United States Patent 10,724,096 (METHODS AND COMPOSITIONS FOR INHIBITING AND TREATING NEUROLOGICAL CONDITIONS) - sequence listing, part 138

SEQ ID NO: 2478 - DNA, 410691 bp, Homo sapiens
ggagggtgccgggcgtcacaggtcctgacagggaagaagttggcaggtcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggtaagggagaacctgctcgcctcacctttgcctctggtcactcctctctcacgtaccgggggagcgactgttcgcagttctttcctcttggcagctctgggagacccttctcagtttgccgggagccacctgcgaagctccccctcgcttcacctaagcgtcccatccaagaggaggaatcatgtggggttgggtggggagcgggacagccaaggctgagctcctgggaaactcagatcgaagtagaagaaccccttctagacatttttgtgcgtctgggggacttttccccttctcgccagtctctggtgcgcccgccgctccccactgctcttttcctgcttctgttttgcctccttccccagtttcttctagcttaactcccagcctggttcgagttaccgatattcgtctgcaccctctggccccgtcttttgcccagcgtggttgactatgccgggactgagacacggcatgcgttccctcggcatcttccgtacagcggagcgtgcaaggagtaggaaaagctgataccctctctcactgaggtctcaaagttaaatgattatcttgtagtttgtagtgatcagcgagattctccgtgtccaaggtgggctagtcaaagtgtgttcgtttttgaatgatggtatcttctggtacttcaaagtttctgctgttacttacaactccactcgtgcaagcttgacggaagttctgatttatgatcactcacattcttcgctcacttcttgaagtgaagtctggttattgtttttgcatagcagtgttatgcctctgcctgaagttttctgccgaaaactttactcaggaggacatttttccatttctgacagttgtgtttggaaaagagtttcccagctattgccactttacttgagattgtgcttttagtattttggggatcactttgtttgcagttgccttgagtcaccttttcatacagtggtcttttagtgcttttagagttatgagttaagtagatcatcagagttaattaagatttatttgctgatacattgacagtctttccagaccagtaatgatctggttttgctattgttacaaatggtattacaggataagaaaatgcatgtcctcacagatcatcataggaagtatctataataaagtaaatatctaattttttttaatagtgaccactgaaatgagatctggcgtgagctggggagagtggactcaaccccccttcccccctcctttttttttgaaatggagtttccctcttgttgcccaggctggactgcaatggctgccatctccgctcaccacaacctccgcctctagggttcaaatgattctccttcctcagtctccccagtagctgggattacaggcatgcaccaccacgcctggctaattttttttttttttaagtagagacggggtttctccatgtttgtcaagctggtctcgaactccccacctcaggtgatccacccacctcggcttcccaaagtactgggattacaggcatgagccaccgtgcccggcaacccccttcttttttttttttttttttcgatacagagccttactgtgttgcccagacgtgagtgcaatggcgcaatctcggctcactgcagcctccgcctccctggttcaagcaattctcccgtactcagccttccgaatagctgggattacaggtgctcgccattacgcccagctaatttttgtgtttttagtagagacggagtttcgccatgttggccaggctggtctcaaactcctgacctcaggtgattcacttgcctcgcctcccgaagtgctgggattacaggtatcagccaccatgcctgccacgcccaccgcccccacccttccttttttttttttttttttttttaaataagatagagtcttgcttgttgcccaggcaggtaactcctgggctcaagcaatcctcccacctcagcctcctgagtagttggaattacaggggtatgccatgatacctggctttcagtgattctcagtatagtaaaaactacagcacttatgttcattctaaattgcggtctaaatgaaaacagtgacaagtttcagctgtggctgttacatgaagtccccacacgttctgacatcgaaacttttggtatatatctgcctgcttatagtctttttatcttctctacttggtgaatgattgttcattcttcacacttccatttcaaactactcttctgtgaagccacccctaatgcctctgggctaagttagaccctcagccaactctaccaatgagccctttatattattttatgatcatgtgatcagggtctctttttcttactagaatgggcattcaccctgggaaaaggtgatgttttattaatttacatcctctgcacctagcacagggcctggttaattgatttttagtagatgttgttcagtgtctgtggaaagcctgagagtaaggacagtctttaagtggcgcatagcacctagtccttagtgtattttatcagtaagctattgctaagtaagaaccgcaacatcacagtggcatacaacagttagtatttattttgttggtgcatctgggggccacctgggagctgaccgacataggctgtagtcatctgggtatctctatgatgcacatgtggtccatatgtctctaatctttggactagtgggctgaagtcctcatggtgatagcagaggtataagagcaagcccaaccacagagacacattttaaacccctgctcacatcatgtgtttatttcctattggccaaagtaagatatttggcaaaggccaaattcaaggggcagggaaatacaactccttccttggaggtgacaaagaggaagtgaatatttttctattacaatttaatcgatcacatatattaaacatttacaagctcttagtaaatgtatttcaaatgaatgaaccattcctatcctatatgcatctagtactggaaaactataaggaatctaagcagtgctagagatatgtgactccttttctcgctcgtgggacatctgaagaacatctgctctgtctacttgttttttcctttaaaattctgtctttccattaccctatagagctccaaggctgtctcatggccttttactttatgttaactattcagtattttctgtgttttgtaattaacaaaacataggttttgagagaaaacctggttgacctagtgcatcatttggttccaggttacatggtaagttgccaagatttgagtcaagcgagtacttaaattagatgaggtctggaagatgatgaatcaatatcagtagaggttatggatgttgttctgttttcctctttgttgagtctcattacatgttgacgaagatggccactggcaactccgggctttcatatccatccagctagtaatccagaagaaataactcttttccccaacatccaaatcatttcctccaaaggactctgataggccaaggttagaccaattgctgtgtccagaatggggcactttggctaacctgggttatcagcctaccctgtggcaggtaaggtaacaacctcactagaattacatagagtgagagaggggcagttcctaaaaggaggcaatgtagggcagatgaaaaagtagcaatgactgttacacacgtatttacaaaccacctaccgaatgaaaaatgttgcctagaggtatgaatacttggctgaagaatctgattatggaatatttcacagttcagtttatatcaaagcaggatgctttttcctggattggctaattgaaaaagttggttaagaggtgaattgtaataacgatacatattccaagtgaagttattttctgagtgtcaaatctttctaggtatttgtaattcttcaaatgtttatagttggcttccaacacctaaactgatagtaaacttttaagcaacttacctttatctttctcaaacattcaacttggcttttagggtaacgttaactccctttcagctctatgttattagttttgtaatatttaattaatgacaagttaaatatttaattgatgacaaatttaatttgttattttgaagaataagtagaataaaaaggtttgtgaagaagcacagttaacttggcaagcatacaacttgacactggcgtcagatgcatctaagtcttgatccagtcctaggtctactaccacgtactggatgctcttcactgatctatatcaagtatttagattgttttggaatgtatttttgtttcacctttattcttgactttgttttatatgcttacttttgctttctctttttcttcataaatgttatcttgttgtattgttcatctttttaagccatcttgaatccttttggtaatagttgtcatataagtcttccataagttgttggaatttggacaactttttactttctaacctcagttttctcttcacttaatgggagtgataacacatactttggaaggttgttttgagtatttgagataatatttgtaaaatgtttagcttggaatctgccacatcatagactcaaaataaatagcagctattgttattattattattattatttgagacaaagtctcactccatcatccaggctgaagtgcagcagtgtgatctcggctcactgcaacctccatgtcctgggttcaaacgattcttgtgccttagtcttctgagtagctgggactacaggtgcacaccaccacgcctggctaatttttgtattttttttggcagggatggggttttgccatgttgcccaggcaggtctcgaactcctgagctcaagcaatctgcccacctcagcctcccaaagtgctgggattacacgtgtgagccaccatgcccggcctgttgctgtgtcttaaaaacgggaaacactatagcttccgcatgtaaaggataaggttttctggtttttacttgcatccctgagcatagattcatatataaatatagggattcagaattctgttaactgtccttttaactgtagggtaactggaattggccatttttgttgagtggatcccaaatgtcagtatctacaggtctttttttcttgttccaatatccgagaaaggaaacctggttaagtatccctaatacaaaaattaaagatcttaaatgcttcaatatccgaaactttttgagagccgacatgttgccacgaatggaaaattccatgcttgacctcatgtgacaagtcgcaattaaaatacagtcaaaactttgttttatgcataaaattattttaaaaattatataaattgccttcaggctatgtgtataaggtatatatgaaaaacaaatgaatttcatgtttagacttgggtcccatcccaagccttctctttatgttttgcaaatattcccaaatccaaacaaatccaaaatctgaacaaattcaaaatccaaaacacttctggttccattttggataaggggtactcattctatattgcactctcctctctggcaggcagatataagactagctgcctattatctggaagctaagtgaaggaaagggatattgatcagaatgaagagcctgttatactactttaagctgtactcgatgtttaagatcagaactgttactcatcttctctagaaatgtatctatcaaagtaccattgtggggaagtgtagttgcctggtgttgatgatgtaatcagggcatctagctactcttctaaaagattttcaaccaatacttttgtgtttagccttactcctctacccatctggtcttcataagtgtttctgtatagttatgatcagtttagttagttctggagtaaacaaacatttcaggttaataaatgggtctttgacttccattgtgttcagttgcatacgttgtttacctaatgggtttagggaccttaggacttgatgtcttttttttcttcttctgatacttaatcttttgacatgaacttatttggtatatagcattgatatttgactaaatagctcattgacttacttaggagaatgagaaaatgccttgactattccttcaccccagataatttcatttgaatattatttaattatataacatgggtatttgaaggaggtcttctaaaagtggtagatgataaggttataacttgatgggagatttgagcatcccttcagttcattaaactaccaatattattgatggccttaaaataactgaatcttctttttaaagcaatgtcaaaagtaatttgacttgatctcctattgcaattacttttacctaacatggattatataaatgtcttatttgttctaaatatgttgcctgttactttcattgagtattagcttgttgtcgtattgtcgatcatgtagatcacgttgtcatactgtagatcatgcagatcatactaaactatgtaagccccttccagtattatacatgtggtgacttaaattattttttacattagcggtttatggtaccattaccttgacatcagagtaccttggtgccattaccttgacatcagagtaatttagactattaaaaggtatttactgtttggagtttaattgggcaagattgaagataatttataatgtctacattttatatttttaaaaatttaatactttgttttttcctaagagtaagctctgttgagtagtttgtttttcttcctgttgcccatagttgacagactataataagaccctgtattattattattatttttaaacagaatcttgctctgttgcctgcgctggagtgcagtagtgcagtctggctcaaacaattctcatgccttctgtgccttctgcctcccaggctcaagcagttctcgtgcctcagcctctcaagaacctgggattacaggtgcatgccatgcaccacctaatttttgtatttttagtagagatggggtttcatcatgttggccaggctggtatcgaactcctggcctccagtgatctacccacctttgcctctgaaagtgctgggattacaggcatgagccaccatgcctgaacaagaccctgcttttgattaagtcttttaaacaattaaaaataaagaaaaccttcaaagagagactaccttttccgatcctccatttaaaaaactaaccttctaaaacttctacatagtatataaaatttaaacatttttcctatgaaatatattcatactgatatattttcttgattattttgatctcagtttgcccttctacacataagaattatgcatctttggaataagtgttccttttttgaaaatagaaaccactctagctactttaagcagaaatgggtttagcatagtgaattaagtgcttacaaaatcactggagaaacagtctaagagtgaatcccagaacaacagagtgccagaacagtataaagctgcaactggccagccaagtgaaatactacctctaccacaataaagaacctgaagctgtctccaggattatatcactttagctgtgatctttggtgaacaggaagctgctgtgccataactatagattctagaagcaaagtatgccataactatagattctagaagcaaccaggagaagtgatgccacttgtgctccctctcactctccattaaattagagagtcaacactggaacctctgttaaagctgcttcagaaaaaccaagtatctttacaactattctaagcagcacaagttggttgtgaattatagttaacaccatctttccttgtttcaaatctcatgttagtgcatctgattagttaaaccaaaatcacatctgaaactttggctgctacggattccaggaaatacagcttctagctttccaactctataaaatagaaaggtatcttggaagctggaatggataggtgatgccggtttatcatattctctacaagcagaggtgttaagagtttagggtctgtagtcaggcagcctggattttaaccttgggtttgactcttgtgagctctctgacgttgggcaaattgcttaactgccctgtgttctagttttttctctcacgtagtaggtatctatcccatagtgttgtttgagtatttaatgaagaatgtggtaagacttgcattaattcttactcagacatgtaatgtaattttcttgtaagcaatctgggcctggagttttctttgtggtaagttttatatttatgaattcagtttttgaaatagtttagactattcggattttccgtttcttcttgtgtcagttttagtagttgtgtttttctaggaatttgtccatttcatctaaatttttaaagttagttttcataaatatccctttattattattttttaatgtctgcaggatttatagtaacctccctgtatcacattgatagttcttccttttttcttattagtcttattaaggatttatcagttttatcaatcttttcaaagaaacaacgtttagtattatcgatcctctctcctgtgtttgttttctacttcattaacctgtactcttttagggatctattttgcttatttttcaaatttttgcaatgaatgcttattaacttttggcctttctgtatttttttctgtaagcctggatttagctgcatgtcatatgttttgaaatgtatttctattgtcattcaattcaaaatactttataattttctttgttttttcagagatagagcctcactctgttccccaatttggagtgcaatggcttcatcattgctcactacaacctcaaactcctatgctcaagcaatcctcttgcctcagcttcctgagtagctaggactacaggcagacaccaccacatcctactaattatttttattttaaaatttttttgaggcagagtctcgctgttgtcaaccaggctggagtgcaatggcacaatctcggcttactgcaacctctgcctcctgggttcaagcgattctcctgcctcagcctccccatcagctgggattacaggcccccgccaccacacctggctaatttttgtatttttagtaaggatggggtttcaccatgttggccaggctggtctcaaactcctgacctctggtgatctacccacctcagcctccccaaagtgctgggattacaggcgtgagccactgtgcccagcctatttttattttttgtagatatggggtcttgccatgttgctcaggctggtctggaattcctggcctcaagcagtcctcctgcctcagccttccaaagtgttaggattacagacatgagccactgcacctggcctatagtttttattatgtgttctttttctgtttcacaggttatttataagtacattgcctagtttccaaatatatttggcttttcaaatatctttttctttatttttgtttgcttatgagtctgaagttattttatatctaagatttttctatcatgggaaatataaaacatatataaagctagagagaacaatacaataatcattcaggtactgataagcttcaacactgttaactcatgaacagctgtgtttattctcacttctcccattgccccaccaccattattttgaagcaaatctcagatgtcattttttctttaaatatttcattatgaacttataaaaatgacattaaaaaatcacaataccacatcaacccagaataattaattgatgtcatgaaatatctgatcagttttcaaattttccccattttgtcataatttttctttataatttgattattttggaggaggatccaaataaaatccaagcattattattggttgatatgccccacacttaaaaacctggcttttagcaacaccagcaaaattattcattatgctaaaacatacataccttgcatactcaatatacctccccattcctaggtaagctttgaaattcaacttttctctcctagctccataggttgttaaagaagcagcttatcttcttggttctttcttttagaattgacacatatccccaggagaaaagtggttgcaaaagtcagagtaacctttgtaggttttctccttttaaagatataagactgcaagccaagtgctgtggctcacttctgtaatcccagcactttgggaggccagggttgaagatcacttgagcccaggagtttgaatccagcctgggtaatatagggagaccccatctctacaaaaaatttaaaaaattaaccagacgtggtggtgcatacttttagttccagctgctagggagcctgaggtaggaggatcgcctgaacccagctgggtgacaggctgggtgacagtgaggctgcgtgacaaagtaagatcctgtctcaaaaaaaaaaaaaaaagatatcagacttgtaaatcttcactgtctttgctctctgatgtcttcaagtaatgctttaaaatattttgttcatcttttatagttatcttcagtaggagatatatctgaattatctaatctgtcattattagaagggaaagtccccttaccacttaaattttgaacattttgaacactaaacttactatatgtttagataacatgactgcaatatttggctttatttcaaaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggtaaccattattctagttaagattttgtaaacactagatttctcttggataagaaaaacaatctaataagaatcatcattatttattctattgagtttacgggcaatctttttcagaacttaggttttacaacttgttttaggaaatcctgctattttaactgggtcttgctgtattatcagactaaaggaaacaagttctcacaaatatagtggcatttgaagataaggtggttgcaaatcaaagggttcatttaaacattctgtcataacatttgtttatgacaaaaagccatgtttgttctgaggcaaagaaggggctgaaagtgaaaacagaatttttccaaactacccttcaagtaataatctgaaaaatcaagctttggtattttttccatttatttatttttttattactttcagaatagaatcaatcttaagactaaaggagaaaattcaactgaaaacactgatattgtaagaagcatatggactgttctgactttaaaaatcattagaaaagagacaagagagttacagactgcaataacaagataccattttactgaattaattttctctcacagttatgttctagcatgttgcaatattactgtaggtgtttgattttataaaatctgccttttctgacagtatttcacattttgaaagggagggaggagcacatttacagtaactgtaagaagagcaaaaaacattttaagtgtaaatgtgactgaataaggtttaggtgaggctaggaataattttaagaaaaaaattttcacaaagggtatctttttatagtatatgtttctcgagctattttagtttagaatatctaagctttaaaacataatagctaaaaattgggatttggataaaaattgactaggttgggcaggaaagaacaattagaatctggttttataatactattttactgaaaatgccggctgggcgcagtggctcatgcctgtaatcctagcacttcaggaggccaaggtgggtggatcacttgaccctaggagttcaagaccagcctgggcaacatggcaaaaccccacctttacaaaaaatacaaaaattaattgggcatggtggcatgtgcctatggtcttagctactccagaggctgaggtggaaagattgattgagcccgggaggttgaggctgctgtgagctgtgccattgcattctagcctggatgacagagtaagactctgcctcaaaaaaaaaaaaaaaaaaaaaaaaaatcaaagtaaagaaaatgccaaataaaatatataaacttacagattttggggtgtacctgtacattaattatgagattctcattaggataccccaactgctttgccttttgatggagataatcagttttgtccttggttagaaaggaaagaaaggtatatgcttactctgtgtcaggtacagagctaggtgttttgatgtattccatttcaagtgatccttacaataactttgtgaagcaggaatggaaatgattaaacatttagaaggaaatgaaagacaagaaaggacagagtgatccagtaggggtctttaggtataaagttctaaaacttatcttctgcatccactggtgaaaagagacaataagtataaattatagcaagaataatttcctgacatcttcaaggccctggtaagggttagccagtgagaatgtgaaatagtctcttcttgagatctttcaaagcaagtcatggttatccacttgtagagatgatcctcatgtagtactatccagagcccaagctatagagtaaactgggactcctttccaacagcattgttctttgtgatatatcttcttgtgatatatgaaagaataaatgtatatctatacaaatatgacattgagttggaaaaaagacacgtgactgagctaaagtgttggcttcattggctgccaagattttttttttcaaactagttagtatctgtccacattagtgcaaaaataacagtactttgggaggccgaagcaagacgatcacttgaggccaggagttcaagactagccttggcaacatagggaaaccctgtctctacaaaaaattttaaaaattagccaggggtggtggtatgtgcttgtagtcccaggcactcaggaggctgaggcaggagaatccttacagcccaggatttcaaggctgcagtgagccataatcatgccactgcactccagtttgggcgatagagtgagacccctttagggattacaggcttgagccaccatgcctggccagggtttctgttttttttttgttttgttttttaatattacttggaatagcccaaagcagtggtttagaagtagttttgcaatgaagtggagtactctcatcttcctctatattttttaagtttgtttaatcagcagtaatgatgattgaaaaaaaagggatgaatagtgttaaattcaaaccaataaatatttaatagcaccttctatatatatataaaaaaacagaaataaatataaatatacaatactatgcttaaggagctgaaatagataaaagttaaataataaaaataattaaataaggaaagttaactattcagtgtaagaactctcaccaggctgtgcataagtactttcaaaatgagtggaatactcacacttaatagaagtttagaggtaggagtgagttttggaaatgatttttaaaaaaactggatctggaagtacttgaaagttctgggagaaggggatgcccagatgatggcaaagatactagaaaatacacagggtaagaaagagcaagacagaatcatcagaggctactgagaagaggccattgcagtctttagctggaggaatgattatcaatatatattatatggtggatctgctccaggttcttggttttttttttctttttagagaaggagtctcaatctgtcacccaggctggagtgcagtagcccattctcagcttactgcaacctttacctccagggttcaagtgactctcctgcctcagcctcctgagtagctgggattacaggtgtgtgccatcacacctggctaatttttttgtatatttaatagagacagggtttcaccatgttgggcaggctggttttgaactcctgaaatcaagtgatccacctgccttggcctcccaaagtgctgggattacaggtgtgagccaccacgcccagcctgctccaggttctattaaggggctaagcattggagattttgggctgggcacagtggctcatgcctgtagtttcagcactttgggaggctgagaagggtggatcacttgagcctaggagtttgagaccagcctggccaacatgctgaaaccctgtctctactaaaaatacaaaaaaaattagctggacatggtggttcatgcctgtaatcccagtatcccagttactcggtggctaacacatgagaatagcttgaacgtgggaggtggaggttgcagtcagatgagattgtgccactgaactccagcctggtgacgaagtgagactctgtatcaaaaaaaaaaaaaaaaaatagacactggggatgttacaagttcctcacaaatcataattgtaaaccccattttcactttctcagttcttatcgcctaagatcacctgccacagcttaacagagataacacacacagggtgatcagcacttgttatcaatacctattagttttgtctatcttaaacttttgctacccattcatttctgtctccttaaagttttattagagttgaagtgaatacccccaagagggttaatgcctaggtatttgtgaattcaaaatacctagttgtatcttgtttatataagcagtgaccttaaaaactttgaccattattttctgtcagccttacatgataataattaaaatgaaggaataattttcccttagtgacttttcatctgaagctaaagtttaaacaatgtaaaagttaggttacaaaactcccaaggtttgttgtcgtctttgtctacctgtggatggtgactctttgtttcaaattacgtgttgagagttatgaaatgaaaatccagggtatgactcctggattttgttccttgacaaactattcttgcctttctggtactttctttcttcctcttttttgagacggtctcactctgttgcccaggctggtatgcagtggcatgatcatagctcactgaagccttgacctcccaggcttaagcaatccgcccgccttagtctcccaagtggctaggactacagttacatgccaccatgcccagctaatttttgtatattttgtagagatggggttttgctgtgttgcccaggctggtctcaaactgctggggtcaagggatctgcctgccttgacctcccaaagtgctgggattacaggcgtaagccactatgcctggactttggtactttgtttcttagaactttgtagaagaggctcttgttattagatagatgcaagtatataagctaagagacaccaggagatgtttataccaaaattctttgattaaaatttccttttccctatctcataaactataatatattgttgtataaagcttgctgtgtagatacaagaaattgttcctatctcccatatttcaacttaattccagcacagcaggaatttgcatattctggaagctttaaattgcttccattatatatggaaccatagaagtgcctgagttattcatttataagtgtatacgtgtcttaggtatagagaaagctgagaggcctgaactgtccttctttgtttgaagaagactactgttactatggtaattgctgaattagaaggctagaactcttgacttttgccttgtcctgggaacttagaatgggcaaaaagtcaagaatgactttgtctttgactgtgttgcatctttctattataacaaatgcactacaccgagatcataccttccatttctagggaaagaaaaagacaaaccaaaccctcacctcattattttagttatatagcttgtgaatgttcagtaaataaaaactagtgattagatggtttgcttatgaaattagatgtatggcagattatttttgtatgtgtagtataacctaggtacgtatatagagcttggcgaggctggcatctaagacaaatacgaatactgcatctatatttaaaagcatagttttattgttagtagtgatattaacaacagaggtgattatagcaataaaacaacgttttttaggacctttaaaatatgatccgtagtttccagaaaactgtgaattccattgtgtcacatttttatggatcttaaatcatagatatgggctagtataacttagttttctaatttgttttaaatttcattgcaattttttatgtaacgtgcttacatataaatatactgtttcagtaaattgaaatgttcccttaaacattttccaaatcccaatatagtacatgtagaaaccatctactaatttcctaaaacccatgagactggaaaacatctctttagctatttttaaaatttgtaatttttaagcacttatttttgaaagaactccaaagcatctagaattaagtttgtttgtttgtttgtttgtttgtttgtttgtttgttttgagacagagtcttgctctgtcaccaggctggagtgcagtggtgcaatcttggctcactgcaacctccgcctcccgggttcaagcgattctcctgcctcagcctcctgattagctgggactacaggcatgtgccaccacgcccagctaatttttgtatttttagtagagacggggtttcaccatgttggccaggatggtctcgatctcttgacctcatgatccacccaccttggcctcccaaagtgctggtattacaggcgtgagccaccgcgcctggcctagaattaagtttttaaaaccttctgaaaacctctcctctttgttcttctgcagccttttaggacccactccactctctggcttactttgtatttttggatcaattttcttttactcacaatacaatttacataacaaaatttgctattttaatcactttaaagtatgcaattcagtggttttaagtatatttacaatgttgtacagccttcaccactattccagaactttttcattaccctgaaaagaaaccccatatacattggctgtaactccccattctccttcttcctctagtccctggcaaccagtacttgactttctgtctctatgtgttgtctgttctggacactttatgtaaatggaatcctacaatatgtggccctgtatgtctgtcttctttcactgagcgtaatctttttaaatttaagattcagccatattgtaccacataacagtacctcatactttttttatggcatcccactgtatggctaatgtattttgtttttttcatcagttgatgaacatttggattgtttctaattttgggctattatgaataatgccactatgaatatgcatgtacaagtttttgtgtgaacatatgcttttaattctcttgggtatgtacccaggagtggaattgctgggtcatgtggtatctctatgtttaactttttgaggaatagccaactatttttcatagggctgtaccattttatattctaggaatgtatgagtgttttagtttctccccatacttatcagtgaagcacttgttaatttttcttcttttttaaaaaatattacaacccttatagtggatatgaagtgatatctcactgtggctttgatatgcatttctctattgtctaatgatgttgagtatcttttcatgtgcttattggccatttgtattttttttcttttttttgagaaatgcctattcaagttctctgcctgctttttttttaatgttttattttctttccaatgggacttttgcactcctgtctttgtgtttttaattgagctgtctctttttattgtcagagttatttttatatattctggatattagaccctatcatacatgtgatatttgcaaatattttctcctagcctgtgcattttcttttaactttcttgatatgtagtatcttttgatgcacaaaatttttaattttgatgaggtgtaacatgtctattttttcatttgttatctataattttaatgtcatatttatccatggcttgcttttcacctctagtttcaacctcttggcatgtttaggcttcagatttttcctctagcagcttttctttttccctcttcaaataattatctgccccaatgactcgttcctcagtccttactcagcaggccatttttaggaagaaactcaaagttcctcagttctaggatagctttaggtgcttgtgaaaaaaatggtttggccctggggagaagaatctggccattgttaatggtttgggataaagctttgaagtttaggacaaagatagagtgaactttttatactctgagtatgttggcaaaaaatcgtagttgtcacataacattaattacaagtataatgctaagactgaagtttttaagaatttaagtttgagcagtttcttttgttataggcattactagcgaaccacagagatcagacaggacctaggtaaatagttgaaaaactaagactagacaagagcttgtagacttgacgcttgaataaagtagatgactcagtgaaaaagaacagtccttaagtttggaacaaatgaaatggaacttgaagtaaccaaactgaatctttgtcatactatattgatagcagttttcctataattagaactaacttcttatagttttgaaaatagtgattattaacattattctttcataagatgccatcttttagggtttttaaaccctgataacttcatggataattgatttcatttttataagtatcttagaggtataggatgaggtttactgtttctccactgcctacccccttaaaaaggtcatatggtaagcattctgtttctttaagaaataatgctttcggccgggcatggtggctcacacctgtaatcccagcactttgggaggctgaggtgggtgggtcacgaggtcaggagtttgagaccagcctggccaacatagtgaaaccccatctctactaaaaatacaaaaattagccgggagtggtggcagacacctgtaatcccagctactcgggaggctgaggcaggagaatcgcttgaacccgggagacagaggttgcagtgagctaagattgcgccattgcactccaccctgggtgacagtgcaagactccatctcaaaaaagaaataatgctttccagaatgacaagttttgcttcagtgataagttgaaatcaaattttttattttgaatagtgtttttaacttttaaaacatgtacttaacttctattatctcagtttgttttttagaaattaaaaaaaattaccattattacaaaatatgtgcatgttatttctacttgtttcagatttaattacaagtatttatttcatcctgatatatgagagacagagagggagagagacagatgcaagaagaagagaatattcttattaaaattaggccataaaacaattccacttttagcaatgtatcttaagtaaacaatcagaaatagatttgatgttttccacaagaatgttcactgcagcagtgtgcacaatagtacaaaattgggcacaatcttaaaatccaacataaagttctggttcaataaattatggtgcagacatccattgaacttggcagccattaaaatcatattatgggatattacttaatgatgtgggaaactgtttataatacatactttgttataattggtgaataacaaattgcaaaacaatatggacaagtgctttcagttctttaataaaaggaatatgtgaacatagaataagatttgaaggctgcgtaccaaaattctcatgttatctctccatgttaggattatgagcagttttttcttgaaggaaccgtatattgcttttatattaaaactttttttggatttcaatactgtattgttgataattttaatagttttatcttacacttttttttttttttttttgagatggagtttcgctcttgtcacccaggctggaatgcaatggcacgatctcggctcacagcagcctctgtctcctgggttcaagcgattctcctgcctcagcctcctgagtagttgggattacagacgcctgccactacacctggctaatttttgtatttttagtagagacagggtttcaccatgttggccaggctgatcttgaactcctgaccttaggtgattctacctgcgtcaacctcctaaagtgctgggattataggcgtgagtcatcttgcattttggaggttaaatattttgctcattttcatcttttcttagtatttactgtagttttccatattagtgtaaataacctcatctctacctagaatcttataggcccagagaagacaaagaatcattatgttattatgattgttttatttgtgattggtgactttgttttttcagattatgatactttggggcctagtgcttatttggtcagtcatattgcaaataacttttttctttttctttttctttttttttttttgagacagagtctcgctctgtcacccaggctggagtacagtggcgcgatctccactcactgcaagctccgcctcccgggttcatgccgatcttctgcctcagcttcctgagtagctgggactacaggtgcctgccaccacgcccagctaatctttttgtatttttagtagatacagggtttcactgtgttagcctggatggtctcgatctcctgacctggtgatccacccgccttggcctcccaaagtgctgggattacaggcgtgagccaccacgcccggccaacttttttcatctcatttaattaccctgtcaaaggactgggcctctgtggcagaaataaagaaaagctctatttttatggaaagggtaatacagtttacacgtattctcttactatgttttagtttgcttggctgccaaaacaaaacaccacatactggggggcttaaacaagagaaatttagtttcttgcagctctgggagctagaaatctgagatcaaggtgttggcaggtttggtttcttctgaggcctcttccctttggcttgcagatggccgccctcacactgccttttcggaggccattcctctgtgcatgcatgaccctgatgtctctctgtgtcctacctcctcttttttttttcagttgataatttattttattttattttagttttattttttgaggcagaatctcgctctgtcacccaggctggagtgcagtggcgtgatctcagctcactgcatccttcacctcccaggttcaagcaattctcctgcctcagcctcccgagaggctgggactacaggcgcatgccaccacacccggctaatttttgtatttttattagagatgaggtttcaccatactggccaagctggtctcaaactcctgatcttgtgatccgcctgcctcggcctcccaaagtgctgggattacaggcatgagccactgcacctgacccctttttttaatttgtaatttcaattttcatttttttccataagttattggggtataggtggtatttggttgcataagtaagttcttttgtggtgttctgtgagattttggttcacccatcagctgagcagtatacagtgtaccatatttgtttatcccttgtacccctcccactcttccccgcaagtccccaaagtccattgtatcattcttatgcctttgcatcctcatagcttagctcccacatatcagtgagaatatatgatgtttgattttccattcccgagttacttcatttagaataatagtctccaatcccatccaggtcactgcaaatgcccttaattcattcctttgtgtagtattccattgtatatatatatataccacagtttctttatccactcgttgattgatgggcatttgggttggttccacgattttgcaattgtgaattgtgctgctataaacatgagtgtgcaagggtctttttcgaataatgacttattttcctctgggtagataccaagtagtgggattgctggaccaaatggtagttctacttttagttctttaaggaatctccacactgtttccatagtggttgtactagttttcattcccaccagcagtgtagaggtgttccctgatcacagcatccacgccagtatctattgttttttgactttttgattatagccattcttgcaggagtaaggtggtattgcattgtgcttttgatttgcttttccctgatcactagtgatgttgagcatttttttcatatatttgttggccatttgtatatcttcttttgagaattgtctattcatgtccttagtccactttttgatgggattgtttgtttttttcttactgattcgtttgagttcgttgtggattctgaatattaggcctttgtcagatgtttagattgtgaagattttctcccactctctgggttgtctgtttactctgctgactgttccttttgctgtacaaaagctccttagtttaattagatctcagctatttatcttttttttttttttttttttgcatttgcttttgggttcttggtcatgaaatccttgcctaagacaatgtctagaagagtttttccaatgttatcttctagaattttgatagtttcaggtcttagatttaagtcctcaatccatcctaagttgattttttataaggtgatatgagtatccagtttcattctctgcatatagctagccaattattccagcaccatttgttgaaaagggtgtcctttcccccactttttgttttgtttactttgtcaaagatcagttggctgtaagtatttggatttatttctggtttctctattctgttccagtggtctctgtgcttatttttatatcagtaccacgctgttttagtgactgtggctttatagtatagttgaaatcaggtagtgtgatgcctccagatttgttctttttgcttagtcttgctttggctatgcaggttcttttttggttccatataaattttagaattgttttttctaattcggtgaagaatgatggtggtattttgatggggattgaattgaatttgtagattgcttttggcagtatggtcattttcaccatattgattctacctatccatgagcatgggatgtgtttccaattgtttgtgtcgtctgtgatttctttcagctgtgttttgtagttttccttgtagaggtcttttgacgtcttggttaggtatattcctaagtattccttttttttttgcagctgttgcaaaaagggttgagttcttgatttgattctctacttggttgccgttggtgtatagaaaaactattgatttgtgtacattaaccttgtatttggaaattttgctgaattcttttatcagttctaggagctttctggaggagtctttagggttgtcgaggtaaacaatcatatcatcagcaaacagtgacagtttgacttcctctttactgatgccctttctttctttctcttgtgattgctctggctaggacttccagtactatgttgaagagcagtggtgagagtgggcatccttgtcttgttcctgttctcagagggactgctttcagcttttccccattcagtattatgttggctgtgggtttatcatagatggcttttattacattaaggaatgtcccttgtatgccagttttgctgagagttttaatcataaagcaatgctggattttgtcgaatgctttttctgcatctattgagatgatcatgtgatttttgtttttaattctgtttatgtggtgtatcacatttattgatttgcatatgttaaggcatccctgcatccctgatatgaaacccacttgatcatggtggattatctttttgatatgttgttggattcagttaactggtattttgttaaagatttcaacatctgtgttcatcaaggatatcagtctgtagttttcttttttggttatgtctgtccctggttttggtattagagtgatgctggcttcatagaatgaattagggagggtttcttatttctttagcttgtggaatagtgttaaaaggattggtaccaattcttctttcaatgtctggtagaattctgctgtgaatccatctggtcctggacttttttttgttggtaattttaaaattaccatttcagtctcgctgcttgttattgttctgttcagggtatctaattctcatgctttactgactgggctagctgggtgcctcagggtatctaatttttcctgatttaagctaggagggttatatttttccaggaatttatccatctcttctaggttttctagtttatgtgtgtaaatatagtagccttgaatgatcttttgtgtttcagtggtgtcatttgcagtatctcctgtttcctagtgaggttatttggattttctctcttcttttcttggttaatcttgctaatggtctatcaattttatttatcttttcaaagaaccagctttttctttcatttgtcttttgtattttgttgttgttgtttcaatttcatttagttctgctctgatcttggttattttctttcttctgctgtgtttaggtttggtttgttcttgtttctctagttccttgaggtgtgaccttagactgtcagtttgtgctctttcagtcattttgatgtaggcatttagggctatgaactttcctcttagcatcacctttgctgtatcccatagattttgataggttgtgtcattattgtcattcagttcgaagaattttttaatttccaccttgatttcgtttttggcccagtgcttatttagtagcaggttatttaattttcatatatttgcatggttttgaaggttccttttggagttgatttccacttttattccaccatggtctgagagggtgcttgatataattccagttttcttaaatgtatttaggctcgttttatggcctatcatatggtctgtcttggagaaagttccatgtgctgttgaataaaaagtttattctgcagttgttggacaaaatgttctgtatgtatctgttaagtccatttgttccaaggtatagtttaaatctattgtttccttgttgactttctgtcttgatgacctgtctagtgctgtcagtggagtattgaagtcctctactattattgtgttgctgtctatctcatttcttaggcattagtaattgttttataaatttgggagctccagtgttaggtacatatatgtttaggatcgtgatattttcctgttggacaaggccttttaccattatgtaatgtccctctttgtctcttttaactgctgttgctttaaggtttgttttgtctgatataagaatagctacgcctgctagtttttggtatccatttgcatgaaatgcctttttccacccctttaagttaagtgtgagtccttatgtgttagatgagtctcttgaaggcagcagatagttggttggtgagttttgatctattttacggttctgtgtcttttaagtggagcgtttaggctatttacattcattgttagtatcgaaatgtgaggtacccttgcattaattgtactctttgttgcctgagtactttgtttttttttgtttttgctttttaacttgtatttttgttttataggtcctgtgtgatttatgctttaaagaggttctactttgatgtgtttccaggatttgcttcaatatttagagctctttttagcagttcttgtggtggtggcttggtaatggtgaattctctcagtatttgtctgaaaaagactgtaatttccttcatatatgatgcctacttatatgatgccttgtttcactggatacaaaattcttggctgacaattgttttgtttgtttgagaggccccagtcccttccgcattgtagggtttctgctgagaaatctgctgttgatctgataggattttctttataggttacctggtgcttttgcctcacagctcttaagagtctttccttcatcttaacttttgataatcgatggcagtgtgcctgggtgatgatccttttgtgatgaatttcccagagcttcttgtagttggatgtctaggtctctagcaaggccgggaaaattttccttgattattcccccaaatatgttttccaagcttcttcctcaggaacaccgattattcttcagtttggtcatttaacataatcccagacttcttggaggctttgttcatattttcttattctttttctctttgttggattgggttaatttgaagatcttgttcttgagctcggaatttctttcttctacttattcaattctattgttgagactttccagagcatttcacatttctaaaagtgtgtctgaagttttctgacattttgactgttttttcttaatgctatctatttccttgaatgtttctgccttcacttcttatattgttcttttggatttgcttgcattgggctttgcctttctctggtgcctccctgattagcttaataactaacctcctgaattctttttcaggtaaatcagggatttcttcttggtccggatccgttgctggttaactagtgtgatttttttgggggtgctaaagagccttgtttagtcacattaacagggttgtttttctggttccttctcatttgggtaggctccgtcagagggaaggtctagggctgaaggctgttgttcagattcttttgtcccactgggtgttcccttgatgtagtactctccccgttttcctatggatgtggcttcctatgagcagaactgctgtgatgtctctcctgggttctagctacccagtgagtctacctggccctgggctggtactggaggttgtctgcacagagtcctgtgatgtgaactgtctatgggtctcttagctgtggatactagtgcctgttctggtggaggtggcggggtggggggtacaatggagtccgtgagggttcttagctttggtggtttaatgctctctttttgtgctggttgacctcctgctgggaggtggtgctttccagagagcatcaactgtagtaatacggagaggaactggtggtgggcggggccctagacctcccaagagtatatgccctttgtcttcagctaccaggctgggtagggaaggaccatcatgtaggggcagggctaggcctgtctgagctcagaatctccttgggtgggtcttgctgtagctgctgtgggggatgggggtgagattcccaatacctcctcttcttataaagaaaccagtcacattgcattagggcccaccctaatgaccctattttaactaaattacctttaaaagccctattgctaaatatagtcacctttcgaggtaccagggttagggcttcagcataagaatttggggaaagtgggaggcacacttcagtccgtaattctatatatcacttatgacaagttttaaatgacaaagtgaatgttgaagtaaatttttatgaattatcaatggttattacaaacttttataacattctaaagaacttcagctgtaaattatatgggagagaatgtagaggattgtagatggattagcactaattttttttttcccctgagaaactcaaactctatgacctattgcacaattgagtctatttgtatataacaaatagtatttttcataggtattaataaaatatcagtgtcaagtcaaatatttaaaagagttgttaactgaagcgggattagaattaaaggcattagaattaagattagtgggcaaaagatacaaaaactttgctccctgacattcataactgtctgtagatggaatagcagacctgaagattggctatttctttgtgactgaagttctgaattttttgtgctgttatagagtaaatttatgtattgttgagtgtggttctggaaggtgatgatttttcagcttgattctctaagtatactgtgtgggtttttggctttaaaaaggttaagaacttccctttacataatgaaaacccaacaagtaaatattatttgttagtactttaagatgtagattaatcatttaaaaagtcattatgttaaatattctgaggaccatactgttatttctttccttctccctctagtgggcagaaaatattcttaaaatatagcatggaataatttattgctattgggtataccataatatacagtctcagtctcagcttttttgaatactaaaaatgttaacatttcagaatcattaaagcaaacgctttactcctttctaggcataatagtggatccttgaatgttgaagatgtccttaccagctttgacaatacaggaaatgtttgtaagttatacattcactctatagaaatatatttagtgttttacaaagtgaatttatagttgatgttttcttctcactaatatttattatactcactaaatgtatgcatatatgtatatataatagaaagtttgactgtctttagctgcaaaataagccttgtataaggtacaccgacaaaatgggatactgcagtttctaaacttcgcaggtgtgtgtgtgtgggggggaggtgggggagggagagagagagggagatggagagagtaggtcagaaagaacactggacactgaagtactgtcccttttatttttgtttccattttgacctcagttaattcagtagtggggctgtttcttccttctttgctttgtttcgggtgctttctttgccattccctgcttctttactttcactgtagaataaacccagaacatatttttcttgatgctactatacattaataccagagtgtttttgtttgatgcagtattacaatattacagaatatattgccttttcatcaaagcttctgattaattggtgatagatttgtccactgagaaaatcacttaaatatttcttataattcttgtaattaatttcatgtgatgaaagacatcagccaagaatacctttatgtcactgagttaaacagcataccatcataggagctatggactttttatgttttttgtataggacatttctcttaagatagtgaattgtcaatgaaatatgagcattttaaatgtaaaaatagtactcatactctttttctcaaagaaaatttcagaactgttaacttttggctgaatttaggtagtgtctttggcttaacaatgcagttttatcaaataaatagatttgcatagaattgtgttcagtaatactcagacaacacttttgttcttatgtccacattatgataagcttttgattttatagaaaaatatttgtggttcactaaggaatctataaatgtccttaaattatcctaaatacctaaaataatgtaggtttcttttttatggatagtgactgatgtgccttttagtttctttctttttttttaaattttccaaacaccaacttgaacccgaatgccttttagtttttccatgttggcatttagtgaattctctcccacttaggtgtatctcatatttttattaggtctaggcaaggactgggcaaagcataccaatgatggttgaggatacatactcttttagttctggggtaatgttaaatatcattgagtcaggcttaaacatatgtaatttcagaaaatgattctagaatgttaaatgtggaatttttgattcagtaatgtaaaagtcaagtattgttcccagttggctccgtatgaaatagggccactagctgacagcattatgtaaaataaaaataatttcctaaaggcatcaattattattttaggcatgaatgactgtcttagccttctctaacattttttcccatcaacttgttccataccccgtgttgttgttgcatgaacaaacggaaatattgcatattcagggtgttttttcactgttgtctcttgtttggtagaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattattactggcgatgagtacctatataacctcttttggttttttcctaataaagaagataatattattaggattattctgtcttatactattttaattgaactaacagggcagaaaaattagataaaattagcaaaatagctgtttattaaaatgcctcattataaatgttgccttaaaaacctggatatattgctgagtgatagaagtggtgacaaaaataagacctcttaaaatatgttgttttgtgtaccttttatgtttactttttattttaacagaaaaatctatatagatgtttcatttaatgataaattggtaaagtcctgttccaataaagtaaatattgattatgacttttatataatcttggacgtaaagtaaccatggactgaaaaagtgatttttcacttgatgcctcaaaaatttgattttattatgccaatagtgatattgagtttgtgactagaaaacccagcagagggcgccacaatcataattctttgtcatagcccaatataattaggataaatagctcaaataataaccctaagcttttaccatgtagacatataaagatgtgtctaaacatttctatttgattcatttataatatatttaatatattcagtaattcaaaaatacaaaaaaatagatttttcctggccgattttttaatttttaaaaatatcagtttaatttttctacttctagctttaaataaagaagtacttttgatagagagtgaaagttccatacaagagtatcagttcataaatcaccaccatggtagtatgttaaaggacaattagaatgaggaaaaaagtttctaatagatgagagaaccaagagatggaattatctatttattttaagaatttgtttctaggttaataatgcttcctagtaatagaaaaaacagcttaactaaaacattttctagtcacaaaaacctgatatgtgtagatacagtaaaaaaaggtatggtcatggtttagtagaaccattaatttcaattgtaagttcattttgaatatcaggggatgattatattcattgcaaattttcagagatgaaaggatcagtcttaccttctgaattggtttatgctctaagtgaaaagacgtggaaaaatctctttaattttggaaaataaacctctagataacttatttactattagaaaagataatttttttgtatttacttttttgtatagaagttttgtggttttaaatgtatgaactgcaaagtgttttatatttttgaggtaacttttcattgcttgaatttcttcgaatgttgtgggaagaaattaagaggaatctcgtacagaatgaatcacgtctgcgtattgatttattgctgtgtgatatacgacccaaccttctttttatatatttatatttactatggtggaaaacaaaccattttgaaagtgcttacctttaactaggaataggtatgtatatttcattatttggtttctactacttgagaacctactttcttttgagatatcaaagcttcttggtcaggaggttgtgtctactattgattcattgtgcccagaaagacatgctgacaagctacctagggaagagtataggatgacatctttcacctcagatgaggtactggctgcttctgtgtctcctttgatatgtcgctcagataccttgggtaacaagggagtgctctataagcattgtagcagatttcttgcttctgctttttctgtgggcagggactcctttctagcttgtcctctgacctctggtcaaagaagctgcaccatgctgtctcttccaaaatcattttccttttctccaaagttatttcgttccactactgaaaggaatttttaaaaatgtaattctcagtgcttacttgatccaaatttggataccatagtatctaatttaactatttgttgtttataacatctcatcttatgcttgggtctgtagtagattcattggaacattttaagcacatcatcctttgttgagtagtatgaacagaagtgttagtacttcgtataatttattataaactatgtacaatataatgtatataatcctttaaaggataggaggtcagcagttaaatcatttcagtaatatcattgtgaagcaggattcctggcaaatgttgcagcttaagtctgggggatgtattggtaaaacttctctactattctttgaaaaaaattttttttcttggttgagctccatgacaggaccctgtggtagttggtgtcacattatctcctggaggaatttgtagaccctctgccatatatacttgtacatgtgacagtggtgatttttgttttccctagtgaattctaagactgaccaggattttttttttttttaatggagtttcactcttgtcccccaggctagagtgcaatggtgcaatcttggctcactgcaacctctgcctcccaggttcaagtgattctcctgcctcagcctcccgagtagctgggattacaggcgcctgctactatgtccagctaatttttgtctttttagtagagacggagtttcaccatgttggccaggctggtctcgaactgctgacctcaggtgatttacccgccacagcctcccaaagtgctgggattataggcaagagccactgtgcctgacctgaccaggatttttaatgcacacagctatagactttgcttcctagtggtctgatagcagaatctgtttgtctgtttgtgatgtatctaaaactgatctcttttggggtggtaatcagttattattgaaagcaagactcattaaaataaaagtcaggtgtggaggtatgttcctgtagtcccagctactcagaaggctaaggctggatgattgcttgagcccaagaatttgaggcaagcctgggcaatatagcaagacttttcctgtaaaaaaaagacaatcaaatatttatcttcctggtttttctagaggaaaaaaaattatatgttttcactttttacttgtatttaggaaaccaaaggtaatagtttctttggaaatatggtctaaatttttagtttttctgtttcattgttgttatgttataaagttagggtttggaatgttggtgaaattatcaaagcttcaagaatgtcagcttggattttaaaatgctattcttattcaaataaagatgtctatatatgtaatgcatatgtatgtgtatatgtatatgtagttatataatgcatatatgtagcatgtgtgtatacatatgcatatatacatatatgtagtatatgtgtatacatgtacatatgcagatatataatgcatctatgtagtgtatgtgtatacatatgcattatatatacatgtatgcattgtatatctatatttatatacagatatatacatatacacagtacagtggtttgattaaaaaatgaaaaagttgggcttttatgggtcattgctctgtttttaatttagagtggttatggaaggtacatgggatatgaagttcaggttttagctctgcgggttattagctgtgtaattgtagacgagtctttgtacaagtcttaactccttatgtaaaattgaataggaaacaataagtactttatagtgaggtgaacataatattagataatgtgaaagtaccaagtaaactgtaaatagtatttgtattttttatggttagtaatatcatctgcctcattcttgaattttttcagtacctttgttattcaaaataatacaagatagaagatatttttggtatgtgccattctgttttaatatcatacattattttgttatgtgaaaacaatgtaaagctacacaattaaaatagtgtggcattattgcagaaatacacatataaatcaatatttttagaataaagtgttcacaaagacctaaatatatgtgacttaacatatgatgaagatacaattttagtaagagaggaaaggatggattctttaataaatagtattgggaccattgcctaggaatttaggaaactaataaagctgactccctcctatatactatatgccaaaataaatttaatatgggttaagtatttaattaaaaacataacactcttagatatttcagatgaataattttaatatattgaaatcaagaaggtccttctaagtgcgagtcaaacaccatgaatttaaaggttaatagattgactaatttaagatttaaagaccctttattcaaaaagcgcatcaaaaaaattgaaatacaaattacacactggcaattattatttatgacatatattcagatgaagatgtattttctttataaagagctcttacaaatccataataaaaagacaatctgaaaacctgtaagatagagaaaaacgtagccaaaaatttaagaagaggtatttcacaagagaaatagcaatgttctgtatgtacatcaaatggttattttattaggaattgaaggaatgatttttaaaagtgagataatttttgcttatcaggttggcaaagatgaaagaagttaagcagtaatcagtaaattgtagggaactgggtattctcatacactgttggtggaggggggtaggtaaattaattctacttttccagaggcagtctgattatatctttcataattttaaatatccatatctttcaactaatgattacctttctaaaaaaaaaaaaaagaaagaaagaaagaaaggaaccaggatgggaactgtggctcacacctgtaatcccagcactttgggaagccaaggtgggcggatcacaaggtcaggagatcgagaccatcctggccaacatggtgaaaccctgtctctactaaaaatacaaaaattagctgggcgtagtggcgtgaggctgtagtctcagctactcaggaggctgaggcagtagaatcgcttgaacccaggaggcgaaggttgcagtgagccgagattgcaccactgcccttcagcccaggcgacagagtgagactccatctcaaaaaaaaaaaaaaaaagaaaaagtacacaatattttgttttaaaataatacttttcttgaaggagctcacagcatgttagatgttaatgtattagtcccccattacacttatgagataaggaatcagagatcaaatcattttaaccctttcttaggttgggaaagtacaaagaggttaaagtcagtcagtggcagaatattgagctttgggaatagaaaatttataagttgtgttacaaaataaatatttaaggtcatcaatgcattatgtggttagaacgcatgggtaatgatcagcagccctgagagtataggggacctgaaagccagtggagcactgatggtatgcagcatggcagtggattcttagtccctctttagcatcgtaatgtacatgtagtctttgattcttagtctgtgttagaatttttgaaggttggcttcggttgctagatggcaatttccctagccatgtgtctccaacttcttagctccacagttgtcaggacggttttttcttttggctcaaaatcaggtaagcgtgcccctaattcataaacagagccctacacgtttgttatcaattaccagagaaggaaaaagacacatttgttatcaattaccagagaaggaaaaagacacatttgttatcaattaccaaagaaggaaaaagaagtctctttttaatgtattttaaaaatttctatttgaaataagaaaccacagaattggaatgattctttgacagtagaacttggtgctatcatgggaactgactgaaataaaccctataatcctttgtagattcatatgccttaatcagtgcaataatatagagaggtagctcatgtctttgtcataaacctgctagtttctccctcttttaaatatctaaagggatgtttctaatttaggtacttccaagttttagcacaagatatgccaagaaagtctttttatttttcccccgagcaaatactgagtagttttcctttgtctgtcttttaaatagctaccattacttttgcatcctttacagtatttgtcaggagctttgtaagtactgtcccgtttaataatcttaacgtctttacaaggggtgaggaaactgatgtccagaacaaggtaatttgcttaaagatttagtaggtggtggcacaggaatttaactattctactttatttcttaaaggctacatttctccaaaacggcgagaaatgaattttaaaagtttgtgatgggaattgaaacagaaagtggtaacttgaagggctagaaaataactttggcaaatggaattctgtgcagcagattgtgtctcagaggagactgattaaaggtcaagaaaaatgggctctccagggtttctgcaaggtagttgacaatctaatggaatggggatttggggagtgtggataagggacaaagaatgcgttttcttttaatagtcttaaaccaaatgcgggctttgttttacttcagtttctttcttttttcttttcttttctttttttttttttttgagaagtgctgatttttgtaacgataatacaatagtaataacaagttatgttttaacatagccccttctctaaggtacttctcaagcttatggctatatattttaaaagtgcttacataaacgtaaatcacccaaagagctcaactaaaaggatgttcttgatttttaacaaagttgtttggattgtggatagcctttccacagagaattgttatatttgacatttatatgaactgtgtatattgcactgctcttgttaatgcttgataagaacaaaatatttgatgattgaatgaatttagtgtttgtgtgtatatactccatgttaaaaaaaattttctcttctctgaacttttactctccactcagccctgagtctgaatattttcattattttctgggaggtgggaacagtttgcaggaaggaataaggaaaagtttccaatcattctgtgtgtatgagattgaaaaggcgcatgttttgtgtaattatagatacgtcacatgctcacaatctgcttgtcctggtatactggatcaggtgtagtctttgctgcacatggtaaattcatagttcgtcttaagcctttgcccttccagggttttgaagatcagacttctgtatcacttaatttctgattgattttctacaaaaaagtattgtttttaattgtgtgatagtcaaacacagacaaataatattttggttaatcctggactttgtttttattttaatacttggtgacttaatcagaatttagtggggattgactgcactgccattagatacaagtaagaaatgatatgtgtgggatgaaaaccacaagttctcctctgcttgtgcctatcctctgaatttctttaaaagagaaattaatgtaacaataaatttgttgggggagggggcattgattcttattgccctctttgatctttctcttatttcccacagatttgttaccatttcccttttttccctctctcatctcctgccatctcacattgctactggttctacacctcttaaatacaaaataatcaagaaaaaaaaaaagctaagaaaaaattctaactcttgtatccatcataagaaaactcttgtcttccattttatcccctttccttctgatttcgtcatgatagaattgaggaagacggctgtcaatgtaggatttttcttgcaggaggtgagcctggggtaggtagactggaagaagaagagacagaaacagaccaggttcttttagttagggtgactgtacagcctcgtttgcctccagtggtcgcagttgttcttatcataattattaacaatgcttactttcactcccaaaagtgctctgatttggatgataaattatatgtgtatgtttagaagacaaggaaagagaaagattggaagcttaattatttatagtcatttataactctttatcccagcatagtacctttcacaaagcctgacccaagtggtattcagtaagtatgcattgattcatttgaatcccaagtcatacccaaacaaatctgttcattctacacaagtgtatttatatttgatatgttaatatgttctatataatggagaggtaaatctaagtttcaattttagaggacatataccacaagccctataaactaatagaaactgagttcagaacacatacattttttatttaggtaatacaataatttttaaaaaattacaaccaggatttaaaaatcagaaatattcacataaaaatgtcgatttttcagtttcttttagagaaaaaaaaaatgatctaatggcccgagtctgagctcacatggtaattattatatggaatgagcagggtctttattttgccttggcactcaccactctacccatggacattcagatttgcaatccctgatgcatattgtatatttggaagcatttaagatgttaaactttgtatatttagttatctacttaagatgagccaattctcattagtcatgttgtttatcaaagctatttaaatgaaatacttaaaaattcttttggtgataagcctttttaaaaaaattcaacaagttaatcattaatctttgggaaatattttttcccataccatccatgaatggcaacagctattaacaaatatttatattattttattgaataaaaaataagctaacactattttaaatatttttcaacagccagtatcttcgagaaagcgtatttttgaaacatacttatttgagttaaaattgtgaaatgcatttaaaaattgaaattgaaagtagaactactggagaagttttaaatatttgtgagtacatgtatgtgtgtatgtgcatgtatacttatgtgtgtgtatatatatatatatatatatatatatatatgtatgtacataaaatacatagttaacttgttcttcatttggttcttgtttatttatagattggaacagaaagagcaatctccacaagtgtttattaagttcctattatgtgctgtcctgcattttcaattctcaaatgatttatcaactttgaagtacaaagtagtaaaacattctttctacacatgttgaagaaactactgcaagttaaatttggataaatatctcagtatctgatgcatccaggtacttggatgatttctgtgaactatatctgacttctcaccagcaaacatgttttaaaaataatacaaagacggggcacagtggctcacgcctgtaatctcagcactttgggaggtgaggcgggtggatcacctgaggtcaggagtttgagaccagcctggccaacatggtgaaactccatctctactaaaaacagaaaaattagccaggcatggtggcggacgcctgtagtcttagctattcaagaggctgaggcaggtgaatctattgaacccgggaggcggaggttgcagtgagctgagattgtgtcactgcactccagactgggtgacagagactctgtctcaaaaaaaaaaataaaataaaatttaaaatagctacattgcttcaccaatgaagaatttaccctgctaacaatttttagaattttggcaaaaaaatggcttgaataactacattaaatatgaatttaatggcttgaacatattgtctcaggacatgattttatttgtacatttttaaggtttaatatattttcagttaaaattatctatatgtagatcaatttcttgctttcggagtcttttctgaagccttctgatgtcttccagtttgacctctacaccagcaacaagcatcttgacatcttccctcactatcatcttgaggattcatttcatttcttttgttttgtatctcgttctaaattccatggcttcctttttgtttggtctgttgttttggaggattataaactccagtagcttcctgagaaagtaaggggaagtaattttttgagaacttgtgatactttggttggatataaaatgatagaattggccgggcgcggtggctcacgcctatagtcccaggactttgggaggccaaggcgggtggatcacctgaggttgggcgttcgagaccagcctggccaacatggtgaaaccccgtctctactaaagatacaaaaaaattagccaggcctggtggcaggtgcctgtaatcatagctactcgggaggctgaggcagaagaattgcttgaacccgggaggcagagcttgcagtgagccaatatcgcaccattgcaccccagcttgggtgacacagcaagactctgtctaaaaaaaaaaaaaaaaaaaaagatagaatttaaaacaatttccccttcaaagttttacagtaatgtgtcatagcttctagagttgcatttgagtagtccaatgctattctaacttatcatttttatgaaacttgttaattctctgttgattgaatcttctgttattcccattattccaatattttatgataaaatatctttgtgtggctgtattttcaaacattgtgttggacatttcttgggcacttttcagtttagaaagtcatatttttcagtctggaaaatttttttgaattactcttttaatgactttcttccatctgttttctctgtttctttcagaaacttccattttttgaatgttgtgcatcctggacagttctctaattatcttttcatcttttgttttgctgtttttttttttttttttttactttttctttacttttaacctttctgttgagttttttatttctatttttacgctttttaatgtccaaaagttctttttctcttttcttagctttttcccccatagcattcttttcatatttcttaattgcctttcttgctttttttgaagatattactgaaagttttttttttttttctgtctttatagtctttgtttcctttaaatcgctttttctgtttcttttctttggtctctgtctgttacagtagaggctttcattacatttctgatgatccttaagagttgtgtactacaaaactgattggaagggacactgatattacagtttcctctgtgggatgatctggttgggttgattcttagggaaccctggctgtccatatggtgtttcccttgagctggccagtttatcagagaaaacacttttgagtttgctgctttgggcagtatgtataccttagcagctagcattttggaagatggataagaagagtcctcagttactcaaccccctgattcagttactccacccccaattaaaaagtattttaccttccttaccaccaccctccttgagctgcacgaatgccttccagtctggagagactagacccgaagacatctgacaggatggagcaagggtagttgcacaaatctttggaataagagatgagatttcaagatctaattgttttgtaagtagattttcaacaaattcttctgtgtttagtccatccttgtactctactcgtagacatgtaactccggttgcttcttagcttctcactactgctgatttaagattcagctttttgtgcctttatgaaccttcattttgtttctaaatgtacttacttttattttaggtggggtgtcaggaagagagggaagctaataggtagattcactctaacatctttagctgccatctttaacgcatacacacatatatgcactcatatacattaatttcacataaatgctataatcacttaaaaataaggtaataaaatttttaatacttcatttaattagactacatatggttcttgtcaaatctacactagaacagcatttccagtttacatgtattgagataaatcaccaaggctttgcataaattttagaaattctttcttccctaatttctgaattcttcagccttcaagattcaactcagatgtcacctataaagcttttcctgactctcctaagctatagtttattggtcctttctatgtttacctatagactttttaatttaatataccattaaaacatatcacattgtgttataactatgtctaaatcacttactagactgtaagcttccagaaggcaggagtgatgttttgtttgtacagtgcctggcatataatgaatacccaatatatgctttgtggattagtgaacttattatttaaaaaagcaaaccacactttaagtaaataaattaggatatgattattttagaaaatattcactatacaaaataatttacaatgcatttaaaatttcattacatggcttgttttcccctccaggaacatgttcatattagtatcatttttgcatatgtgtgtacatatgtatgcattttccattgttcttctttagtaggggtgttactcgtcttttaaaatacatacgtgttattttgttacatattggcgatattttcccctccagatatcttttgctaggagagcactaagttgctattcatctagttttttgatcagtgcaatatattttaagcaactagttcaaaaatacattcaaatagcatgccctattcctcatgaattgctatttctttgcttaaatttcccactcagaccaccagcaatcccttaagtacttttcctaccagctaatgctagcttttaaaaatctacttaatgtttctcttttctttctctttgttgcctctgtcacttaatatacctgtgtgcctgtctcgatattgttccttctcaaggtctttttatgcttttaggatgatctttcctagtttctttttctactgtcttagatgctttgattctgctgtttctccattgcagagagcttagtggaaggaggaagtgaatattaagagtgtctttttaaaaaaagatgttatgtataatattaaagagaatataaatgctggtggttactatataactagtgctccaaaaaggattttgataaacttttagagtctttcatggaggcaaaaatacgaaaatgcgttgtgtttaaatttcttagacaaggggaaaagggagcattgaaattgggcaattgtaaaaaatgaatgatagatacatgggagttcattattttctatctctatgtttttgtgtatattaaaatctatctaaatacaaggtttaaaagaggttaagtatcatttttcatttcttttgacccaataatcccacttttgggtgtcagtcctctagctcataaagacagatgagcaaggatgttaaatatagcactatttggactggaaaggaacataacttgaaaacagtctgacagctgtacttccattactaatggaattgttggataaattatagtgtgtccatacaatattatatagcaatcaaaaagaatggattgagttatatgctatattctggagggatgtccaagatgtatttttaggtgttgagtaatgcataaaatgtaatttcattttaataaaaagaagctatgaatattgcaaaaagctgtgaaggcatatataccaatttatcaaagttgcttattttaggaaatcggaacttgaaggaatggggtagaagaaaaattaactttattaatctttgtacttaatttgtttcaagtatgtgttacttttggggaaaatgtaatgaagatttgaaaaaaatttaaaaataaaatatttaaaaaatgaatgtcaattcatccaagataataataactcatttttaaagctgtaaagagacacagaaagtgatatgcataagaaactaaatgatgaattagatcataatttgcctttggaaagaaacataaatggattgatagctcatgcctatgaaatgtatattcaactctgattctattcccaaacttctaacagaaattgctgggtaataattagaaaggagactttggccttttatatattaattcagtattctcctaaaatctgtgcctaaactttaagcctttttgttatggtaactgaaccaatcaatttcatagttaaagatgtcccattttcaacagaccatatttaacttggaaccaagggtatctagttatatcagttagggttctttggttgtgagcaacagaaactgagtctagccaacttagacaaaaagaaatgtattggaaagatactaagcaggtaatagaattcatgtttcacctgacagttgggcatttctttttgtgttttagtatgcctctaattatattctctgctttcaattatagcattgctccaaaagttcctaaccaagcgcctttgtcattttgccttaagtcttttttttttaattaccattttttaaaaggggaatttatataacatctgttgttcaaattgtgccctagtaaatgttgagtttggagttataataagtttgatttattataagagatattcctattcagatacttacagatagtttcaacctacatattttattttagaattgtcacccttgagtttctctttaataccaccccagtgtctttgtgtgtgtgtgtgtttagcacatttgttttgtttatcttttttgttgttgttgttttattggtaagttttctggggagattaattgtaaaatgtttattaacattaaattattattatttttgagacaacgtctcactctgttgcccaggctggaatgcagtggcaccatcatggcctactgcatccgcaacttcctggacccaggtgatcctcccacctcagcctcccaagtagctgggactatggaagcgcactaccaggccctgcttgttttttgtatggttttgtaggaacgaggtttctccatgttgcccagccaggctggtctagaactcctgggctcaagcaatccgcccaccacaccacatcttcccaaagtgctgggattacaggcgtgagccattgcgcccagccaaattatttttttatatctatgctattctttataatttctgtctacttaactggaacagtctcttgtgctttttaattggattccagacatcgtgtgtaaaaggacagcagggactaaggtaataagattcatgcccaaaagtggtcatgcctcttctgttaggtcattagtgtaggagattaagtcaatttaggcagtagtgaaactgagtttggttttgttgttgctgtagttatctgcagttgttctggtgggctatcattatcttgtgcttagtttagagcctggggtcttagagagtttttttcaataattttgctcccttcacagctttcagcagactttgcacccctgtatgacagatctctgtgctcctgagcctctctagaagtagactgttaagttggttcaaggcttgtggtagggcctggagggctcattcttggccataccctgtgcacatgagtctcaggggttagacgttttcaatgtttgtgcttctccccagacggcaatacacttttgctttgtattagtgcaggatccttggcatgagtgggttttctcccctttcacagcagcaggtgtcttttgcctagtgtcagggcaaggtaagaatgaggtggagattgtcttggccaagttaaccttatgaacctctgcagtaaaatggaaatgatactactatctgatgtagcagtgaaacatttagtttactttatttggtactatacagatgtttgttaattaggtaatatttaatgcagaagatatgggttgagccatggctaaaaggattaggacttagatgggcagactgaaggcaagagggcatcttgggtaggttaagataaaataatgataggcagctgcaatttgatgtgaaagtattttttcttaaatcagttattctatacctcaagatgtcattcattcattcagttagtcagtcattgtctcttgctgcactttactaaaagttggggcttcagaagcatatggctcaactgtaatagtaagttgtactaatagatttcccagtatactgggaatgatcagggaaacttaattgaggcctgggttggtttagaggcagaagacaacagtagagcatgtctttttttttttttttttttgagatggagtctcactctgtccccaggctggagtgcagtgacgtgatctcggctcactgcaacctccacctcccaggttcaagcgattttcctgcctcagcctcccgagtagctgggactacaggtgcacaccaccacgtccagctaatttttgtatttttaataaagatggggtttcaccatattggctaggctggtctcgatctactaaccttgtgatccacccacctcggcctcccaaagttctgggattacaggcgtgagccaccgcgcctggccgtcttttactctttatagattgctataaagagttacttgtaagtaaagtaaagataatgacaataacagtaaaatgataatagtagctctagtttatagaaaggtttcttgttttttattgtttgtttttgtctaggcattgacctcttttattaaagccctgcaatacataaattattatttcctatttatttctttacatcttcagatgaagaaactgtatctcagaagagttaagtgagttgctcaaggccactcagctagtttaaattagagcatgactttgaataaggttagtataacttcaaagtctgaactcattttgttttattactctgcctcccaagactcagatatctagtaaggaaagctagtattcagaaacatccaatcaagaagctcctatgttaaatttaattaattaattaatttttttgagacagggtcttgctctgtcacccaggccagagtatagtggcatgatcatggctcactgcagcctcaactttctgggcccaagcaattctcccaccccagcctcctgggtagctgggactacaggtgcacaccaccacacctggctaatatttgtattttttatagagacagtgttttgccacgttgcccaggctggtcttgaactcctgagctcaagcgatttgcctgcctcggcctcccaaagagtcaggattacaggcatgagccaccgcacccagcctgcttctatatttttaatttttagttgttatttcagccgatatatatatatatatatatatatatatatatatatatatatatatatatatatatatatatatatatatatatatatatatatatatatatatatatatatgtatattgctacataaagacaactagccaaaattcaacgtagtatccagccagtgctttgttatgaatccggcattcttgcaggtatgtattatcttaatagttagttgacatttggactcctagagataatcatgacttactggtgatttctaccgtgacatttgttatgttcttcagactcagaaacatttacactttcatatcatgtggggttgtatgatttacaaattaggtattggctggttttttatctcctcttgaaatttcacatgaatcttggtttgattctaaaagtagatgttattgcgttatcacaaataagtaaatttggaattttgtcaagtttttatatacttctttggcctcaaagcatatcttaaagccattttatagtaagactagcaactcttacagtggcagatttggatggctaaatattaaaaaacatagaagacttgacattgttgtaaaaatgtgagatcatacattatgtcttaagatggtaatagaaaacattttatctttaattgtggaatactctgtaatttatagatattttaataaaataattcatatggaaaatcactgtttttttaattgtcaaaatgcagagaagcaatatgatggagatgtatgtaaggactgtgtcgtttgttcattcagtaattcagttaaccaatatttaccatgctagacaatctgttaggtcctggggtataaagagaaataatatctggtccttgttctcaaatggtttagagtttaatgaaatagacaaataatttgatgaactataatatgttttaataaaagtaggaaataactgctgtggaagtatagagaagagctgagagctgtgtatagtttttagtatgttttctttatgtagcatggtttttatatatctgtagaaaagtatgaaactggtagggggtatttttcagcagtttcttaccatgtactaccaaagaagcagaatgtgagagaccagtaatccagtagtaatacgtgtatcctgacaaacttaagtaattagtcaggtatcagtatatatatatatatatttttttttttttttttttttttttttgagacggagtcttgctctgtcgcccacgctggagtgcagtggcgcgatcttggctcactgcaggctctgcccccaggggttcacccccttctcctgcctcagcctcccgagtagctgggactacaggtgcccgccacctcgcccagctaattttttttgtatttttagtaaagatggggtttcaccttgttagccaggaagtatattttacaagactctttttgtgatttatcagcatactttcatgccaatgtaaaatgtgggagatcttaaaattgagaggtacaatcaaccctgaaattccaaatctattgaaagcccaacatagactctgatgactgtcatttcacctaaagggaacatattctaattaattcaaagcaatatgtcagttgcctgttctttaatatgctaaaagacggatatagtaatttggagaaataacttcattaacaagtgaaggattgctgaagcaaagagtaattgtctgatactaatgggatagcaatatacccagagattaaagagttttaagaggttaaaaacaaacaaattctgtttaaggattggtgaattttagctccccaccccccatctaaaaatgaagcaattactttttaaaatgaaatgtatcattatgtataaaattaatttttaaaagtaattgatagttctaaagtaataaataacttttggttaagatgttcctattgggattatataccttaataaaggaaatgtaatcttttgaatacccatcttgagtgttatcagaaatggcctttactgtcatacccattagttcctacttgtagaatttctaaaagttgaaaatttgatttagttttttaaaatacttctcttgtttgaacaaatgtaatttgcggtctttatagacaaaaccttgtacattatattcctgggcatccagatttgttagggtaggtatttttgtgagtaatattctggctagctgagcattcattcgtttactcattacatatttgagtgactattgcgtggcaagtactaggctaagcactggggatacaaaggtgaaaaaaagacattgtcttatagaaaagtgacatttggtttataaagtttctgaagatttagactccaaggaaatgtatactttatactcaattgcatgtattagaaaatttgaccttggtcatatgttatctctagattttagctccctcatttatgaagtgaatgcatctggattaggtaacctacagattctcagagagattttaatagtctgtcggtgcctcatgattctgaataagggttaaaatttagaaaaaaatcctgagtaccagactttttttcatattttattcattagtatattgaatatgcaaataaatactgccttggacaatgtaacattattgtctttctcttatgtattgtatcctttccccaagttttgtctcaagtatttttgtaaaattccattcatcaaactattttttaaatggtttccaccagttgccttagtttttttaaagtcatcattcaaggtagtctttttaattttttttaaattggcatcctgggggcttcaatttcagctaaatctttaacctctctttcattgttgattcattgcccaaagtatcattaacattattaagaaactttggctttggatacataaccaattaatatgtaacatgaacattctcttcaatttttttttttttttttttttttttttttttagcagacagtgtagatttgcactgaatcctccgtaattcttcagccaggactcttctaggataaagacattatcagagaaaacacagcatataaaagtaaccacaaggagatggaactgcttgtcacgcgcattacgtttcaatgtattgactccaatagctagtgataacccacaaagagtctgtccatttattctgtacaccccctgcgatgcctgttctactcccgtacatacaatgggggttcaaaccaaaataatggctagcatatctttgacacaaattgtttttgggccattataatgtttgtttaagttttttttgtttgtttgtttttgtttttgagacagagtctggctctgtcgcctaggctgaagtacaatggcacaatcttggctcactgcaacctctgcctcccaggttcaagcaattctcctgcctcggcttcccgagtggctgggattacaggtgcctgccaccacgcccagctaattttttgtatttttagtagagacagcttttgccatattggccaggctggtcttaaattcctgacctcaggtgatccacccatcttggcctcccaaagtgctgtgtttacaggcgtgagccactgggcccagccaggtgagtcttttgactcaatacatttcattgaattacttacaagccttctaaaactattttgacactgaataagtaaataagcagtaacttaagcaataggaaacatcctcaaaatatcctaaaaattcaatttggaatgtagtttaaaaataaagaggctgggcacggtggctcacgcctgtaatcccagcactttgggaggcggaggtgggcagattacctgaggtcaggagtttgagaccagcttgaccaacatggtgaaaccccgtctccactaaaaatacaaaaattagccaggtgtggtggcgtgcgcctgtaaacccagctattaggggggcggaggcaggagaatggcttgaacccgggaagcagaggttgcagggagctgagattgtgccaccacactccagcctgagcaacagagcaggactccatctcaaaaaaaataaaataaaataaattaaataaataaataaataaataataaactaatggtgttatctattctgtacagttctctgggggctgattacaagtgctgaatggcagtattaatctctgttgtttttcacttgagtgatcctatacattaaagtcacagtgtacattgtttctctgcttgatttctcctcatctcaaaatgtagggtcaaatgaaagaggcaggtagatatttagagaagagcattttaatctaaatataaccatcacgtactattagtaaagaaattaagaggccaggcatggtggctcatgcctgtaatcccagcactttgggaggccaaggcgggtggatcatgaggtcaggagttcaagaccagcctggacaacgtagtgaaaccccgtgtctactaaaaatacaaaaattagccgggcagggtggcatgcgcctataatcctagcttcttgggaggctgaggcaggagaatcggttgaactggggcggtagaggtcacagtgagccaagattgcgccactgcacttaagtcagggtgacagagtgagactccgtctcaaaaaaaaaaaaaagaaaagaaaaagaaatttaagaaatggatccatgggaaatatatacatttgttgaattgaaaattatttttcaacacttggcttatatctactgtgttgttcacttaaaaagcaggcaaaatgaagatgatgctttaaaaggagttatagttagaaatttggaactaccatactgttccagaagacttgatttaatatctggtcatgagttgcacaattaataaattttagacctcattcaatatattttcatgcctgatttatccttgtttgagaactcaatacaagattcatagtaatattttagctttctagacaggatatttagtagccaggctcagggtggcattgtattggtatgccagttggtaggccttttgactatacattggcaggataacttgaatgataccctctcccaaacctgtcccacatcctcatatctctggcaactctattgtagagtagttagccagaggtgattgcttgtaggggaatataatggttattttctggttgttccaaaggaaagaaaatattatctccatgtattatttattgctatatagcacattgccccaaatttagcagcttaaaacaaatatttattatctaacaaagttcctgaagatcaggaatttgggtatgaatggttcctatggttctggcccagggtgtctttatcaggttgcagttaagctgtcagctgaggttgccgttatctcagtgcttgactgggactggaaaatctttccggggtcactcacatggttgttggcaggcctcagtttcttgctaactgttgattagatgcttcagtttttcaccctgtgggccttccatgaggttcacaatatggcagcttccactagagtgtaagatcagagagacagagagtggacacccaagatgagagtcatagtcttttataacctaatttcagaagtgacataccattactgcagccatgtggtgatcatacagaccaaccctaatcccctgagagaggggactacacagggtggaaatatgaagatgcaaagatcattgaggaccatcttggaggctggccaccaaactcctcgtgatggatatcatcattggtagttctctagctggctatctgtaagtctccaaagctacacttgaactgtctagcatttagattagtacagctagaggagctaagtttgaatttttaaaaaatcggccaggcgtggtggcttatgcctgtaatcccagcatgctgggaggccgaggcgggcggatcacgaggtcaagagatggagaccatcctggccaacatggtaaaaccccatctctactaaaaatacaaacattatctgggcatggcggtgtgcctgtagtcctagctactcaggaggctgaggcaggaaatcacttgaacccgggaggcagagaatgcagtgagctgagatggcgccactgcactccagcctggtgatagagtgagactccgtctcggaaaaaagaaaaaaaattctgggtattattcttactagatatgtgtcagattatcagatcacttggtgttaggcctggtatgtacaactgagttactaaaagatttcatcaagtaggtagcagatatttaggaagagtacttaaagaaaatgacttgtttttaaattttccttctttataggtccaggtttagttcactacagaggataattttgtttgctttgcaagacagccagactagaggttaaatgttttttttgacagtatgtggttacaaatcagtcttgccagtcctatgttaattcgttatttccactgtctccagactctggtgatagtgatacaaattaagataatcacatgaataaattagtggcaataatttctttgagtctttttcttggcctttaagttggtcactttgcattacttgtataaatttctaatgtaaacagagagcaaattgtgtgtgtgtgtatgcacatgagtgaaatctataatgaaatcacagtttagagaaggaattatacgtttaaagtcttcaattttatgaaaacaatgattccacatttcttcaagtggctgccatagaatggaaattgaaatccctgggtgggaagtgtgctagaaatcatagtattccttttcaaagtattttgcatccccttatacatatattcagtacttcatttctaacccctacacactaaatcatgctgtgattcataatactctgttatgttttaaattcaaatattgtttttaaagggaaattgctactaatgttggctaagctgcacgtaatagtttagtaaatggttgtaggtttgattcttctcatgtcaatctaaatgtgaactaacattattcaaaatccttttaagatactgaataattgtttcagttaactaaatgcttcatcaagtaatatcaatttatgaagtatggttgggtttagggcatttattatttaaagaaaaaagcaataggtacatacctacgtaacaatgttaatggatatgttttgggtgccatgtgtttgaagaaagagggattttcatatcttaacagaacaagtatagatcattgaaaaaatttaaaagtaatgtatgatttagtttactcttatttaatttgttaaaatatcagctttaatgagatataatttacagaaatgcaccaattttgatgtacattttaatgagttttgaaagttttatacattcatgtaacctatggaacatttctatcaccccagaatgttttcttctgtttttcttccagtcaaatactacttctcgggtaaaaactgatctactctctgtcactattgattagattaaactcttctcgtgtttcatataaatgcattcttatatgttctcttttttttccctaatatatttcacttagcatgatttttttttttttttttttttttgagatggagtcttgctctgtcgcctaggctggagtgcaatggtgtgatcttggctcactgcaacctgtgcctcctgggttcaagtgattctccctgcctcagcctcctaagtagctgtgattacaggtgcccacaaccacacccggctaatttttgtatttttagtagggacagggtttcactatgttggccaggctggtctctaactcctaacctcaggtgatccacccgcctcagcctcccaaattgttggtattacaggtgtgagccaccgcacctggccagcatgatgtttttgagattcatccatattgtggtgtgtatctgttgttcgtttctttatttttttcactttttttagagacagggtctccctctgttgcccaggctggagtgtagtggcctgatcatggctcactgaaacctgaaaatcctgggcttaagtgatcctcctaccttagcctcctgggttgctgggattacagacatgtatcatcatgcctggctttgtttcctttttattcccgagtagtattgcgttgtataaatatggccacactttgggaggctgaggcgcggatcacgaggtcaggagttcaagaccagcctgaccaacatggtgaaaccctgtcactactaaaaatacaaaaaaaattagctgggcgtggtagtgcacacctgtaatcccagctactcaggaggctgaggcaggagaattgcttgaatccgggaggcagaggttgcagtgaggtgagattgcaccactgcactccagcctgggtgaaagaggaagactctgtctcaaaaaataaaaaataaaaatgaaaaataaatatgcccacaattcatttatgtattcatctattgatagacattcaggttgtttccggttttgggctgttttgcataaaactagtgtgaacattcatatacaagtttttgtgtgtgtggacatgtgtttttctttctcttgggtaaatacctaggagtagaattgttagattgtataagtgtacatttaactttgtaagatattaccaaactgttttcccaagtggttgtactattttacattgccactaataatgtatgagagttccagttgcttcacatttttgctaatgcttggtactgtcaattatctttaaccattctgctaggtgtgtagtgtatctcattgcggttctatgcagattcctgatgacgatgacgttgaacatcttttcatgtgcttattggtcattcatatatcttcatctgtgaagtgtatgtcaaatgttttgcccattttaaaaatcagattgtcttaatgagttgtaggccgggcattgtggctcatgcctgtaatcccagcactttgggaagccgaggcgggtagatacctgaggtcaggaatttgagaccagcctgaccaacatggcgaaaccccatctctaccaaaaatataaaaagtagtcgggcatggtggcacgtgcctataatcccaaatactctggaggctgaggcgggagaatcgattgaacctgggaggcagaggttgcagtgagccaagatcgcgccattgcactctagcctgggcgacaagagcggaactctgtctcaaaaaaaaaaaaaaaaagaattgtaagagcttattatatactctgaagacaagtcttttgtcaggcatgtactaagagtatttcctcctttgtgtatcctgtttaaaaaaatctatgaatttttttttttatgtgttcttctagaagttttatagttctggcttttatatttttagtctatggtccattttgagttaatatatacatataacatgaggtagaagttaaggttcttttgttgttgtttttgttgttgttgtttttcacgtgggtatttggttgttttggtatcattgattgaaaacactgtcatttctccattaacttactgttgcacatcctttttgaaaatcatttacccaaatacgtgttagtcttttctagagtctgtattctgtttcattgatccatcttttatgccaatggcactacattgtcatgattattatagcttcatagtgagtctggaaatgggataatgtaagtcctctgaatttgttttcgttttttcaaaattgttttgtccattctaggttcttgcatttccatacaaattttaggctaaacttatcaatgtctgctaagaagtctactacaattttgattggatggcactaaatttgtagctgaatttggggagaattgacattttaacaatatttggtcatccaatctataaacctgatatggttgtctctttatgtaggtattccttaatttctcttagtaaagttttgtatttttcattttacaggtcttgcctatattttgttaaatttattcctaaatattgcattttaaaaataatattttaaataatcttttaaacattttaatttcctggtttttgttgctagaaatcagttattgaaacaaggaaatatatttcaagctaaattattagaaaaagcccttttgatttaaagtatgtgctatttatgagatctgaagaagcaggcaaactaaaactacttttccagattccgtcgcagctaaggtgctaaatatgaattaggttgtaccacttagatgcacttagatgagatttgaaatgtggacctaagatgatgccttggccagctctttctgctggaaagcacagtgatggacatgttgaatgtttctacaaaagcattccagtgtttggtcattagcttcatgggtgaaagtggaaggtacgatggcagcttcctgatccctaaatctcaggtatgtattcttgaactcagcagttctagtggtggcctcctattcccccatctggaagaggaaagaaggcagcagtgagccaaaggatgttcgcagcttctagaagcttgtaatggcaaggaaatagattctcctctaggcctctagaacagatagtaatttgcatacatcttgattttaacccaatgttgttgttaaaagacagtctcgctctgtcacccagcctggagtgcagtggcacagtcatcaccgtaaccctgaacttctgggctcaagtaatctttctgccttaaactcccaggtagctaggacacaggcgcatgctaaaaatgttatttttccaagaggcagaggctgaggtaggaggatcacttgagcccaagaattcaaagctattgtgcacaatgatcacacctgtgaatagccactgcactctagcctgggcaatatggtgagacctcccctctttaaaaaaattttttttttcttctgtggttgctaatatcttttttaaagtgcaaagagtcgtctcacagtcattagacacaatagatgatgtaatgccattgtttctttttttagtatttagagctttttgccatctgaaaaatactcatacaagattgctgatcgcccaagtttaggtgaatactcaggagaggaaattacacaattattttagataattatatgtaaagatttattaattgtgtaaatgtaatgtgagtttaataataggatatagcttaaatctctggcttctatttgaaaaatttctaaggatcacatccaggcatatgaaataaaaaggtgacatgttaatctgtgtataatttgtatatttctgcataattatatggtcaagtctcagactgttttctaattaatatttactgttgctttcatattgtttttatctttctttaatcttagaatccaaccaatacttttctctacattgctagaggggcaatatatatgtagagataaataataaagttgactcttgaacaatgcaggggttaggagtgctgactcctccctaatcaaaaatttgcatataacttttgactattaataaacctacagttgacttttttattgatgaaaatccatgtatatgtggacctgtgcagttcaaacatgtgttgttcaagagtcaactatatatatatatatttttttctcttctttttgtgaaaactgtccaggagtcaactgtgtataaaacctgggagcagtgaggcacctcccagacaatatctgcattattactaaaccctagaagatagtgtggataatttggagctaaaataatttaattatattttttaaaatatttgttgataggtttgtacccagggctttcattcaagatagagtatcatttatttcatagcctatattccactagcagaagcttactttttttttttccccccttgggtaattttttttaattgtctaagggattaactgtcacctcattatctttgttaatcactttcagagcttttcgctattgttcatcacagtagtcaagaggatcacaaagaaagtgctaaatccttatttacaaagaaaattgattctcagctttgcttatatctgctatatatttcctttgaatatttgttagggtagcaatggttaaaattaaatatttattgagaagtgatttttaatgttgtgggaaaatattttatgtcagaaaaatattgaatttcaaaaccatggaaaatagaaaaaaatcattaagagacttgactaatgtctcctcagaatggtttacaatattctgctattcatttactttcttcatgagcagtgatcttgaaagttttgaagaaagacttttgtcttttgttaaatactttggaatttttttggcaatgtgaagaaattttatttacatgtttgataagaacatccacagacatctcttttaaagataaaaaacttcaatatgaaaattgaagttataaactaaagatcctctctcagctaagaattcctttttagaaatgtataaatacaattatcctttaataaataaacatatcttcaaattttctcagtaatgtgtcactgaaacacattaaaagatgacatcgctactcacaataacagtacaaaatgaagaaaataattgaaacatagatcaaggatgttaaagatgggtgaaaaaaattatcttgctttttataactaaagtttgtttaatattcataacaggcttatagaattcttaattgttccaggtaaaatacctaattttctttgttttgaaagcattctctttttcttactaaatcaaaaacagagaaaacttagggtacacgaatcaattatggtttttagaacaacaatggataagaatgttttaaagatttaggaatcttttaatctctgtgacgtttcatcatttccattctgtgtcgagtttttggttgcaaagtaatagaaactgatgttgaataacttgagtagaaataaattcattggatatcaagcaattctcagagtatattttgaaggctggaaaatgggacttgggaaataaagaggaaccaaggcaggctaggcccaggaacctctacacagatcaacctgcatgatacagtttggatatatgtccctgtcaaatctcacattgaaatgtaatccccagtgttggaggtggggcctggtgggaggtgtttgagtcatggaggtggagtcctcattgcttggtgccgtccttgtaatagtgagtacttacagaatctggttgtttaaaagtgtgtagctcctcgcttgcactgtctcatgagtaaaagctccctgaggcctcaccggaagctgagcagatgctggtgcaatacttatacagcctgtagaactgtgagccaattaaacttcttttctttataaattacccagtctcaggtatttctttatagcaatgcaagaatggactagcacattaatgttgactaacttatgtagaaataaatttgctgaatattgggcaattctcagaacctgggaaggctagaaaatggggcttgggaaatacagagggacccagccaggaacctctacacagatcaacgtgcaggatcagtcttgttgtatggatgctcctctcagacacacatcagtgctagcactactggattcttaatgctacttctgctgttgctgctgcaaatactttatcacctgtatctgtattttgccttactccctcaagattcaaagtccagaattggactatccaaatatattggtcattagttggaacataaatttctttttttttttttaattttcaaacatctcaacagccagatggagcataaattttatcttgtagatcagtgttttactctcacaaagttttgtctcccagttgacactctaatggagtttccagttcagcttctctaagaggtgagctgctttttgatgaagagatacatagaaccagtgaattctctgggttatcagctcatggctttatttttatcactgtaaggtgagctccttgttcagaatcaacgtggtatggtataccaaatgtccattacaccttcagtctcagattttctttctcatcttcactctgtatcttccacctgcagcagcaataaaggtatcacaaacaattattttttagaattcctcaagaggaataatatttgttctactgatcatcctggtttcagtagaattatcctaggagtgagcagtaatcatatgcacagattcagacatcaggactctattttattttattttatttatttattttgagacagagtctccctctgtcacccaggctgcagtgcaatggtgcgatctcggctcactgcaacctctacctcctgggttcaagtgattctcctgcctcagcctcctgagtagctgggattacagtcatgcaccaccactcctgtctaatttttgtatttgtagtagagacggggtgttaccatattggccacactggtctcgaactcctgacctcaagtgatccacctgcctgccttggcctcccgaagtgctggcattacaggcatgagccatcgcgctgggccaaaacccttaactcaaatagcacttcaagcatcagttctctgtctcctccctttctgttttcctgtgctgcagagatgccatcttataaataattctgtgagcctagttatcacaatgaattgtaattttgttttgtacatcatcttcctcatggactatgaactgctggagagcaggaagttttaatttgtctttgtgttttctgcacttaacactacatttgggacacagtaatggctcagtttttaaaatcaaagtaaaatatacatacagttaaaataaaatatattgaaggctttataatgaaaatcaacagtctccttttctaacctgtcctgcttcttagaggccaacatttttaacttttctaagtagtcttctggcagttatttccatatttctttaaaaatatgtttatcatggtatttcttgattcatcaattttagaaaatttattgaccacccgccaacattcctgagatatgtatgtatgtatgtgggtgtgtatgtagctgtttttgtttttatgaataattagcatgtatattatttgaactatgcaaattacattcattacagagccaagtagtgttttgtaattatattttccatcttacacagctttcttttctcgtcctcttatactatttgctattatatttcctttcttatgccacttctataccttatatattatctaatgtttctgtaccgtatgtatttcttaatttttttcaagccctcctgtagtgggagcggtcgcagacaaaacctcttggacaccggttttaggaaggaatgggctttagtcagctgggagcatcggtagacgctcatctcaaggtccaagctccccaaagtaaagattcctgtcccttttatgggcttacaactctaaggggtccatgtgaaagggccgtgatacattgcgcaagtgggggctatgtgactgagggctacatgcatcagtgatgggggctagcagaacagaacagaaggtttcacaatgtttcctcatacaatatctggaatctatagataacacaagcagttaggtcaggagttgatctttaactaccaggcctgacggaatacttctcagccataaaaaggaacgaattaatggcattcacagcaacctggatgagattggagactattattctaagtgaagcaactcaggaatggaaaaccaaacatcatatgttctcactcataagtgggagctaagctatgaggatgcaaagaatgacacagtgcactttggggacttagggggaaagggtgagacgggagtaagggataaaagactacaaattgggtgcagtgtatactgctcgggtgatgggtgtgccaaaatctcacaaaccaccactaaagaacttactcatgtaaccaaacaccacctgttccccaataacttatagaaataaaaaaattagaaaaagaacacagagtggaatggggacaaaactgtaaagtttttgggatatacatgatctagaacatgaaacaaaaaagtacccgttttgataaatagatttcatatcctcctgtaatattcacaattagaacacattcaatattgtgactcaaagttaaagaataaaatgttgcatattttcaaattgcatggactcctttagagattctgaatcagaataataaaataattaaaaataaacataaagaataatgaaaaataaagctatctaacaatagttaatggctgggtttttaaatgaataaaacattatcttatcattatcttaccaaaagacaacaatatttcaaatctacttatgaagacattaatgatatgactatctagtgtctactaaccattattataacaaccattttggtggagatttactaccttgttagaagaatatcatggctaaaagaagagaaatagcaattgcaagttatcgtagaagtataaagacaaggtcattatagactgatagttaatagagcaatagaaaaatgacatttgatatgaactgttttgattacagaaaaggctgagactcatttttacattcatatatttataagaaaattccaggtttataagattgatccttcaattatttttttcttttttgtaacatacaatgagtaattgatgttacatttttcaaagggcaaaagatttgttaaatcaaaagccgtatgtataaggtagagagtatttcagggagaccagtgtattatctctctggttctatgtagtattctatcttttttttttttttccgagacagagtttcactcttgttgcccaggctggagtgcaatagcatgatcttggctcactgcaacctccacctcccgagtttaagccattctcctgcctcagcctcccaagtagctgggattacatgcatgtgccaccatatctggctaatttttgtatttttagtagagaggtgatttcaccatgttggtcaggctggtctcgaactcctgacctcaggtgatccacccgccttggcctcccaaagtgctgggattacaggcgtgagccactgtgcccagccaggattgtatcttttaagcagaaaacttaatagctttgttcatgacttaaaaaaaataccatgagaatcattttaccaagtaatttactttatacaaataattagaaattatgctatcactaaaacatagtttaaatatttttgaaaataacttagtgttgtcataaaatagaattggaaaaggcgggtaaatcaacataattggtaactggcaaaagtttcaagcattctgcctaagaactggagcaagacaaggatgcccattcttaccactcctattcaatttagtactggaagtcttaaccagagcaatcaggcaagagaaagaaagaaaaggcatatagatgggaaaaaatgaagttaaattgtctctcttcattgaccatgtggttctgtacctagaaaaccctgaagattctgctcaaagactcctagacctgataaatgacttcagtaaggtctcaggatacaaaagcaatgtacaaaaatctgtagcatttctatgtaccaataacattcaagctgagaaccaaaacaagaatgcagtcccatttacaatacacatacctaggaatacttgtaaccaaggaggtgaaaaatctctatgaggagaacttaaaacactgctgaaagaaattatagatgacacaaacaaatggaaaaacattccatgctcatgtactggaagaatcgatatcattaaaatgcccatactgcccaaagcaatttacagattcaatgctatttctatgaaattaccaatgtcacttttcacagtattagaaaaactatctaaaattcatatggaaccaaaaaagagcccaagtagccaaagcaagcctaagcaaaaagaacaaaaccagaggcatcacattacacaattttaaactaaactacagggctacagtaaccaaaacagcatggaactggtacaaaaatagacacatagaccaatggaacagaatagagaatcctgaaataaagccatatacctacaaccaactgatgttctacaatgtcaacaatgggggaaggataccctattcaataaatggtgctgggaaaactggttaaccatatgcagaagaatgaaatgacatctacctctgaccatatacaaaaactaacttaagatggattaaagatttaaatataagatctcgaaccataaaaattctagtagaaaacctaggaaatactcttctggacattggcctaggcaaataatgtacgaccaagtcctcaaaaacaaatgcaacaaaaaaattgacaattggtcctaattagacaaaagaacttctgcacagcaaaataaactatcaacagattaaacagacaacatacagaatgggagaaaatatttgaaagctacacatttgacaaaagactagtatccagaatctataaggaatgtaaacaaatcaacaagaaaaaaaatgccattgaaaagtgggcaaaggacacgaacagatacttctcaaaagaagacatccaagtggccaacaaacatgaaaaaattctcaacttcgtgaatctagagggatgcacatcgaaaacacaatgagataccaaaccttagcaccatacaatatactcatgtcacaaaccaccacaagtatcccctgtatcttaaaatgtgtatatgtatttttttttagccttcaaatgtaaattaacatggagcccaagaggccaaaaaacagctgctacaaaatataccagatttgtattatattgaatttgtggcccaaaccagaccatatatttttctgcttggtaaaaatgtgatagtgaaatgggagagttcctttgaccccctcatgggacttgcgacagggttggctcgtttgctcagctgccgtgcccaaaccccttgtgggaaagggagcatacaggtgagggggtgcagtctctggggtgaatgtctttgggcactggcaggaacaaacctgcagcagcctctaggggttgcccacaacctctggagcccctaagggtgtgtgttacaaacaatgctcttttagcatttgccttctactgttggctaagtgttaaccagctcagtggagggtcagggtgacagctttttacaccctgccctcttggtacctaggttcttgtccagtgtccaggaagaatcagatcacacggacttgaaggatggtgaatgcggagatttcattgagtggtggaagtggctctcagcaggatggagagttggaaatggggtggagtgagaagataatcttcccctagagttcggtcgttcccagcccaactcctctttgaccatagtctctgatgttcagctgcctcttctcttctcgacgttcagacacatcttctcttctttccttctctgttgtgctgccctgctcctctgccaatggaggttgtgatttttatgggcacatgataggaagtgtggggggcaaaaaggcagcactagggtaggaaagcggagatgtgaagttctcatttagggccgcaggtccaggctcgagggtggaaccctcgccagggaccccacccttttctactcagtatttccctgcctcctgtccatatcaatagatgttggcagttcttttagttaacatagtccaaggtttttcttgaatttttgtatgtttgtgtatatgtatattttatatgtatgtatgtctgtatgtatgtatatatatcttcaattttctcagacttcataccacagcttagagttatgcagtcacgttaaccataataactcaaattccaccagatacaactccaaatgcaagtttatgatgactccatgagtttgtaaaactgttacagactttcaaggatctcaaagcacgggcagaaggcatttgtttctgggcaatgtgctctgcttgttggagtgacccagctaaacagagcaagaagttattttgccttttcctgccatttctccatgcatttgggggctttaagagtgctttgagtctaagaaatatatttgaaatataggttggaatcatctttgttccagtcatgttgaacttaaggctaaagtcaaagagcccaactcttcttacagggctccttgagccccaccagtgaaattgtttcttatctgaccagcctagacataccagaatctcacttagactcaaactgacatccctaccctacaagctgtgaagctgactttgaagcaatgtggaatgtgtttgctttggtgactcaggaggttttatatatatgtgtgtgtgtgtgtgtatgtgtgtgtgtgtgtgtgtgtgtgtgtgtgtatgtcttatggatggtgaattatactgttaattcaaactaatatttctggataatacatattatattcctactactgtttcggtttgttcaatctgaaatagccctagctggacctgtatctctttgcttctttcctggtctctatgttatcatacttacttcaacatcatttaacataatggagctactaatgactcttccaaggtttttgttgttgttgtttgagattgttactttaatgggaccaaaagaagaacgtataagacaaaagaataaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagacaaaagaataaaacctatcagagtcaggtgctaatttacccataattatgtagggtctcattatatgatcttgttaaagtttgtgatagtgattatatatatgtgtatatatatgtattgagacaaaaatctctaaatgataaaaataattagtaatccaggactctttatagagaagctctctataaagatgagagaattttggggggaaattatgacttcttgatactttcaatgggctttcggctatgaatgtttgagattctcatggtgctgcattaagtcaaagtattccatgtaaaacagtggtactcttggtggaagctaaagaataacctgccttgtagtctctgatgtttcaaaagaatctgcccaaacatatgatctccatcaactgtaaagttagggcctggaatcacacctttcattttctttttgtctcctttagcagccctgaagagttttcaccaaattgcaaactggagtcaggtaataatgtttgtttctgagctttcagaggaagctgtttattttagtaggcaattttcatgtgtgatgaagtgaaatgttgagaaggcagcctctcatcagtggacaaacaatgcctaagaatttagctaatggccccccttcagtgcagagaatagatggtaacaattggacttgcatactagacccagagctacttgtttggctgctaggtgttaatgcaaatttgttcttcagctcattcaaccctggggctcccatcctttgatttaattaaatgtaattggttacattgctcctcccaggcccccgaggtgtttttgtttattgcttactctttgcaataaaacttcaattcatggcacaaaatgctggataaataagagtctttttttcctgtgttggatttgttgggagattatttctttcaaatagtttggctttactgttaaaagtaaatgaccagtgaaataaactcattgggtggcaaatgtagcatatccagaagcaaggaattaagtagggtaaattacatgagattaggaaaagataggaagttgtaatgttaaattagtaaagatttgcaaaagtactataagagctatcaacactgtaaacaaagctttaataagtgagattatcatttttgtagcacgttattaaaaagttactttaaaatttcagttatgaaatactcaatttattttgtaatcatacataattctcttacaaatatgcaggtggcattgattcaggataaaagtgagaataatattgatttaaattaggtcagcacaattaacctattctttttaatgagagatattttccctctgaagtaagtatatatattttttctacctgaagatattataaataacattttttggtaaactgatacttttttttcccctttcaagttttaatcttaatttgagaagtggggtaaattaactttgtattaacttctgaggaataactcagaaacttaggaaaattgagaaaatattattagcacttcccaattcaattttaagtaccaaattgtataaatgacttttttccctttttgttactgtcaatgggataaaatggcctccagaagctgccatttattatagtgctaactggttagttcctttgttgctttcttctttccctggtctttatttttcccttttttactgtagaggtaacatcagtgacattttcattagtgcaatagactttctaaatcttgctgtgtcacaggcctaactcatatctcttctgatggaaaaaatgaaaaatctgtgataagaacctaggtattcccagtgcaatatgaagcttcagtttcccacaataggattgttttgcagaaatttttttctaggctcctctcacattctattgttgagatactggggttttaggcttatcatcttgtgctgtcgggttaggcctttcttctggtggatgcccctgatgaaaaccaagtggtaatagacaactagaaaacactcccattgggaaatggggaactagtctaagatgttagctcaattgtaagtgttcagagaagaaatcaagtacccaatttacttcctggaaatgagctgttaaaaaggctgtgcttcactttcagagcaagctttgttcagctcctaccagctcaggtataggcagaaaacccaactgtggtcctgggtccaaaaatcttggatggaaattacaggctttcttgacagcaaggccaggatgatttaacttcttggctggtttagtcgcatcttaaaataactcttgccccacatacagagaaataagaatgtttaaaatattataatgtagtggttactgagggtttcctttgtaaatgaatgtaatgtcatagacaaaagggagagaaatgttccagtggtcttttagataaaaccagatactcctgtacttgagtaattttcctccctgcacacgggtaataataagcccattgcccatcccctgactctcctgtgactctcctgaatccacagctttgattggaaactctcaacccctgaccagccttgggagcactgattacgaaggcaccccacatacttccttcataaacatttggcagatcaggaagtgctgaaaagcaatgcccctgggtctcagaagagaatactggtgggagaagaaatagaacattttccctcttgcagctgtcaaagagtgattatgtcaaatgggttttcaaggagccacgaagtaattacagggtaacttcttgacattattttccaatgtttgactcagcagatgatgatgaattgatgcatattattttatggctctctgaaactttgtttgatacttcagatagaggcagagctaagtcttcacttagactaacataacaaagttgccttaaattttaacatgttaactctttctttgtaatagatgatttcctaaactaactggtcttctggttgctaatagagactgtgtttgagctaacttttcatgtaaattaaaaaaaaaaaaaacatatgctttccaagtagtgtttcattcttttactaagatgttactgttaattttccgtggctattgtgagaattaaatgagttaaataatgaaaagagcttaatagttggcacatggtaaatgctcagtaaatatcagctataataaaacatgacatagtaatcattaaactcagaaacgtatttccttatattctctctcaaatgttgtccttttggcagagaggaatttgaacacccagctcattttcttgtgtagttatgttacattagagctggtctatctattggtttatatctttttacaaattttagttcaagttaaaatagttgggagtatttaaatacagtggacttgaaatacatatatatatccttttccagggtgtattttatatatgaatgtctaatattatttgattccaagcaagtaattgattcaggtaagccaagatctggacattcatgactgatgcaatagaagtgaagaaagatgaattaacatagtaagtaatacatatcgtggaacttttactgagtttgtaagctttaagtgtatttttttttcaaatccaagttgtcaatgatataagcattttgtgatcttagggttttcataagtttgtatacgaaaagatgttttgtagccagaatgtttcttataagaaaaatggaagtgtctgacattatgagaatttgtaacactttttgcttagtctaaattaaaaaaagtcttaagttttatttttgcctttgtttcatgcaaaataagttctatatgctgaccctaaactgttgattaaaaaataattatactgagcatgataatgtcatatgaatgacttggtatagcatgaaccactaatatttgattaacttttgaaaacatgcttacatatggcttatgcaagtaagtgcttttgagtagaattttttaaaaattcagttatcaatgtttattcaaagtattatttttcctcaatttaagagaaatcttttagaatcaaagatcttgctatagtgggatctcaccatgcccttttacataccaaatacattcatctgtctggtggtgtgtctgtgtgccgtggtttgtaaataaatgtgtgttttgtaaacaaatggagtaggtgagttgtttgtaagctgtgctgcttctgcctgccaactagatgtatcatcaacattccaggtacaaaagatgtttaaccagttcaactgaatagtcctcctttgtgtccacacgtatttcacaaagaaaagatgctgctttcatggtaacagaaggatggtagtctagggtttgcagtgccgtcttcattatgtgtatgctgaatgaaaagaaaccaagtattcaactgtgggctgctgtacgtttgtgagggatttttttttttttggtgttggttgaggtttccattgatagaatattttagacttttaaaaaaccatctgtttatctgaagcacaggaagtgcatccgtctgttgactttattaagtgtattgcaaataacagatggcttagtattaggtttgctcttctgtaggaatttgttgcttctaaaagtaacaaatttttgtctttcaatattaactcatttaggatatttggactgatgtttgatttcattctaaaataaagctttcattgacaatctgacctaagctctccatttatgccctaattgtaatattgtcctactgtatggtaattatctgcttacttggcaatgtccttagcaaagaaggtagtgactttgtcttattcaatattgtctccccaagatcaattaacacaagtatgttgaatgaatgaagcagctttgtgtgtgtgtgtatgtgtctgtgacaatccagaagaaacatccagagatgctgtaaattcctctgatttagggattggtgaaattcagctattttgtgaaagctctcctcccatttttagataaaggttgctaataggtttccaacaaaaaatggcagaaacctagactgctaatttactgtttatgtttgcatatattaaactaggaccctaaatgaaaatatcagagtagcatgttaatcacaatttgaggtcaagtcaattagaaaacattataagtaagtttgctgttatttccaacttcatataatggcatcattgtctctggggcacgtatgttttcaaatatgagcatcgttaggttcttttgaacaacagtacaccatctaatgaatttacatacgtaaatactactaattaacattggtttattattttgcatttcactgctatttactaacagatttcaagacaatggacaattttgtaacctcgattttataaaaaccactagtatttttggtccctagcaaccatttagtatgtaaattaggtattctcaggcttaatgtacttcatttttataaaacaaatacatcattaatctgattaagttcttgggtggaagtgctgtcctcagatcattgtggattatttattgttgggcacgcatccaaaaaaaaattcaagcatggcacttacagtctagatttaggagaattgttgaaaccccctaaatgacattttccagaagaatagaaaggcactgcttacttacaattgcaagcattacctaaaacttaatgatgttcttatccttaattacaactcagttggatgatgattcagtgcctgaaattatgccatgttttgctttgatgttataaaatgtataatgaaataaaggtgatccgagtgaatcaaaaatagattctggctttccagtagtgacttaatcactatgtttctgacttcacaacttgcttgactgtcatggctattatttggtatgtctttagcttttagtcaaatttactacttaagaagtgagaatgtttaattttaaggttaaggaaagttcatgatgttctcattcacatagcagaaggaccttttaaagaaagcttaaaattatttgaattctgcctttttagttcatagtttaccaagttgtatatcttccttttggaggtagtctttgtctaatggagcacgacataataatggttttcatttactgaatgtctcccatagtacgtcattcattttgcctagaaatcctgtgaagttcgttatgtttatacccattttacaaatgattaaacaaaggctctgtgaggttaaggagatacccaaggtcattatagatagcatgtgcttaatctaggaatcaaaccaattctttttttcttttttcttgttttttgagacagagtctccctctgtcacccaggctggagtgcagtggcgcaatctcagctcactgcaacctccacctcccaggttcaagcgattctcgtgcctcagccacctgagtaactgggactacggatgtgcgccaccatgcccagcaaatttttttgtatttttagtagagacagggtttcaccatgttggccaggctggtctcgaactcctgacctcaaatgatctgcccacctcagcctcccaaagtgctgggattataggtatgagcccctggtccggccaaactcaattctcacttcagagcctctgcctcctcagatagggcagataaagaaaggggacaccaatttccaaggcatgctaggctgggatcatttcagacaaggattgggaaactttttctgtaaaaggtcagatagtaaatattttaggttttgaggaccacacagggtttttgtcaaatattcttatttttaatttttttttttttacaaactttaaaaaatataaaaccactcttaactccagggccatacaaaaacattctgagggccagatttgaccaaaagtacttagtttgccaacctcagatttaggactgtgtcagtaagccctataggtatctattctctcaggactatgtgattacagtcaacaataaaataacttatatccataatagtgacttttaaacactaagaaaatggataaattatggttctctatgccctatttaagaaggcttgcaagtattacatcttagattttcatcaaaaaaataaaaataaggttttggtgtttataatgatattttaggtacctgaaagattcaactttttgaaacacttcatttcataacagataaaatgaaaggtattattacaagtggattttgacagttacagaatttataacataccattttagtttcatacctgagcgtttaattttatttttaaaaatcttacctccttgatatttgagtgcttactattctgtccagatttttcatattgcagactgttacttccttacccaccccccaacagtatacattttattgaagaatacaaaggagtagctgagaaaatggttctttatccttcttaagaaaaaagcattttataacaataggtatcagttatctgagatttttgctgatagattaatgtttatatacatatgaatgtttctttctccaactccttaattcattaaccatctatttttgacaggctaaagtgaatcagacttctgcttcaatccctttgcttaaagaggccccaagcagggttactggggggatagttgttctgttggggaataggggatggcaagggacctggggccgtcaaaccagtagttgaaaacgttttttatttaattcctttatgtccatgtttttctgatttctttgtttttcttcaagccataagccgttagtagtgttcttttgaaaaagtcagtattggctgatcacagtggctcacgcctgtaatcccagcactttgggaggctgaggtggttggatcatttgcactcaggagttcaagtccagtctgggcaacatggtgaaacccccgtctctacaataattataaaaatcatttgggcgtggtgcatacttgtagacccagctactcgggaggttgaggtaggaggattgcttgagcccaggagtttgaagctgcagtgattcagccactgtactttggctcaggcaacagagcaagactctgctacaaaaaaaaaaaaaaaaaaatgatcaaacaggattcagattcagagaactactaccttctctgagtcttcttttctatgtttgctcctccagagatccaccaagtaatgtgtgtttttttttcctgccacctctactggttttttaataaagtaaaaaatacagacagcttcttattccatgttctaagctctttatatgtattagtttacattatcttggcagtaactctttgagaaaggtacttatagccgcatgagaaaactaaggcaccaagaggttaagtaatttcttaactagatcaaggtcactcagctagtaaaatggggagctgggagttgaactcaggcaggctagctccagtgttcatgctcttaaccattcctctaaactctttctcaactataatactagacttgcatcttcctactattaaattcaatatgagtgaatttgtttcagtaaaacaacattattcattacattaaattgataagttaagtttgaatataattggttttgaaatttcatttgtgtttagtttataaacttgttttggtttcatggttatataaaagctataactttgaggaagttttacttgtttttgtgcataataattataattacaaaaataataagagttaaagagtagtcctcaacaactataaattttttcctattcatttacataacattgcttaagtttaggaaacactagtctgtgacgtaaagttaggctcttaatgcagtatagagttccttaaagatatgatccctacctgtcttcagtttgatttctcaccatttccacctttatactttttgacactgaactactcaggtgtgtgttttttgtttgtttgttttgttttttttgagatggagtctcactctgcagtgcaggttggagtgcagtggcacaatcacggctcgctgcagcctttgcctcccaggttcaagtgattctcctgcctcagcctcttgagtaccaggtgtgctttttgtttgcttcaactcacccttgcataggactgtctcctcttatctgcccctcctactgggaaaatggacacggcatccccttaaccccttgcctgatcttggttggtgcccttttttggtaaccgcatagtgtcctgtgcacccttctctcattttactcaccacattgtttcataatttttgtacctgttttaattaaactgatgacctgagcaaagggacaggtacagaagaaacagctatagtgaaaagtaaccatactttcctggccagttagtttcattttcttgaagccaccatcttttttttctcactgtcttttggaacccaaattgaaaccaccatcacttgttattaaaacattaagaactctcattgggacacagtttattatactacattctttctcgtataattagatccttctcttaccaccccaatgactttatcctacaattaatcctctctctctcctacatccttaattcctccttctttgtagagtcatttccatcagcaaacaaacatgtagtacttcccttcttaaaaataattctctcttgaccccatttccaatctagttgttgttccacttccctgccacccacctcctcttttgattcctttttatagaaaaactttttggtagagttagttctagttgcttcccctcacattctttctgctgatactggattcaagaaatgccaatatgggccgggcgcagtggctcacacctgtaatcccagcactttgggaggctgaagcaggtggatcacgaggtcaggagatcgagaccatcctggctaacacggtgaaaccccgtctctactaaaaatacaaaaaatcagccgggcgtcgtggcgggcgcctgtagtcccagctactcgggaggctgaggtaggagaatggcatgaacccgggagagcaagactccatctcataaaataaataaataaataaataaataaataaataaataaataagaaatgccgatatgctgggaggacttacatccatctgaaaacgtttccagggcttatgaatgctataagtcaagaaatgtcaggagccaacaacagagttactgaatgaaacccctgaagataaatattttctacttggagacaaaggtctcattggcaggctcaagcctctcatcttttctgacagtgcctccatctcatgggatatggcttcttatggcgcaggtcagaatgagaaaggagagtgcttagaggtaaagagtgttgaattagaaagggttttatttgttgttgtttgtgtttacttatacaggtcttataaaaatgtactcatttgagctggacttgggatgctgcatcctctagtcccatgattctagtgcagcccatgatttccttgagtttcctgaggttctaaaagccaacttgggctcttgatgtaacctcgggacctcagggaaatcacacaaagagtgggtcttgatagcagtaatagaaaatacggtattattttattttttggatgaagaacccaacattcagattgtccccagggcaccatgctagtaaatactagtaaatgtcaatgctggcatttgaaaaccagatcctacctcatagcatgtgctcttcccactctttcacctataaaagatacacaaacactttaagtcttaagctgcactatccaatatggtagccactaactctatggctttttaaattctaaatttaatgaattatgataaaatttaatttaataaattaaatcaaaatttcagctccccatttcacatttcaatgcacatttcaagggctcagtagccacatgtggctactatattggacaggaatgatatagagtatttctatcagaaagatgtattaagacagtgctacttcctttccaagacattaattttccacagtagtatcacatactcttagaattctgtgctattggtattgatcgtaattgtagaaccttttatcccttattttttttattatccatttttaatatcatggtattatttttcacagaatccctcttttacttggtgtagtcagaattctccattcctcctcttaacttacattttctcttttcttaaaatggcctgtttggaattagccttgccacccctactaatttgaattccacatcatgaaatgaaagttcctactttgtgcttacctggccagtacctgggggaattcacctattaaatcatattcttccccttaatatattcctttggttcctcttccttaacaatttttttctcacttatttggtgtctgttaaatatcaaaacacttttcctgtgactcaatatatgtttatatgccaagtctttttttcagtttgaggtacttgaagttcgtgccttttcatttgacttgctggaaaatagttattccttccctacatcatgagttttcaggattaaaaggttttttgacctttaaattgtaactaataatttgcctaaatcagtgttgctgggtgataacatctaggataacaagtgagttacaggttcacagtgatgactcggaattaatccttagcctgtgtcatcaagcttgcaaatagaggagtctttagaactaagactctatctgctttctctcatggcacacggcatagtaccaagcatttcatcttgtgcactcaatagatgtagatgattaactgtataaaaagactgcgctatcttagggtagggttaactatctcttgatacttctttttttttttaaacccaacacagactgaataatatagtgccttcgaatatctttcagattggtgcattgatatttgtagatataatttcaaatttagaaagtgcttggtcttctgccatatcactctgtaggtatgtattctccttatataactagttgtactgtagaaggtgatttggagccttacagctttaaatcattcttgcctttttaatatttataaggaaccacagttttctgtgcattttgacatggtagcttttatacttgaaataatataatggcaaggaaaatatcctcttttatctagacttctaaggcttaagctttgttttttgttttttcattttctttcagcacctgcggtatgcagctatatacaaggctgatggagagcaaaagaggctgcccgatagcactttaaagaaaagttattaggctggtcttcaaattggcccttgagaagcaggtagctcccttgctactaaacagatgtgctggtagcagcttgggaataaagagcagcagcagagtctggcccaaatactcatttttacccaagcaagactccagtctgagagaaaaagaactgcttagataaggtgaatgaaagagaagtatgtatgactcagttctttcatttgccttgcaaacccatctgtggctctagtggagagcaggtcagaagcccaagagcaatggttatcatttcccatagagttgtgtgtatatatatacacacatatataaagcaaaattatatacataaaaatgatatatatctctctatacatacatgttcgtatacatattttacatctgctcattttgctttgttagtctaatgccaaggtttctatgagtatggcacccttgtagtccttcacagaacagacttgaaacctatggtttctaggcactaaacgttatctcttgctactaagccatattgtattcctcacattctcaggtcaaaccttttgatgactccttgcatttcaatataatgttagctctgtcttcaagggctcctcttaattctctgaccgacttctactgatgtttctaaatacaattgaaatgctaccttcttgttaaagcctttccaaattccttcaggccagtggttctatcccttgtgctcccaaagtacttagttcatcctgctgttgcagcactaggcatctactgtaattatcactttatttgtctgtcatccctctttctgatgagctgctggagcagggattgttttcatatccttaacatctagcacagacctagacttcttaataggtgctcaataaatgagtgactgcaagaataaatgaatgaataaaatataccacctcatgtttgaaatgtacttgaattcttccaaccagccttttcttttgtgctgcttttctttatcttcttcccggcagcacgttcttctgtcctacctggtagattttagagcttaggaaatacgtgtttgaagatttaaaatatagttctttgaactccttagaggaaaagtctatgaataaataattagactcatttcacatcaaaatctaaagtgtgaaaaaatgttcgtatcatttggtgctttattcacttgtatggtaatctaatggcatacccattgttaacactgaactgtactgaaatattttactctcagggcttttcatctgacaaaggaggctttttgaaaatgaaaaatcacagctcctgtccctggtatgctatggggaaatttattagttttgtaatgcatgggttaatattaccatttttttatattgaatattacttgaaaaaattactattaatatcactgcagcatgtatgtatataagtcctgtcatctttggggtatgtaaatcaggaatgttgctgaagaactacttagcattttcttgggggtgaagtgcttagttttggaatttaattgtaggttttacatttaagctgctcagtattactcttctaaaggttctataaatttcttgctttgtagtttaacaggtttagtcaccacagttgaaaggcatcatcctcataatgaagccagagaagaataaaggttgatcatgcagggctggctggctgtgacattgaacaatagagcttgacttcttcatgtctgttaaattagactatggggtgtgcttatcttgctgcaatgatactgaattgtaacatgaaaatgttatgttgtgcagctctgcgaagggagttcatccgttctcacctcatatgtatggcaaaagctttaaaatactactgaagctgcctagtgggcttaaagtctaatggcacagaattgggcataataatgaaacaaataaagaaaaagtgcaaaggcttttaaatgtcttgtacaattttatttatagtagtcttttaagggtctaaggcagaacacaagaagggtatgctggaaaaattccatttggaagaggtctttgaaggagataagtgttacggcctgaaggaaaagtaagaagatatgttgcgtaggtgagtgatttattctaaacttttctacacgtgtacttgatacatacaactcaattctttaaatattgataaaatacctactatgttcccagcaccgtgttggataccataggagattttgaaagagcattaaattcagtcctgccttgagcaatttagtattttttgaggcgacagaaatgaaatccatgaaataatttcttagaattgtcggatatgtgaatgacagtattataagctgtcaagatcatgtaaaattttgattctgttattatatgtatcattcccagatgtgtcacatgagcttttgataggcataccttttatgttttcaagtctctgataaaaatgttaaaaagtcaaggccatggttaggttaggggcaagaaagagccttctgacacttcccatacttgttcttcacacatgctttttgtctacttttgaacctgtgttattttctaaatgtgtataagccacaaattagtaatctgttacaaaattttatcgtggatgttaagctactgttcaagttatacacacatacatgtgtgtgtaaaaatctggattaatattctagttctttcagagcaattatcctgcaaatcctgccaggtgatgggaataaatagggtgcccatcacccagaggtttccttttaggggaagtaagagcatgggagctaaccaacaccaagcaccatgtacccaaatcttagcaagcataactatagctaccagttatctgggcatgtcacaggacatccaaggaggactcaattccacagtttcacctgggcattcggcttatgaaaaggagtccatgcaaccccccaagacacatttttgtcccaaattcaattccaagctttgggtcaaagccctgggaaagaaaactggatctaagggatctagaggcagatgataatagaggttaaaaggcacagtgcaggtgagcatggctagtttctgccaattaagccaagcctcccatttcatggataaaggtcaagctaatattcatggcataaatgaggtcccgggaactccaaggctactgacagtagcagggatagagacataggtgagagcagataattcctattctctaggccctccctgcttcatggctacaaactgctttggcacccatgagtggcacctgttatggtttctaggactcagggatgcaaggatggaagagggaaagaggactcacttccttctttccctcacataccccaggtatttgctaggaagagaagggaaccagggatgcctgctcccctctttctagatgagtagccattcatcttcagtttgtatccctttcaaatgcatcccgaacccctgggattcccttgaaaaatgccctcttttttcttttctcctccttggttctctcttcacagataggtaattgtgtctccatactacgggacattcccctaagatgcaccctccaaactgggaaaagttaatttcccaaaccttaaactggttggcttaggactgggctcaggggaagtccaacatgtcggcaaaagggtagttttttttttttttttttttttttttttttttttttttttttttttttaccagttgggcttttggtcttcctctccccatgcaaactggtaaaaggcctcaggatttttgagttgtcctcagccccctcctcttgtttcattttaatacatgttttctaataacccagtttgtctcttcttactttcagaccatcaaactccaaatggtcatgcaaccaaagtcttgaagtctcggacaatgaccccttctgccaggaactcttagataggcttctgactgccattttccccaaaacaagaccctctgtcagcaggaagcagttaagatctgtcttcatccttatctttatccttattctaatgtcagttagacatacttctttagaggggggaatgtgacagccaagtataaaggggtcgctagagaacctctgggactacaggtgtgtgctaccacacccggctaattttttgtatttttagtagagatggagtttcagcatgttcgccaggctggtctcgaattcttgacctcaggtgatcggctcaccttggcctcccaaaatgctgggattacaggtgtgagccactgcgcctggcaacagatatttactgaatgccagttatgtgtcaggttcagttgcgttgattattcactctcagagcctcccagatttggtctttcccttatattatttatttatttatttatttatttgaaacacagtctcgctgtgtcacccaggctggagtgtagtgttgtgatctcagttcactgcaacctctgcctcctgggttcaagcaattctcatgcctcagtcaccgagtagcttggattacaggtgtgtgccaccatgtccagctaatttttgtatttttagtagagacggggttttgccatgttggccaggctggtcttgaactcctggcctcaagtgatccacccacctctgcctcccaaagtgctgggattacaggccgcgccactatgcccagccttttcccttatattctcattcacttcaacaacttaagttccgacctagaggcctccatctcagtcttccaccacactgtataccttgttgtgctgccacagggtttgtggtgtcaaagcaggcatctcagtccagcattgaggcctttcatcatcacagtctttctatctgaagtttatcttctgtcattcctcatcatacccacaagatttggccatacctgtgtcattacctttgttgttgttgtacatacacatgttatgatttacatttgggcttttccttattccttttccacgttagcatttatgaaggtagtctatacttgattacccaggtgttctttatttaatgtaactcgtattcctgacaagcttatctgcacaaaattttggtacattggaccatttaagacaagagtaaataatcaattttaatttatctttgtttaaagttggagttttatttagtggagatatgatgcatctgtatattgctttgtgctttgttaatgttcagataaggaaactgaggttcctagtggttaagagattggcataggacatttggctagtaaatagagagagtaggattaaaactcacattttataactcattgtcgagtatgcttttcactagaatagttgatttccttttattctcctcgttttatgtaattctgttataatatccctaaaggtaagagctgtattttgtatcatacccctcctccaaatattcataacattagtgcctaccgtagttttggataaagagatttaattgccatgttgatatatgtgaatgtatcagtcatagtgggataggttatgttgcaataataaacagcccatcccccccaacctcagtggcttacaacactaacatttctttcatgttgcatgtttatcttgggtttattgtggctatgtttcatgttgtctgcaatgtgcaacctgggatcagtaagcaacttcttgaacacttgtagtggatagaaaaagggcacagtaacccatgtactacttctcaaacagtaatgttttcacatcttattggccagagcaatttacatggtgaagcctgttgtcagtagggcataaaagtataatccttctgtaggtaggggcagcaaatatttttgaaaaataatactccgcccaaaaaatctgtgaccttacatacagagcattgagcaacttgtatttttcagtttatggcatactatcatcattggtccctgtctggccactttgttttttaattcatttgtctgtctgttttaatgtattcttataaaatgcattctattgtttgggatatgtattttaaatttataagtggtataatgctagagattgtattctgtttcttaattttttttcacttaacatttattacaagatttattcacgttgctgcacattcatccagtttgttgcatctggtgaatatagttgtcccttggtacatgtggggaactaaccagttctataccaaaatccacacacagtcacatctgaaagttgaccctgcagaaactgcatatatgaaaagcaccccaccacccactgctccttacgcacgggtttgcatctggggaatgttgtattttccatctgcctttagttgaaaaaaaatccacatataagtgtatctgcacatttcaaacctgtgttgttcaagggtcagctatctatagtattgcatgataaatatccactacactttacctgtccacttccctagagggtcttcaattctgtactacaataaatggtgctgcgtgagaatttctttgggctgtacacccaggtataagattgctgggtctttggacatacatatatttaactatttaagtattgctttcttattgtttttgctaagtcttcacagctattaagccttggtattatgagagtttagtaattgtgtattctatcttgtaagttaaccttactaattctgtaaaaaaagtccacccaactaagaacacacgtgtaagtaatgtgacatgtaattcacctctgtaaacatatttttcactaatgattatgtatatgcgtatgttataaactgttattctgaggcattattttgtatctctgtaaatcagtgagtggataaacaaaatgtagtatatttattcaatggaatatttttcagcaataaaaatgaatgaattaatgatacaacctggatgaacctcagaaacattgtgctaagtataagaatccagtcacaaaagactattttaagatagcatttatatgaacggtctaggacaggcaaatctgtagagacagtagattagtagttgcctcgtgcaggaaactagggagtatggacggaatggggtttcttttgggggtgatgaaaatgttgaaaaattgattgcgacaatgtttgcacacctgtgtaaatacacaaaaaactattaagttgtaccatttaactgggtgaactttgtggcatgtaaattatgtcttaataaacctgttaaagacaaaacaaaacttcaatcagatcgttttccaagaagcaggctagaaatgagttaaatgttgaccccttcatgtagggggaagattttctccccttgtgagaacctgaagggaaaaaattgggacagttttattcccaaactctatcctcaagttgtttgaaaataaacccatgcatgttatttcaactgactatctctgtgctgatataccctcagccctgataatttgtttaactgtttagttatcttcaggatatttttacttgtataacccaccactaattttcttcccaattatccaatttctgctgtcctttcggttttttatatctcagtagtttatatctccataaatcttggtgatctctttcttttttctcatttctagattaaccttttatcatgtcatatcatattatcttgaaattatttttcacatatgcttctttttattctttagactttactctgcccaaaaggagaaaataatttctttcttcaatgttttagaaacaatagcattggcagatgtatgctaattaatacttgcttaaaaacagcaaggaaatttcttctttcaacactattaacaagtatctgacatgaaataacactttcacaagtaaaagggattctgatattttacgttccttagtaaatctttggggagggggttagtactagaaatttttttcctttggaggactggtaaattcagttctaatttttacattgttttacatatgtccttttatgatcactataacatttgtgtttatcaaataagttaaagtatagtaatttttaagttaagtagcgaaatccatgataatccagagatgctcaagtgacttgaatgcttcaacttgagatgggtcagctttaggggtgaagttgtgaagagaaagccatcacacacacttcatcaacactgtggaatgagggaccgatgcttttactgagcagtggatttccagtgagcatataaactaattggtgggtgaacataccccaggagcaatgattttaaggtcatagcaggctcagtgaataatgctgacttacactgcgtctcactgatagctgatcttaccaatgagcagtttagaggcattcaagcctgagctgtcttccatgtgccttgaatggcatgtcagtggtcactgtttttgacatcctttatatttgtccagtcagctctaaatctttaggttcagcttcagagtactcaggaaagaaaagagagaagcaattattttcagtcattgagttttgaagatcttagcgttaattatgccaaacattgttggttcatcaacaaatacaaaccttaaaaggggttatgaagcattctgaacttgcttaaacatagtttatggtgattaagagaatcttgtatacactaatatatttttagttacactttcacccatatattttcatatacagtttcaaaaccaaatattcaaattaaagctaatttcagttttggttaataaattttgaaatgcttattcactttaattagcatttctttcgtatttgaaaaaagaggaataaaaaagtacaattcactatttctctgtggagtccagagtaattttgggtgtgaaaaatatttcaataaaacaaaaatcacaatgtcatagctctagtaatgctatttaaaaattgatttaatagtgggctttgagatttagaaattttctcccacttaaatctttaatttatcaaagattatttgagcattaaaaatgtgctttgcctattgttttccaactctctgtgctctctgacttgttgaagttttgcaggaagtgcccaatcaaaggatttgaggaagcagtactggacattctttggaagtgttcatctgagaaaatgaaagttagaggctaaactagttttcttgtttgcaactcaaattttaaatctaatttcccatgtaaataaaataagtgaaaagcacaaaggatgtaaacttcctaaatctgccagaatcttgtgtcttaattaaaaaataattttatcatagcaaaagaaacacatttagttcctaaagaaaataccatgggtggtattcttttgttgtattagaggtttgaagtagaatagttgtttctcatgtacatgtattacagtagacaaagtgttgaatagttttcatttctgatacattaatgattagaaaaatcgttaccctaatcctttttttataactcaaaaacaaactaaaaaggtttttgtttttttggaggatctgttctttccaagaggctggtgttcttctacctttactgtcctaaccttgcctttcaaattaagatataatagttagaatctactatagaattaatttagattcagttgtctctattaacagaaagtgatatggttttaaaaaatgcagatgatcatttatgagaatctggctgtaatcaaaagcagtaactactatccttagcagttctttattcagtaaagagttatcctctttttgctattctttatttcatttattcttgtgaaatatgtttacctttttaacaaaactttctattttacgtggctagatatgtgataaaacaaacacggtaaaatgttaaggatagaatctaggtggtaggtatatggtcttctctgtaaaatttgcttctctttcacatttgctgtatgtttgaaattttcatgagacaattttagagaaaaaaagctttctattttgattgtaatagccaatagccaaaaaccttattccatttttgaaaaaaaacctagatattttaagtttcttttacttatctaagcataacaatgcaaataccatataatatatattgataatatcacacatttagtgagttagaaaatataaaactggcttttaattgttaaatatgtatactatataccattcatattttagctggtggtttaaaaagctaacttaggcattatttaaactgaattagggtaattacatcaaaagtagtttcttagccagaataattttccattttgttaaaggagccatgatgaaatgaagtgtttagagagttttaggaataaaatgtgggtgtgtattctttaacatagaatgaatatgctttccagtggactttggaatgggaaaagtatcaataaataatgcttattaagcttctaactaggcatagcgccagttatctcatacttgagagagaattttttccttaaataaatgcaaccattgcattttgggggtgcttttcttactgtcttcattcaactgtttgccacatgtgtgcctgatacattattgaatcatagaaataatgtttaaatatatgtgggctccccacctacctcctttttaaagaaatagatattaaacacacaaaaaaatattactattgtttcttccctgaaatctttcatggcacacttggcttacagagtttaattttgctgaaataagagtttataagtcattttacctttgatattccaaagttggaaacctagagataatttttaagtaaaatttatctttaacctttgtattataatctgtatttacatgagtgtgcaagtagcctctctttattaatgaaaataaagactagtgaaaaaattttacaaatgattaacctagttcttgcattcattaggtatatttacaagtcatctgtgatcagtttagttaccatccctttgatatcctgcagccattattggatgcctttggggttgtgatatcatgctggggaagaatggttcggctgcaggttttatgtgtctttttatagttgttcacaatatcccatgctaaattatatggtgaattattatacatttgctagtttaaaagatgtctaattgatttactatgctaaaatatcaaagactatatgctgcaggagtgatgcttccagttaacaacttatcatgtattcatggagacgacaatgcttgctcacatattggcactattgtctaatttggtgtgccttgtgttgtaattcaatcatctattattaaaagtagatgtggctgtagggagcaaaaccacatacaaatccataaacatacatatgtgcatatttacttatactcacatatatgttcaataaggtttttgttttacctgctattaatgtttgtactagtgagtcataaatggaaaatatctattagctctaaggtaaaataaaataggttttgatttagttcaagtgaaccatctcatttaaaattagcccaggggtcttgtaaagaatgcaagtaatctaaacataataatgcacattgcccaattgcttctgtgtatgatacaggttcagtgctgtagtgctttgacagcccattactgaatgtaatgaacagctatttttaaacagaagaaattcaagttgacagcttggcaatgaaattcagctagtgggataatttttgtcatctttagtatagagaatggattcagtttggtttaagcaaatttgtatcatgtagtttatagcgcaaacatttttattaaaagataattttattgtccattttgtggagaggggcagatgttactgttaagaatatgtaatcagcttttaatgaatactttaatgaattactgaaacatcatttctagaacctaggtttaaaatgaaatttctcatttttctttcctgccatgggtgaaatagtctaataaaacgactataagattaagaggtgtttttctatgctgctttttagtctttcagagtttaaaacaagtagttttaagaaataagatagtctttggaaatggatataaagcttgaggcagtgttgtcttaatggaagtaagaattagacaaaataccattgagagagagaaggaaaatgtctgcctgactatattttagagaaattcttttactaagaataaggagacggtaacatctgattttgacaactcttaaaaaataagttggagaagcttcgtctgcaattcttaaataaaacatatatttttaactcatactatgaaaaataatagggtaagtcagagtgagttatttcattctcttctgtttacagcagaaattgtttgagaattctaattgctattttttctaagttgagctaattgccagagcttttaaaatagagacttcaggttcaacgttgtgcattgtgttaaatgtggcttgaaaaatacattactcaacgaaatctgggtgaacaaagtaagtaaactgagtactttacccaatatccaataatgtttctgaccctaccagtaaaataaactaaatatatagcagtggtgaaaattttaaaattgtcagaaatccccctctaaatgcattgccagaaagctttgttcatgggtcttcattaccccttcatgcttccagggcacctcctctgggttcccaaggcactgggaacttaaaagttagctttgcttagtaactatgccttgaagtaggataataaaacaaatcatttttaatagtcagtagattttttttccatttctgatctgtttctctattttacttatctcttggacggcataatggccccaaacctaatatagcaatgaatctgtgtagaagtcaagcatttttggagaggctttcatgttaggtcactactgtactctttagaattgtattgtatcagtgaatcaaaagaatttcttgacatgaaagaattggtacacatctataaacattttatttaaacctagagaggatattatttatctaacagaatccagcttacttctagcaacagtaccatcagtttgtagcctggtctttgaactcttgattttgttgtgaagtgaccctcttgaaatcttaatttacccatggatagaggacgttgtatgaggcagaagggcatcatcacattagccctgcttctctatggcatcatgagatgctaagataagcacttgaaaggtattttaactttcttgatctcagaataacttgagaagaaattcatggtacccacatactgggttaacaaaataattagtcgcatttggttatttgtgaggaggaaactgtgaaacgtgaaagtaggactggggattccaggacgaagcctagagatagattttttttagaaggaggcttatctctgaagatgggcaggatgaaagaagtcaccagcgattccagtggatgctttctgtgttatgtgactacatttttctttctgcttgccctttgaactttgaggtctgagcagtgcaggaagaagagaagaaattgcgttgccatgatacactgtaagggcttcaggaaaatgggatatggcagtggtttgaaagatattgagaaggtttccaacccaattgtcattcattgcagctgtaagaatttaatgggatatggtctaatgaagcatacccattgaaaaattcttaaactagtgtcttgagagtcaaaattgtttgctggttaagacacattctgtctggagcttgactgcctgggcttaagccctatcactagctgtgtaactttgaccaagttatttaaccactttgtgccattgtttctttatttgcaacaaaaatcacaactcccagggttagtataaggatcacatgggttaaacatttaaaattcttaaaaagctattttttttaatgcaaaaagagcttaatttgtgtaatctattgttgttgttttagaattcattgtagttggaatgctgtgtgtcaaaaacgttggtccttaattaaaggttaaagttatcaggaatcctaactttgaaaaaggaaagtctaaatgagaattcaattccatttggttaatatttatcattcataaatattaagtagcatgggatgggatttataaaatattgaaatcatagcttctaccctactaataaactctttgaggatagggaacatgctgtatgctaccagtcttgtaacctaaatggtgccttgtgtaattcaaatatttgttcagtaaaagtcaggtcaacatgaatccaaatatattgctagtacatattagatacttaatatgtgtaacttaagtgaaaggatttatttatgtgcgtgagtatgaaaacaagtgttcattttcactagtgatgaaggacttgaattacaacaaaagagttacaggttataaatagaagtaatctgactatagggttggtaaacatcctagttctttcctaagagaaataacagaatctatatattgtaaagaataggttatcaggtgacatttaactgtctttatttgttgtagaagaatatttaggtcttttagccctcttaccctctatttctcagaattattatataaatatgtacattcttgtgaaagaagaaacaaaaagaccttggaatgaaaagctttaactacagccaagtttaccttttctatacatgtcatcctttctcttttaggggaagcaaccaggggaaaatgaagatatcaccatcagtagtaactcttccttttttgtttaaatggtaaatatgcctggggagatgggacttataagaaaagatgttttggccaaggcatcctacctctgcttgtcttcatgatcttcattacaatcatagcagaaatcctcatgctaaatgtttttcttttccttcttttctgggagatcattaatcagctatcctattttcctattttacgatttctccttctccagcccaattatgttttctacaaagctagtgtctgggatactaactcttaactcattcaagcaagcttctcggctatatcattacaataaattctatttaaaatacttagtgaagtacagtattcataagccagttattgcattaggtgtagctgcagtgacactgattagcattcatcataaagatagttgaatatgatttatttatatttgtatgtaagtatatatattttgaatatgtactatgctcatatgattcaaagttcaaaatggcctcaagagtataaactgtgaaaagtctcctttccatctgtccttcatcaacccagtttccctctctggaaataaccacaatgactaatttcttttgtattcttccagagttattttctgcatacaaataaaaacatgtatggttgcatatatttctgtatacttaaaaaatggagatgactcttttgttttttggttaacatcactttctggaaggcaaaagatgatcataaattccttctgagagtaccaacttgccaacttaccttaagtcatatttctttctttttattttctttctctctttttttttttttttgagacagaatcttgctctgtcacccaggctggagtgcagtggcatgatcttggctcactgcaacctccaccccccgggttcaagcgattctcccacctcagcctcccgagtagctgggactacaggtgcgtgtcaccacgcccggctaatttttgtatttttagtagagatggggtttcaccatgttggccaggctggtctcaaactcctgacctcgtgatccacccgccttggcctcccaaaagtgctaggattacaggcatgagccaccgtgcccggcccttaagtcatatttcttaaaagtgcctagtgtacaagagtctttgaaactagaaataagtaagaagagaaagcaaagatagattagaaaccctcaatatttgttttcttcttttggaaattctcaacagaaattccagatgttacaaagttgaattagctagttcctccatggctgcttggtgatggataagccattcccctgcaaatgaatagtgaaccctcagattctcttggaagcatggaacagcctgcacattagtgtaaagaacatcccccattttggagtcagattaatctgggtttggagacacagatctagcattaggactttgtagctttgtgacttttttttttttttttttttttttgccagagtctcgctctgttgctcaggcttgagtgcagtggtgcattctcggctcactgcaacctctgcctccccggttcaaacgatcttcccacctcagcctcccacatagctggaattacaggcatgtgccatcatgcccggctaatttttgtatttttagtagagacagggtttcaccatgttggctaggctagtctcgaactcctgatctcaagtgatccgcccgcctcggcctcccagagtgctgggataacaggtgtgagccactgcgccctgccagctttgacttttagcaaatgactgagtcacctcgtgaaaactctgtaaatagagagtaatcaaaccaaacctgtggtatatttcacacggttaaatgagatcatgtaagtgaatactgtctggacaaaaagtaggtgctcaataaatgtcagcttctttattcgccattctgccagtacatttaagatgaaaaggtctgctttcaggggtttgtgctgttcagtcttactgtgcttctcagaattgaaaacagcatttagaaagacgtttttatataattattcatcttgtaaggatgcaagtgtcagaatctatttttaatccaacaaccagcttttctgtagtgttttaacagtttacaaatgttaactttccattctctctagggagatgagagaaatcgataaaaggcgattacaagtgaatactcctatagcaatacttgatacattaaattgtttaaaagtgttttttttcttcttcctcttctagttgcagtaatacgaggtttctaaaggccatacgtaactgtgtacataaagaggaaagctacttgggatagaaggactctcagattgggttttaacttctcaagtataaaaataagacaagtaggcaaaaatatcacattctgaagttttaagtgacagataaacaaattcaacatgcaccaccaactttttgagttttaggtacactaacttattgtgggatctgggccagctgctctacctctgtagacatttctaagtgggaaaaaaaaaaaagatttaggaatagtacccttttcagattctctcagaattatagttgtaagcactatgtaaattcatagaacatagttttgaagaccagctttagaatttcaatagttattgtatattcaaaacagctacacaagcactttattttcattttaaagatttacaattaaagtcattttatgtatacctcaaatgcctgattatacacaaacccattacagggtttatacacacattaaatcccttcttattatggggttttgtgcacattaaatgcctggttgttatagattgttgtttttcttgttaccattaaatgtaacatttccctaggtgatgaaatgtattattatttagaacatttattttagtgtgtgttctgtattttaaaagagaaaggtatttaagcagcaaagatgtaactgttatgaaatttatttttataaatagctttcagcagaaatcagaacagtgctttaaaattacagttaaaaaatcatttaatcatcacactccttgatggctaatagagtagtaagtgactcccccatatcccccgcaataggctattctcgatatgctcacttaagtggccctaagaatagtactagtatattttatgttagcaagccttgatagcaaagtgccaaaagttcagggggcatttgtctcctttctcaaaaattcatttaagtcttgctggagctttaactggggcagacagccatacaaatgacttgagataaaatgaaaataatggactgagctgggtgctggggatggtagttatgctgagcacacatcaataagcttggagtgtgattctatgctaatgcaagcctgatggatcagctttctcttttagcctggaggaccattaagctctggaagctgagtcaaactgatagagttggcaaatacagcccatcagttagcagcaatagttaactgactgtgattcctaatatgcgaaactaacattgcttaaaaaccctccatgttcaggacatagatcagaaaggagataatagattctgctttaatttgcataatcaaagcttctcattttcccaccttatagttaacagaagagggaaaaaaagccatggctaccttcattttgttgttagtcttgaatcatagcaaataattttcataaaaatgtaaataacttgtttcaaaataaaagagtatatttgaaagattctctgtgttatttctttggaattaaactgtaggcacagttacatgggttgggtagtaagtgtcttggggatatgaaaagtaacaaagtcttaaaaaattgtgagtctttttagtgattgattattttcatatataatttataaagttctatacttttacttgaggatattggctttgcaaacttatcaaaaacagttcaaattctgttgaattcatatttttgtgttgtgaggactttctgttcatttaaaaacatttgttgagcacccatttatttcaggcactgcattggacactggtgatgtggttgtcctcttggagcttacttttttttctttacaggggaggtaataaactagtaaacaaagacataatacagtttcagtgagtgatagattcttttttttttttttttttttttgagacagagtcttgctctgtcacccaggctggagtgtgcagtggcatgatctccacttactgcaacctccacttcccaggttcacacgattctccagcctcagcctcccgagtagctgagatcacaggcgcataccaccacacccagctaatttttgtacttttggtaaagatggctttttgccatgttggccaggctggtctcgaactcctggcctcaaagtgatccacccgcctcagcctcccaaagtgctgggattataggcatgagccaccatgcctgccctgagtgacagattcttaagtagagccttctccatctgagagattctactctgaccaagtttttgccaaatagactcaaacattaaatatgctgttttcaatcacaggtttccagacggtctaaaaaatttgtaaatgtaaggaaaataataaataaatttgtgttgaagaaaaattaagggcttttgtgtatacctcgttgtaatccagactgacatctctgtgaaaaccctaataaaagtctatatgcacgactttctgagtgtttaatatgtgctggctctcttctaagcagtttactcattaaatatctcattaaaaaaaacctctaaagaaggtactattattcccagatgaggaaattgagacaataaatgttaaataacttgctcaaagttatatagctagtaagtgggtgaggtgggattaaaacctaggcagtttggctccagagtaagtgttcttaatcactgttactctatggcaacctgaagaaatttgtttagctgaaaatgtattgctactttagaatgcaaggtttgagaggacagggaatgcatctgtcttgttcacctctaactctgcacttagcactgaacctgggttatagagggtggccaataagtatttcttgaataagtgagtgtaaatgactactattatatgtttaaattgaataatatttcatacaaattcttttcaaaatttattttgctacatatgtttttctggtgccctaaattagtatatgccttatatgtacattccagtgctagttagaatgataatacgatcaattcctatggatggggtaagggtagggccagaattccttgacctacatcatttctatagcctatctaccctaggtatatgggatttctcagtggatcacatcacatcgagctcatactgtgttcttgtataatacctgctacccttgactcacagaatgttttgtgtgatgtcaagtagcaaatgcttacatatttctacttccaattatgtttcctttctccttatatctttggagaagacaataacattattctgtaagtatcaaactgatattaaatgattgaatgaatggggctttctcctgtacatggtttgtttttagaatataaaaatgaaaaataatttttctaaatataatacacaggacaactcatgtagaaaattcaaataataaagaaaagggtaataaagtaaaaataaaacatattctcattactcaaaataatttatgttatcacttacatgtattaattctcagttaacattttggtaatcatcctttcagataactctatgtatacatagacacttacacatgattttaaataaatgagtttataatgtgcatatgattggataacctgcattttttcactcaataatgaaacttggaaattttttttcatgtcaatgaacattattatagtttttaatgacctactctgttgtttggatttatgattatttaattggccttataataatagatctaaattcctttttttgcttttatttttgatgttccaaacaaaactgtagtgaatatgtattcatatatctatatgaattgttgctgggtcaaaggttttattttttgggtcatgtgtaatctgacagtttaaaattatacaaaaatgtgctgaagtccttgcgttcattgcttagggagtatctgtgtgcaagaggaacattatatgaatgaatagaaatataattcaggtctcagctatttagaaaaaaaaatgcttcttaattctcttaatctaaagatttcttctttatctccttttgctttttctccttgcactttgttaaagaaactattgttctgtaggttttcctgtagagtctgagttttgctgattgcatccccatattgtcatttaacatgaactgctaccttctgtatttcctatacattgatcgttaaatctagaggcttgagccaattcaagtttgattttatttacttatttattcaaagctacttcatagggagagcttttcttctctgccagaaggccacagtatcaatcttattgtagtattgtagtacttacagccattcttgatcaatgccatggatacctatgttaatgtctttgcagtcctttaagttgttccagtttggatttgcataacacaccacttcaaaacttaatggcttacagtaatgtcagcaagaataggaagccctagaccttgttttcccacaaagacactgacttaacaatatatgacccaaaaacatttaggatagctccagaagccagttgtgaattcacagcaccctaggcaggatcaaagccatgaatagttctattgaaagagataagacaagtagttccatttgaatgatgtcagcccctctcttaagccagcatagctcataatagggaggaaaagcccaactcatggcttctgccttgagaggaaaacagaaaagtgaaatgtacatgcaatatactagctttttagggggtgaaaaagtaaggggttgggtgggagttgggctgcccagaatgttgatttcagtcttgcctgactcagagtgctagctgaaccagcataccttggatacctggggtctacagtgaacaaaagagaacttagtagctttttgcagcaccaagaaccctgccagtaccacagacaggcgcaagagggaggaagaaactataaaccgaaaaagaaactgacaaacttctctaattgggaatttacatgcagagagtgagagaagatacatctccccataaaaggattgagaggctgtcagattctctggctgtgctgtttggtgaaggtcttcccctatagaaagccagtatgtaaagattgggagaggtggctgtttttcaaatgcaaaaatcacaacaaaaaataacaaggcacacaaagaaacagggaaatcagtcaaagaaacaaaataaatctccattaactgactccgaagaaacagagatctattagttacctgaaaaagaatttatgataatcttaaagaagctcaatgtgttacaagagaatacagatagacagctaaatgaaatcaggcaaacaaagcatgaacagaatgaggatatgaacaaagatatagaaactataaaaaagaacaaactagaaattctggagctgaagaaaacaactggttaggaaaattcactgtggaagaccaacaagagacttgatcaaacaggaaagaatcagctaactcaaagacaagtcatttgaaattattgagtcagagtaacaacagcaacacaagaatgaagaaaagtaaagaaagcctgaaggacttatggtgtaccatctggctgaccaatatatacattatgggagttctagaaggagaagagagaataggacagagagcttatttgaagaaataatggtcaaaaacttccaaaatctgaggaagaaaatggacattcaaattcaaaaaactcaacagactgtagatatgatgaatcagaagaggtgcacactgtgacacattataaactgtcgaatgtcaaagacagaatctgcaaagcagcaagagaaaagcaacttgacacatacaagggagctcccataagttatcagtggatttctatcagaaatgttacaggtcagaaagagttggaagatatactaaaagtgctgaaagaaaaaaaactgccaataatactgtatctggcaaaattatcatttaaagatgaaggagaaataaagaccttcttggataaacaaaagctgagggaattcatcatttatcatcactagaccttctttacaagaaatgctaaaaggaatctttcaagttgaaacaaaaggatgctagacagcaacacaaaaacatatgaaaatgtaaagctctctagtgaaggaaaatatatagataaatacagaatcctataatctgttatgaagtgcataaatcacttaattccaaagtgattccaatttaaaattggatatttatcttttaaattggattatcttttaaattccaatttaaaagataaaagcactgaaaatagctaactataaaactatgttaatgaatataaaatataaaaagatacgtaatttgtgacactggtaacatagagggaagagatgtaaaggaatgaaatatttatatgtgatttaagttatcagtttaaaagagatcattataactatgttttatgtaatcctcatagtaaccacaaagaaaatacctacagaagctgcacaaaaaaaatgagaacagaataaaaacacatcactaaaaaaatcaatgaaacaggctggacgcagtagatcactcctgtaatcccagcactttggtaggccaaggcaggtagatcgcttgaggttaggagttcaagaccagcctgaccaatatggtgaaaccccgtctctactaaaaatacaaaaattagctgggtggtggcgcatgcctgtactcccagctactcgggaggctgaggcacgagaattgctggaacctgggaggcagaggctgcagtgagccaagtttgtgccactgtactctgtcaaaaaaaaaaaaaaaatcaatgaaacataaagggagacagcaagagagaaaaggagagacaaaataactggaaaatatagaaatagtaagttccatgggaacggtgagagcttctctatcagaagttacttcaaatgtgaatgtttactttaaactccttaatcaaagaacagagagtagctgatttaattataaaaacttcaaacaataaatgctgtttataaggcactcactgtagatatgaagacttaggctgaaagtgaaaggatggaaaaagatactccatgcaaatagcaaccaaaggaaaaaggaggttagccctacttagacaaaataaactttaagtcaaaaactcacaagagacaaagaaggacattatataatgataaaaggatcagttctccaggaactcaaaacaagtctaaatatatatgcatctaacagtagagcacccaaatatataaagcaaacactagcagaattgaaggaagaaatagtaacgcagttaacagtaggatatttaaatatttcacttttcataagggatagatcaactagacagaagatcataaggaaacaaaggacttcaataacattatagtccaattggatctaacagatatacagaacactccactcaacaacagcataacacacatttttctcaagcacatatagaacgttttccagtataaatcatgttaggccatcaaaagcggtcttaacaaatttaagtagattgaaatcactttatgtattttttctgaccacactgaaataaaactagaaatcaacatcaaaagggaaactggaaaattcataaatatgtggtgattaatcaacacactcttgaacaaccactgtgtcaaaaaaatcaccagagaaattagaaaacatctgaaggcaaatgaaaacgaatacacaacatattaaaacttacggaatgcagcaaaagcagtactcagaggaaagtttatagtggtagacacattaaaaaagaaggctctcatatcaacaaaataactttacactcaaggaaccagaaaaagaacaaactaatcccgaagctagtagaaggaaggatataataaagatttgaacagaaataaataaaaagagaataaaaatgattttaaaaaattaacaaaactaagatggcttttagaaaatatcaacaaaattgactagccattagctagacttaaataaaaaaagacaagactccaataacaaaaatcagaaatgaaagagcagacaaaacaacggatgccacagaactgaaaaggactataagagactactatgaacaattacacagcaacacatttgataacctagaaatggataaatttctagaaacatataacctaccaagactgaatcactaagaaataaaaataggccagtcacggtggctcacacctgtaatcccagcaccttgggaggccaatacaggaggattgcttgagtccaggagtttgagatcagcctgggcaacatagtgagaccctgtctatacaaaaaataaaagcaaaattagccaggcatggtggcacatagctgcagtctcagctactcaggaggctgaggtgggaggattgcttgagcctgggaggtcaaggctgcagcagtgagctgtgatcatgacactgtactcagcaagaccctgtctccaaaaacaaaaacaaacaggtggctcacgcctgtaatcccagcactttgggaggccaaggcaggcagaccacctgagatcaggagttcgagaccagcctggccaacatggtgaaaccctgtctctactaaaaatacaaaaattagccaggcatggtggtgggtgcctgtaatcccagctgctagggaggatgagacaggagaatcccttgaacatgggaggcagaggttgtagtgagctgtgagctgtgattgcaccactgcactccagcctgggtgacaagagcgaaactctgtctcagaaaaaaaaacaaaaaaaaacaaagccaaaccaacaaacaaaaactcaccaccaccaccaccaaaatatactacaaagcgacagtcagcaaaacaatatggtactggcatgaaaactaacatgtagaccaatagaatacagaaccaagaaataagtttgtgtatctatagccaactgatttttgagaaaggtattccaaaaatatgttgaggggaaggacagtctcttcagtaaatagtggtgggaaaactggatatccatatgtagaagaatgaaactagactcctagttctcaccatgcacaaaaatcatctcaagatggattacggactcaaatataagacccaaaactatgaaactaccagaagaaagtatgggagaaatgcttcagggcattggtctgggcaaagattttatggctaagacctcaaaaacataggcaacaaaagcaaaaatagacaaatagtattatataaaactaaaaagcttttgcacaacagaataaacaatcaacagagtgaaaagacaactggaagaatgggagacaatatttgcaaactatccaacaagagtttaatatccagaatatacaaggaactcaacaattcaacagcaaaaaagcaaataatctaacaaaaatgaggctataatctgaatagatatttttcagcagaagtcatattaaaggccaacaagtatatgaaacaatgttccacatcactggtcatcaggaaagtataaatcaaaaccatgatgatatatcatctctcactccaggtacaatggctgtcaacgaaaagacaaaaaataacaaatgctggtgaggatacagagaagggggagctcatacactgctggtgggaatgtagattaatacagccattatggaaaacagtatggagtttcctcagaaaactaaaaatggaactatcatatgattcaccagtatcactgctgggtatatatccaaagtaattgaaatcagtatattgaagagctatctgcactcccatgtttattgcagcactgttcatagtagccaagatatggaatcaatctgtgttcatctagagatggatagataaagaaaatataaggccaggtgtggtggcttatgcctgtaatcccagcactttgggaggctgaggagagaggattgtttgaacctagaagtttgagaccagcctgagcaacaaagcaagacccagtctctacaaaaattacaaaaattatttgggtatggtggtacatgcctataatcctaggtactcaggaggctgaggtgggaggattgcttgagctgggaggttgaggctgtggtgagccatgattgctccattgtactacagcctggatgacagagtgtgagaccctgtctcaaaaacaacaacaaaaaaacaaaggaaaagaaagaaaaatgtatgttctcactcgtgtggaagctaaaaatgttgatctcatggaagtagggaatggaaggctaggaagagtagggtgaaggaaggtattgggagaggttggttaatgtatacaatattaaagctagatgagaggaatcagttctagtgttctacagcactgtagagtgactatcgttaacaaagaaatgatatatgtttgaggtaagatatactaattaccctgatttgatcattacacattgtacatatatatcaaagtatcatactgtatccataaatgtgtacaattactatgtgttagttaaatataataataattttttaaaaattagcttattttttcattgagtgtcttaatctatttggctgttgaatcttattaaacctgattttttttttgttataaataatttggtcatgttgtctgaaaatccaaagattgtgtatttggtgtgtgccctttcaatgcgtagctttaagtatatttctttgtttataaattttagaaacattttcttggatgataattccacatttgttgtaatccattacttttctttttcaggagctcctcttacatgtatgttaaatcttcttctttgtgtttctttatatgttactttatctcatgtttataattgctttcttaatttgttttctttccaaattttttattgtgttaaaatgcacctatcacaaaatttaccatcttaaccattttttagtattcagtggtattgaatacatacataatgttgtacgcttatcatcaccatgcatctgtctcctcacattttcagtttttattttgtctttaattgtatccttttcatcttctattacttttaaggtattatcagttacgtttgtttgctctcatgttccttctggttttgttttcatttttgaaaaaaatttctttcatttctaatttttttttgcattttatcaccttatttctgggttttctaattctgatttatatatttaaatatcttctattgctttcttaatttcttctagcttgtttggacataataagttagattttctatatagatattttctgtatctatccatagatataatttttccctttatctttttttttctctctaataagaactttccatgagattcaactgtaatatttcctgcggctcattttaatgtaaaagtagttattctaaatatttaggtaggagggttgtgtcaatatagcttttgtagctttccagttctaacattctcaattctgtttttaaaactatggcctcatactgtgaagtttcctgggttttctcctctcccatttttacctgggtcatttctttgctttaattctattgccccatcctgcccaatttgcattccactaccagccacttgtcctttgtgagggcagcttcagaccctttgtactctcacctgtgagttggaatgggcagtagtgtctctcattttcagttgctgttctcaaattggccctccatgcttctcaaggaataccttggaaggagtttacaatttggaggtgtctggtttcttcccacctgtttgtattttgtcattcatggagataccttgttatagctttgttgtagattgtcaagggggttttggttattctacttaaaaagtacgtttactgtctttatttaagaagctgattattgaattttgctatacattaataaaatgatatccagacaaagtcattgctaatatatatgcatgtctgttttttccttctccaacaaccttgcgtattatctgtcttttgaaattgtcagttggcaaaaagtaataccttattgagttcttatttacatttattgattacttatgagattaaccacttttcatgtatttgaggtccacttgcatttttttctattgtaaattaattgttcttttgtcagtttatctgctatgtttatctttttcttattggattttgagagctctttgaatattaggaatattaatgttttgtttttcactattgttaatgtttcttctctctctctctcttttttttttttttttttttgagacagtttcgctctctcacccaggctggagtgcagtggtgcgatcttggctcactgcaacctccgccttccgatttcaagcaattctcctgcctcagcctcccaagtatctgggattacaggcacccgccatcacacctaagttttgtatttttagtagagacggggtttcaccatgttggccaggctggtctgaaactcctgacctcaggtggtctgcctgccttggcctcccaaagtgctggcattacaggggtgagccaccgcgcccggctctaatgtttcttctctagctgtttgcttttaatgctttaaaaacatttttttataaaattttatggaatagccaggcacagtggatcacttgagtctaggagtttgagaccagccaaggcaacatagcaaaaccccgtctctaaaaaatatatacaaaatttagctggtggtggtggtgggtgcctgtcgtcccagttactagggaggttgaggtaggtggatcgcttgagtcaaggaggtggaggctgcagagagccatgattgtgccaatacactctagcctgagtaacagagcaagaccctgtctcagaaaaaaaattaactaacaaaagaaagaacatgaccttggagtcaagtagttagatggtatagcttaagcatttactagctatgtgagttgagtcaaatcactcttctctgattcttgatgtaaagtatggagtctcactctgttgcccagactgtctgcagcctccacctcccggttcaagtaattcttgtgcctcagcctcccgtgtggctgagattagaggtgtgcaccaccacgcctgggtaatttttgtatttttagtagaaatggggtttctccacatagagaagactggtctcaaactactgacctcaagtgatccacctgcctggggctcccaaagtgctgggattacaggcgtgagccaccatgcctggcctaaagtactattttcaaatagtactttaaggggttggtatgaagattttcaaaagaactatttatgattcttcctaaaagaattaaatgggcaattattttttgctttgagatggagtctcgctctgttgccccggctggagtgcagtggtacaatctcggctaactgcaagctccgctccctgggttcacgccattcttctgcctcagcatcccgagtagctgggactacaggtgcccgccaccacacctggctaatttttttgtgtgtttttagtagagatggggtttcactctgttagccaggatattaaatgggcaattcttttttaatcagtgtatgaaatttgctttggaatttcatttgaatgattattttttattgtgaagaataaatgagataatgtatataaagtacataccatagtagtcagcgaataaattgtagctattactactgttgctgtgaggctcaatctaataacttgtctaaggttcgaacttttgcatcagcccccaaaatcctgtttgtactaaaatatactatctaaaaacattcataatacaaatattccatatatcctctttcatttttaacaaaaatttatggatgatacaatgtaagcaagaacctgaggatacaaaaaagtaagacttggtgcctgtcacctaggagcccacagttggtagagaggacgggcagatataggaaagaagaaattgcttttcctaaattatgcatcccagaaaatagcattctggagtgtggttttgaacagaattctattctgcagatagcaaaacataagttacatgttgatgagattaaatgttcaaatcaaataatgaaatatatttatttagatacatttaatgtcttcttatataagttatcaagttgcattttttctagctgcatttaaatctatgtgcatttccttcctacttctcctgagattgatatgcagccagcatttcagttaccagcgtgaggaataaaccgggagagaggaaagatagtgaagcagctgtcttccattacaacgtgtctaaatggatagttctaccatgatgtttctttcaattccttccgggtttgggtgagaggggtggaaggaatgtttccattggtgaaatggtagctgaactgccaaatggtatgacctgctatcaacactactaaaaagaaaatcagagacatggattattattggccaacatatgtttttttgtgggcatttcctttgtgtttcattttatgaaaaatgataggtatcgcattaaaaaatcaaataatttataataattggaacctcattagtagattttacattttatataccaaaatgttaacaatctatgttttaaaaattaaacctccaaccactaacaaatcagagctaaagaaataatcccattattgaagaaggatcattgtggtagattgagtgccagaattttttttaaaaacagtgctatgtttagtacattttagaaataattccataaaatggtatgttttataagcgtggatttagagataaattatcttgggaaggtaagttaacgaagacaaattctgtttaatatgtaataaccaactctggacaatgaaacctttccatccatgactttactctgtgtggaattttttagtagatacctgaagttacaaaatataaaaacaatcctctctccttggggaagttacagtttaatgtggaataagtaaactccacatttaatgtagaataagtatggtagaaacccaattgacaaaagttaaaacagtttatgcggtgagaattcaactacctagagacttgtggactttctagaatcattgtcttctgtgcctgatctttggttattactgggatacccgtcatttatctctgcccttcttttacaaacctttcaatccgtaaactgggaccagttgttctatttagagattacccatgaggcaccatccaaattgaatactactaagcagcaattacatgatttatagcagagattatttggctatttgcagcacaaggcaaaggagaaggaatataatctccattcacatatacctgtgtgcatatacatggtatatgtgcatcataataaacatcacagttcttctttggaattgtgaaatatcctctgaacttaatagaaatttagtaagcattgggccgggcgtcgtggctcacacctgtaatcccagcactttgggaggccgaggcaggcggatcacctgaggttaggagttcatgactagcctggcaaacatagtgaaaccccatctctactaaaaatacaaaaaattagccgggtgtggtggcaggtgcctataataccagctactcgggaggctgaggcaggagaattgcttgaacccaggagatggaggttgcagtgggctgagattgtgccattgcactccagcctgggtgacagagcgagactccgtctcaaaaaaaaaaaaaaaaagaaaaagaaaaaagaaatgtagtaagtatcgagaggtaagtagtgagtaagagagagataaagagggagagcgaaatgctaatttttttcaaaggaaatataaccaagtcaacatgaaaatcattctgttactatttaattcctatatgtctatcaacccaactagacctataatctctaaggcagtgactgcttcctttcagattcaaattcagcaaacaactgtgttaaatgttattcctgaccttcctcactatgccagaccaaatgctcctccctgtactccaaataacattgcttgatatctctattaattgcactaacagcactgtaaatacatggaaaccctctatgctgcaattctctatttccgtttttgctctctattctgctaaaatgtaagctcctcatactaataacttttctttattcagtgcctggtatgtagaactgagtaatatttatgacattcatcgtgaaagactggccagacacaagaatgacaagaaaagacctgagacatagtgatagatgaaactcgagaatgtattattatttgaacaaacttgattctaatatttaccaaaatgatacagttgaaaagagtcaaaatgtaatccttctatagcatgtggcttagtttaatatccatgttccattatttcttttgtatcctcttgagtatttaataaattttattaatatctgatttaaattttaaagtagataaattaggctttaataaaaacaaatggaaacttttagtaagtggttggacttgttctgaataaaggaatatagaatggaccttatttgaaaagttgaagtttttaaatagtaagaatataggttgaaattttttttttttttttgagatggagtcttgctctgtcacccaggctggagtgcagtggcgtcatcttggctcattgcaacctccgcctcctgggttctagtgattctcctgtctcagcttcctgagtagctaggattacaggtgcgtgccaccacacccagctaatttttgttgttttagtagagatggggtttcaccatgttggccaggatggtcttgatctcttcaccttgtgatccgcccgtcttggctcccaaagtgctgggattacaggcatgagccaccgcgcctggcctataagtagaaatttttgaaaggaataactggtgtggcaagtagagctggcaacattgtgtatattacaaggatggccttcaaaaggcagaggactgttggatacctcactattttaaagagaaattttatttaaaaaagaaatcttatgcatgatctcatttcagtgttgatttactagaagcatatgatggacctacgaacaggacccttcaaatcaaaatgtatcgtttaggaatattctgaaggggaaagtctgtgactgcattctctgagaaccatctgctcacctacttatgtcccttaaaactgaagctttaggatatcctttgaaacctttttgtttcttatcatataatgtatggtaccataaataccattgcatttgatttttgtgtgaaacaacactaaatcactattaaaaaggaaagaatgaggttatcttgctgacaatttaaagaaaagacttcttcataatatatttacgacatctaaaatgccttttgtcctcagggtagcactgtagttcttcggtgcttgagttgatactgcaatttaatactgtacctacaaagaaaattacagtttttaaactgtttattccaagtgctttcaaaatgaagacactactaaagtggtgaaagcatgtggttggaaaaaaaaaagtagtaggagattattaatttcttaaaggtaaagattattgcaaattcaaaagatcccactcattatcaatatgtggtccttctacagttttgcatagtataacatattcttaaaatgggatacatagtgactttgtagcatcaactatttaaattttctagctcctgagtccttttcttgctgtgaaatgtgttcattttattgtgtgatgatattaacatatatcaagaatataagtgaaatattaaatcttgtcatgttcagggttttagggttcttaaaaatgtgtaaaggtgtttttacactgtgtaaaaaaaaactttatatgtttgtgagattttgagttacctaattttataaactaaattactttgtgaaaaaaaaaatgcttagaatcatatgttccatgtagctcaatattgttttctggaattgaattaaattatatctacagttgcttaacagaaagagcacttaatttgtaatccacagacctcgtggtcttaggcaagccatgtaatttacttgtctttcaatttcctcatctgtaaaatggggataataactcaaaggattggtctaaggatcaatgcttatgaataaaaagcacctagtacatgacacatggtgggtgctatatcccagctattattattatccaaatggcttattactgaagtaatgaaagaaagcttttatacagtcatatcaatggtagttctgggttatagtctcagagacatcattactatgaggatatagagaatttaggaaaattttaaaaattatttaaacaaaatttgaaaaacattgtaggcatgtattaccacatacaattatatctgcctacctatgtatttaatcactatcttttagaaaacacacaacaaaagttcagtttgccgtagttcattatagagttaataggagcttggagatttgatctaataacatgcacttcatagtagagcaaacccatgatgttatcagaaattttggagaagtccaggattggggtgtacaggtgtacccaccctgagaaccagtggatctatataagtctggtgtattggtttcagtacaatgatatttatatacaactttgtatcaaataagtttgctaagccctattataagttaaaactatttttaaaccatatttccccaccctggtttggaaattgataaaacagtttaaagctgaaaaacataaactacagtaactcaataaacaatttaaaaataagttgtgtaggtagctggaaaaaattataaatctcaaaagtatagatttaagataaagcccagttatctagaattataaggttatagtacatttttggttgagcacatttagctttttctattcctccattttgcctagctgccatttcttaactatgaaaggaattgaagagtccatcagagcttttgttcgcactaaagaatagtcatttgaagaaaatggtgccaggccagacatgtaaagatatttaaagaaaagaaggaaggtgataggcctaaattcaggactattagcatattcacaatggtacaggtataggctaagcttggtcacaggtgaaaggcagtagtgtgagaactcatggaattaacaaagctacttcacacaaagggacggatggtacttcctccatgtccattcctttctaagatttcagtggcaaacagcgtatgtaaggctgcagtgacaatttgtttcagtggccctaaaaaatacctatatgtaccatagatttaatgtgtaaaattaaaagcaatgtatattaaatattttctaggaatctgtgattttgtgaccaaagatctgaatatacttaaaaacaaatcctaatttttttctaaagaaacatgataaatatctggatagctggctacattttgaaatattcacccaatatttctgcaatagtcagcatttcaataataattttatttgctttttcatggctttgaattgggtattattttgtttctttgttttgttctaagtctatatattttttttcttgccaccatttgctgtgattacagatataggtttagagtttagcctttgcaatatcatcagttgatggcatgtctacagcaatatggtggataatattttttattttcatagtatgagtgctacttgactctgactgaatgattttctgttacaagattttctttagtttatagacctactttaccttggcttctgaatatgctgaaatccttctgcccttggttataacaccttttatttgttaacatttaaaatgctttcaaatctttaacaataataaaggcattagttattttaattaatttgtatggatggaataaaaccaaagggaaggtgtcattttctggttgcaataaaaagatataaaagttaattgcttttcttttcttcctttttttttttttttttgagaggcgtctcgctctgtcgcccaggctggagtgcagtggcacgatctcggctcactgcaagctccaccttctgggttcaccccattctcctgcctcagcctcccgagtagccgggactacaggcgcccgccaccacgccggctaattttttgtatttttagtagagacggggtttcatcatgttagccaggatggtctcgatctcctgacctcgtgatccgcccgcctcggcctcccaaggtgctgggattacaggcgtgagccaccgcgcccggcaattgcttttcttttctaagaaaattttgctgacatccttggtacatattgctattcttaaatgtttgagtttactaatcctcaacagtaaatatctttaaaaatgtataaccttgcttaatattagttacctaagaatgccacaagaaactggcatctttatagttactttatattacagagtgtaataaattctagaaagatgggactaattatggtaacagacattttatactcaataaaaactttccttaatttcacccttatgcagggagtctcagtagagtacctctcttttgtgtcttggttggtatggcatggcactaagtgacattagattagcaactggggaacaactttgtgaaactgtttatggaagtgaattttcagagttcacggttgtgggtttttttcctatctcagatcacctagcaactttagattcaggcggaagttggagtttattttacaaaacatgaaaaagcttttaaaccaacatttttgaggtaaatctgtagcaaaagtgaggccacctgctgttaagaaaagtgcctacacattcatcacatttctgtccccagtagagggtactgctgagtaaaacactgccattgttgttcagatcctataggtggcagcagttcctacagtttcagagcataacaatggctcgatttgtgggtctaagaataaagctgtcacgaactcatggaatctttatactgtaagggctcttctttgaaatgtgatacatgagaaaattaccattaatgtttagtttcccttttaagatttaagtagcttatctttcttttaagttccattttgtatttgaaagtgtgtccccaaacaagtattgacagccgtaattttatggtgttaaattatgaagtataaatttttaggtaatctcagggaaagatatgatgtaaacttttttttcttttcctctcccaccctagccttccaccccaattacaagaatcatccattgttaatgttgactgctgctgcaatcttgagaaggaagtcctagttgctatacaagcataattttctccatgttcaggagctgagtgcttaatggttttaacattgccattcaacttttaggaggctttgaaccaaattgtagcacctatcaaagagtgattttataactctctttaagaaaaaagatttgaaacatactgtagtttctgttaggcgacacagaactgaggatgtaagtactgtactcttagagcaactcaccttttgccactcccaagcagcagagtgcttgttacttcagtgggtcacttgcacacacatacacacaccctccacacatccagaataaactccatattaggtataacaattgtaattcattcagttttaacggtcaagtgaacattaaaaaaattttccctgctaattattgtgtttagttcagagagttgcaaaatgctaaataaaactagttttttggttcaagtcaaaatagagttaagcctatctctagaaatgcctattcagaaattcagcaacccttgtcttattgctcaaattaattatccagaaactgtattatgatcgtttactcaaattaatatgaaaatctgagaattctatctttgttttaaattcaggaaagactagattctttttatttatcatttgagataacaaagtaaactaatggcaatgtatgagtatcttaacgtattttgaagggaataggttaaactgttactcttttggagctgatctctttgtatcaattaggtacatttgtaaactctatatttttgaaccatatttttggaactaatctaaagctgtgaaatgaatacattatttcaaattaaaacatacatatttatatgtattatacatatcatacatagagatgcatatatatatttattgaagataaaggaaatgtaggttttagggttgtagaacatttggatcatataaataggagatacatgcctatactttctatcatccatattatgtgtgtgtgtgtgtgtatgtatatatgaatacatttattcaatagtatgttcagaatgatgtttttcatgaagaattattagtgtcacatatgattccatttcccatttggtggatgtgaaaggaaacagaattatataagcaaaaaagtttgctgggaacctcacatgctcttagtaattattttgtgcattgtcagctactgaaaaaattatttgtttttaaaggaactactaggagcaaagtataaatcaacttatttttgaacacttgtaatattatatgttcatataaaatctatttttgatggcataatgacagtttaattatgtgcatttttttgtccttgctgttgtttttagcatatttataatagctagctgaataggaaaaaatcatcacttaaggcaaggctcttcaggtcatctgtgaacattctgtctatcctttctttaaaaatattttgaacaccaagatatgacaagataaattccatttttatttttgcaattctctttcagaagcttatgttaaaattaatttcagtttatattattttcttatgtaacttatgaacatgtaaggatgatcactttgttctaatttgtaaatttttacaaagtattttagtaaaatgatatatgtccttcagtgaattcatattgctattcaacaaaacattccctaatgataaagttgatatttatgttttgtaagtaaaatcatttcgatgaatgacaaagcttttgatgaatcagatactatcaaagcttggagttgttttcagaaattgaatgtatgctggtttaaaaaataagctaaaatatatttttaggtatcatacatatggggaaaaaatgagatatatagttaagtttgaacagcttagactcatttaaacccgggttttagaaatttcaattccttgtaattaaaaattctgttgatctatttaaaaatgaatatgtatttaactttcccatatttaacaatagtaaactttaatattagtaaaatattacctaaaagatgttcacagaaactgttgacatgtttgaaaggatagaatataattaactcatgcattttgaggggaattttagggcttagagaattgcataatagactgatagggaaagactttcaggagagggagcacagtgactgatatgcctgaatttgagaaagcagcagatacaataaatgtctgattctatgtaacaagtagtaaatggaatttttcactaattgaatttttctgtttaacctagtgtccatgtgtacgtattgtacatatgactagttttgtaagcattagaatataataaacttaatcttaaacatacacccaaaacaattacttccaaaaattcttcaggaggtctattggaatctttagtgtgaatgattatcattgtgagcatctattgctattttagagtcttgcttatggggaaaaataatttgataatgattgagctttctgattacctgggtactacataaataagagtgttaacactaatttctgtacatttaggtaaatatatttacttataaacatttaacgaaaatattattattaaacatagttctattttgagtaaataatttaaaatgctgggaccgttttctctgagtggccttcttcagacttctggaccctagaaatggccttatacttcaccctaggagggccctttttttcacaggcctgaaactctgtagaatccatgttggatattattaatgaacatgtttctttttgtagaggggagaatgatgattagaaaggtaaattagtatcataaacactccagatatttcagcatatgcgtgaaattattctctctcttcatggaatccattgtcttcatgtgcatctagtttcgtgacctacaaaagaggacttctgagccatgggcatgtacaatcaggttctgcttaaagtcaacatttcttataaaggcaccatctgtattacaaagaatcatgatgccaatgctgtggctttgagtgctgtccaatggaatcaacaagtacatatagcatgcatgttgtgggcaagacatgtgcttagcactatataaaaatacactaaaggctcctacaactgacattttcccattcaggcctgactcttcagccctctctactctcttacctgaatagatatgtcaccctcagtcagtgtggggagaataaagctgaatgtgaaatttagctgccttaacatttaaagtcaacttttcatttaactcatttttttcttctgtgctttcagaaaaacaatgatgagatcaaaattagttactcatgaattcaaccacagttattaaactttactatttttgaggtatagggatccaacagtacctgttctgaagttcattttagtctaatggactttattagccttaaagatgttatctagttaatgcaatatattacacataggcagtgtaattgctctcctctgtttagagagtgtatatgagtagtcataaattcttgatggcataacccaaactggtatcctaaatccttgacttctaattttagaccattgtacttctaaagtttgcttgtaatttgagtattaagaaattaaaggacaagaacatatgaaggccatcatgtagctcaaggtctaagggaaaataatgctgtttcagttctcaatataaaacaaaaataattatatgagtaattattcattttgaaaactgatcttcaagtaaaactgggcttaatcaaaaaaggagtaagccctgaagaccttttgcattgtaaaattctagcaaagttgtgattcccgttgattttaaagagtgataggagtggagcttctgaatatcccctgagattttagaagtatatgatactggcagttgtcacaaaaatatatttctagagaagtctgaataattgactctttaaaaattatgttttcttgcaaaatctctaaggaactgaagaagtttctaagaatcacaggcatgctcttaaagcattaccatgagcctttactctgaaatacctcatagtggtacctcataccttctttgcagaaatgagtgcctaagtcctaatggggagaaatgtactccaaaatgatctgaagccattggcagggagacagaagagatactattagcagagcagaaacaaaaataggtggatagagccaatgggttttttttttttggtagaaactgacaaacgattttaacgtttatatgaaaatgtaaagaaccaataatagtcaaaatcatctggaagaaaaggaagaaagttggaagatttacactaccagatatcaaggcttgttataaagctacagtaattaagatagcgtggtattggtgtaaggattgatgaaagtcaaataaaatgataaggagtccaaaaatatacccacatatatgtggaaacttgattttataacataggtagcactgcaaaacaatgaagatggatggtatttttaataaaatattctgattcaactggataacctcatgaaaaaaaatcatggtcctctacctcataccatatacaaatatcaatttcagatttctatttagactataagtctaaatatagagggtaaagcagtaaagcttctaacattaatgcataagaatatcttcatgaccctgagttaggtaaggatatcttaaataggacaaaaaaaaaaaaaccatacagaaaagattgataaattggtctatgttataattaggaatttctgttattgaaggacactatttagaaagtagaaatgtaagttacagagtaggaggcggtatttgaaatgcatataactaaggacttattttcagaatatataacaaattcttacaaatcaacaggaaaaaaaagaacctaatttcacaaatgtgaaaaacatgaacaggcacttcacgaacagtatatccaaatggccgataaacagaaaaagatactaaaccgaaatagtcaccaggtaaatacaaattgaaaccaaaataagataccaacatatttccaacagaatggtgaaaactaagactggcaaaaccaagtattgataataacgttgagcaattgaaactcatatacactactaatggaaaaaccattttggaaaactgcttgacagtgtctgttaaagctgaaagtatatgcatcctgtttcctggcaatttcgttctctggtatagtagaccctacaaaaatgtgtgcaccaaaagacgtatgcaagaatgttcatagtattttttaatagctgaacactggaaataactcaaatgcccatcaacattagaaaagacaaataaattgtggtttattcatataatggaatatttttaaagcaaagaaaatgaatcaactatttccacacacaatatgctgtacaaatctcacaaacataatgttgagcaaaagatgacagactcaaaataatacatacagtcatgcatcacttaacaatggcgatacgttctgagaaatgtgtccttaggcaattttgttgtgcgaacatcatagagtgtacttacacaaacctagatggtatagcctgctgcacacataggctatgtggtatagcctgccgctctgaggctacaaacctctccagcatgttactgtactggatactgtgggcaactgtaacacaatggtaagtatttatgtatctaaacataggaagggtacaataaaaaactgatattataatctgaagggaccaacatatatgtggtccttctcttaccaaaacatccttatgcaacagatgactatactatatgattccatttgtataaagtccaaaggatggcaaaaccaatctgtggtgttagaaatcaggataatgcttacctctggggaagagagaaagggaacaagggaagcttcaggagtgctactaatattccatttcttaaactgggtgatgattatgtgggtgtgttcactttttttatttttattttttgagatggagtctcactctgtcgcccaggcttgagtgcagtggtgcggtctcagcccactgcaacctctgtcccctgggttcaagcaattctcatgcctcagcctcctgagtagctgggattacaggcccgtgccaccacgcctggctaatctttgtatttttttagtagagacggagtttcaccatgttggccaggctggccttgaactcctggcctcaagtgatccacccaccttggcctcccaaagtgctgggattacaggtgtgagccaccgtctctgacctgggtgtgttcactctgtgataattctttcagccatgatcttatttttttacttttctgtatgtacattgtacttcagtaaacaagtttaataaaaaagagaggtaacagaagttgtgttttgtttgttgtttgtttgtttgttttttagcttttccaatacagagcagaggaaaagcagtctggaatgtggataagaagctctggaagctttttctgatttgaaagaggtggttcacgagataaatatttttaacttaggcacaaactcatagtgtgtactgatgttggtcatagaatgcctcaatgttgcaaggttcttcgggctgtggttctttacctacacaggatagtgtttatgaacctgaatgttgttaaaggaactttagtcagagagctgaaagccattgagcatatatgttgctcagcacagataccgcttcttccagaaagccttcccaggcccatcagtttgggccaaatgctttccttctatgttcccacaaatccttggtgtaccccccaagaaaccgtaagcttcctgagtgaagttgtctgtgttgtctgtcctgagagacattgtctgtgttgtttataatttagattccagtgcctaacattgtgcccagtactgaataaaataagtacatgaatgaatgtttgtaagtcagtcgttcataacatgaaatatgcttaactatgtgtttcactattttatagatagatttgatcattttggaacatgtaattcttatcagcactgaatattaggatgaggaatttgggacccttttgtaggcactagccttttgttactgtagttaaattttacgataaactaaaacttgaggataagtggtcaaaataaaaaaaagtttatgttaaagtagaaacttaaaaaggcctggtattcactgttagaacaaactacttttctcagagtaacattgtgctcatctttaagttactttataaaaatgtgaaatcagcttttttttttctgataacatagagcttagtgatattttgaagttgctcttaaatcatctacagcttaaaaagaactttctagcaaagtcattataggtaatgatttctcaaatgttttgagtttttagtatttgtttattatataaagttgaaatatgtactatcatgataattataatcaaatagagaggtcagacttgaattttatatttctaccactgacatgctttctgtcaaattaacaggttttttttaaataaagttttgacattggattcataaggactgatgtctgtatcatactacaaatataaactgtttaatttaatgacaatgcctaaaccaggtaaccggagtgaagacaaatgaaattcttccttttgtactggtcattgtgtgaaggcaatcatagacacaacctgtgtcctgggatgagatatgtgaaatggatgcaagtcctcaaatgttatcattttatgcattcaaatggatagtcagaagacccataaggcccctaatttagaaattcccacagttctcaataaagtggctttccactagtttgagttgtcaccttttccaaagacttgacaccacatcttcctcaatgaagtaattctgcttcaagcaggtagattttcatattcatggcctacaggccagatttcaaatgctctttagtattttctttatgtcatagcacacttggcttttgggtagtttctgcctcattttcatactagctttgtaaagatttctgtagtatgtaagagaactctaaaattgaggcttatgtaattaaatgagatatagtttagacttatgaaagaacggcatgaagtatgtgtctcataccaatatcaatgacattaaagtctccatatgtatcaagttatctatctttagggatatgaaatgtgtaagtttgccagtatataattcagtaatatttgagtgtgttggccgggcgcggtggctcacacctgtaatcccagccttttgggaggccaaggcgggtggatcacctgaggtcaggagttcgagacaccagcctgaccaacatggtgaaaccccatctctactaaaaatacaaaaaaaattagctgagtgtggtggcgcatgcctgtaatcccagctatttgggaggctgaggcaggagaatcgcttgaacccaggaggcagaggttgtggtaagccaagattgtgccattgcactccagcctgagtaacaagagcaaaactctgtcttttaaaaaaaatttgagtatgttattaataacttatttgtatacagaaattagccaggcatggtggtgtgcacctgtgatcccagctacacaggaggctgaggtgggaggatcacttgagcccaggaagtgaaggttgcagtgagccatgattgctccactgcactccagcctgggtgacaagcgagatcctctctcaaatcaaacaaaaaaaaaactcaccccaaaaaacccaaacttatttgtaaagtgatgttcagttgcattgttatgaaatatggagtcatactttttttaagcacaaggatacttattaaaaattagaaaagccttagggtatttgtgtgtgtgtgtgtgtgtgtgtgtgtgtgtgtgttttaagaaatggagtccctttccattgcccagactggagtacagtggcacagtcatagctcactgcagccttgaactcgtgggctcaagggatcctcctgtccccccgtcctgaggagctgggactgcaggtatataccactatgcctggctaagttttaaacattgttttagaaatggagtctagccatgttgtccaggctggtttcaaacttctggtctcaggcaatcctcctcctgcctcagcctcccaaagttctgggattacaggcatgacccaccaacgctggacttttaatttttgacgtttttaaaattcttcctctagtctaatggttttcatatttatttgttcatggaatactattttttttttttttttttttgagatggagtcttgctctgtcgcccaggctggagtgcaatggcgcaatcttggctcactgcaatctctgcctcccaggttcaagcaattctcctgcctaagcctcttgagtatttgggattacaggcacccgccagcatgcccagctaatttttgtatttttagtaaagacggggtttcaccatgttggtcaggctggtctcgaactcctgaactcagatgatccacctgccttggcctcccaaagtgccgggattacatgtgtgagccactgcgcctggccggaatactttttatattctgatgtcgtggaagaactccaaaatgaagtaatgaggtataatagtatattgcaatacttggattacaattgacaggaaaataaaaccttgcaaactaattgccgtgagaagtagcaattgtgattcttatgctttgaaaactttaacagaatggaaaaaataatggtaacatattagaaaaattggattattgtaaaaagaacaagaaaaacctaatttaaaatgaaattaaaaaaacactttcaatgagaacagtgtttttatgtcttatccatacccatctaatataaggagaactacttattgggttccatgttcactatttgggtgaaaggttcacttgaagcccaaacctcagtattatgcaatatacccatgtaataaacctgcacatgtacttgctgaatctaatgtatatattagattaatacacacacacgcacactcacacacacacacaaatatatgggcaatgtttcactgttggatctgcataccagatgcaacatccagttatagtattatatatatttttaatgcagacagatgcaaaaatccttttccacacagatatgttagaaataaaaggaaaaatatatagacttttacaatagttaggtactcttgaatcagaccattccaaagtgtttaattatataattttcaataatagctcatttgtcatctttctttttcttgtctttttctttctttctttctttctttttgagatggagttttgctctcgttgcccagactggagtgcaatggcgcgatcttggctcaccacaacctccgcctcccgggttcaagtgattctcctgcctcagcctcctgagtagctgggattacaggcatgcgccaccacactcggctaattttgtatttttagtagagatggggtttcaccatgttggtcaggctggtctcgaactcccgacctcaggtgatccacctgcctcggcctcccaaagtgctgggattacaggcatgagccactgcacccagccttatcgtttttctagaaactaaaatctccacatatttatcttcattttgaagtattctggatttcaagtactcatgtacttgaaagttatatgtattataacttatgttgtgagagcagtattttactagatgaacagtatgtatttctctccattccagcctaataattcaataagatctaaattcagctttactattttctttataaagtgcttaaaattgaacaaacaggaggagaaaaaggaagagaagaaaacagcaatgaagtcatttaggaatgataagcaaatgtggccaggtgaggtggctcacacctgtaattacaacactttgggagtccgaggtgggtgaatcagttgagctcaagaatttgacaccagcttgggcaaaatgatgaaaccttgtctctacaaaaaatacaaaaaaaattagctgggcatggtggcatgcctgtagtctcagctacttgggaggcggaggtgggaggatggctcaagcccaggagacagaggttgcagtgagctgagagcacgccactgcactccagcctgagcagtagagccagaccttgtctcaaaaaaaaaaaaaaaaaaaaggtaaatgcagagtattccagagattgtgacaaactcttagctatttctatgtttttgagatttccagcaaggttgtgccaatggctggaggggatagaagaggtggtccattctagggcaatgaagtgagttagataatttttcaaaaaaaataataaaattgaaagttgttctgcttttaattatcatatgtgcctaaaatttttttaaatgccagtggtaaaatacctctccctatccttattcatgtagaccactcctaccatgccgtaccttttggtacaccattggcttccaggatatttaaaaactgaagaaaataccgaaaacagggttacaaaaattttggaatattttaaatgtgttaatttaataaagtaactctttgtacaaaggcaatttaattgagctattcataggatagttgtataatatagaaatatgtaacttacactgcactatgataaatgcctgactttcggccctgtcaggttatcacttgtgactatacatctgacctttttttgattttctttatggctatgagggcagaccatacacttttcttgttgctgttcttttacctattgcacccccttaaccagaatgggccctttttaattggtaactaattgccttaaaggtatgttgagaatatagcattctttgaaggtatcaacaaatttataagaaaagtttgtagagcatgaaattcaggaaatgttttctttctttcttttttaatcaattaagtaattagatttagttctactaatattactgatttaccttaaatcgtgaatccagctgatgaactttttgaaatgtgaagcactggttaggaatttgagaactgcagatgtgagactcatctagatcttagttatgattttattgttcacttcatttgaaggacagagaaaaaaaggcaggggttgaacataaatctcagagactgtatgaggattaatgaaattatgtcccttataaaacatttgagttttttttttggtagaatgccagtatgtgagaataaaggaggatattcaccagtgtcttctaacatttaaaatgttaggagaagcagatcatatttgaaaatgaaatttagtctgtggttaatagtttatttcctcttaaaattgttatcaacttccataaatgtaaattatatatttttattttcatattttttgatagtcaatacttgtttccaacatggacaatattaaactgtaaagtttctgaagtactccaggtttctcaaatactcttatttccaggtaagaataaaaaatgtaaaaaatattttaaaagttaaaaaaataatattgcaagtaagcaatgtaggtaaggtgttttgcatctgagagtgcgtttgcccaacttaactaatagggcaaaagcactattgtgatgacatctttgacgaatctttcttggacccaatatcaccgatgatgttggtttgtgggttgggccttcttcactgcttggtttatctttggtgtcaatcagtggtaatgatacaatccatgacaaaatattttttgttgaatatttatcatcactcaaaataggacacagttctttctaaagataaaggctttctcctaaggcatttgttcctactttaaggatttactgtagcagaatatgcttcttggattttatttattagagctaagttatctgatctttgggggacatattgtatcttttttttttttttctttttttgagacacagtcttgccctgtcgcccaggctagagtgcaatggcatgatcttagctcactgcaacctccacctcctgggttcaagcgattctcctgcctcagcctcctgagtagctgggattacaggcatgtaccaccatgcccagctaatttttgtaatttttttagcagagacggggtttcaccatgctggccaggctggtctcgagctcctgacctcgtgatccacccacctcaggcttccaaagtgctgggattacaggcatgagccactgcacctggccttaatattttgctctattaagcactggtcaacaggaaaaaaacatgaatttactttgaatcctaaaaaagttatgactttagaactaaagtcacctgtgccaggtacctgaggcctcagaaacaaatatctgcctatatactgtatatttgaaaacaaagtagcaaaactttttgtttttaagttttagttctggacttctactcctgcagcccgttagaaatcattctgtctttctctgtctctctcaagtctaaacaaccccagaggatgtactgttgtttttatttgttttataaagtgctaatcaaactattgatggtttaaaaaattatttgataataatgattttgctttttgtttttattcttcttcatgagatgtgtttttcccagggcaagttgataaagacatttttgaccacctgatttttgcctgttgccattgacttttcctttttgaagtgtgactaaactttgagagctccttctttggtaatttatagaagaaaaagccttggaaaaaatatttgtacttgattttaaggggtaacaaaatttctttgttgtttgttttttggaattgtgttaaagaaaattacgaaattgtaatgactaagtgcatatttttgaagggttttactttgtttatttccttcatcaaaaaaataagcaaaccagtaactgttaaccctaatttatttttactcttcaagtgacattacttttaactggctacatttggataataaaagccatggattttaaaccacttagtaatttggtttcatttttaacacaaataacaccttttcatccattttatataaacttcaaacaacatatgttttaacttactgccaaataagaagaaatgtgttacattaaagtgcatgttgtttgcctgtgcatttggaaataccattcattttatagcaattttgagttatttttctgtcactttgtattcctattcaaagagacatacagaaaccctcgctcaaaacaactcccttagggtttactcttggatgtcagtagacatgaacgggaggtactgtatacaacaagcttaggtgatggaaatgtcaactcttgttgacttgcatttattattatcctttgaattgtgtcctcttgagattttgtgagtggtattttaatatatttcttttatgtttgaggtgggcaaaagagagagaccacctcactttttttcccccctcttccctctgtttacgtacaaaaatgagatactctcattctctagaatttgatccaaattttaaaactgttgctaagggataatggtcatgcagaatgtgaaatgttaataacataaaacactaggacataaaaatggaaacattttcagtgctaacatgcaattcaaagtgttggattgtttttaaattaatgagaaagtatttttaaagccctttttctttaggatcttaaattgtaccaagagaacatggattcttttaaagaacacaggttagagttagttaaaacctaccaattagtataggaaagagagactccattatgacagataaggtttagatagaattattattagtaaattagaaaatttaaaaacatccccaggaagctttctctgacctctcacctcctgcccttgttgggttaggtgcctgccactctgtgaagctcaagtaatcagagcactgtgcttagcacatcctcactagtctgtgagctctttcaaggcaggtactgtatcttatttggcttagttttttcatccatctcacacagtagttgctcaggaagtatctgttgaatgaacgtgagatgtagagtgatgatggatagaccctaattatgtccacatccatgtaataaaataagcagtatatttaggtttgagaataatctcactacttttttaaagaaataaatgcctctgcaatctttctaaaaataattgatttttatttttagccaggttcttgctctgtcacccaggctagaatggtagtagtgtgatcataggtcactgcagccttgaactcctaagcttaagcaatcctcctgcctacgcctcctgagtagcctggactacaggtgcatgccacctgcccagctaattttttaaatttttttggtagcggtcaggatcttgctatggtgcccaggctggtcttgaactcctggcctcaagcaatcctcctgccttggtctaccaaagtgctggaattaaagatgtgagccaccgtgcacagccaagaattgatatttattttgaggactgactagaagttttaaaattaaaaagaaaattcattgcagttttgtaatatgtgaaaaaaatcatgaaaatatattgttaaaaatgtcatcacaattctggtaatctaactttgggtttctaaaagcttttgtagtgttaatgttaatactgccctttattgtaggccaaggatgtcaattggaagcaattcttactactggttgttggcaagttgcatgagcaaggcagatttggacccagcctgaaatctctagtcagctccattctttagcagctgtcacagtgtagttccagcagtggtgtgtacctttcttgttccacattatgagcccacaaagaaagccaccagtgaacaggaccagctaaaagttttattctccttctattgggttgcttttgagtagatccaatttcatttttattagtgattcagtttcttccacgtataatcacatgtctttggcagaatctcttactttcttatgaatacctagtaactcaaagtaaagaacagtgaataatccttaaatacagagtatttagtttttttccctcctgcattcagagtaaggccatggttgcactaggccatacccaagttaataatttgtaaaatgccaaagcatttgaagcttttcagatttctattgtaaaagtcctcagtacaattttacactgtcctttatattgaccaatctaaagatttgactattaatttaaccagcattattgtacttttcctctggaataaatcagggctttttaaatgaattgatcccttactgtcttataacaataaagcatattcagcgtcatatttttccgatactattgcacaatattgtcaatacttgaatagaagaacagctgttgtctagggagtgaaggttaaaggtaaacactccctactgattcaaagaaacacgggcaccctatttattatgtatttgtaagtagagctctgcagagtattgccacatttaatgtatatttcatagagtaacaaaagcattttccacttttgactaatacagtttttagagcccatccttgtaggtgacttgtacgtatgccttacaggcacacaataaatattagctgatgatgagagatgaatatccttgcttttcacttctgaacatgagataaccaagccttttaggtagagttaattaatatctggtggtcttctacgttcctaagggaatatgactttgaattctctctcttcatcatagataaatgtgtagtcacaaatgtggtgttccagttttgggcttgggaaatgaagtttaaatgaataatggtaatccatggtaatagaaatgcttagttctactgggtatttaagtctaatatgtaggcatctggggactctgatacactgatttacttgtaggtaaaaacgtttagagctgctggcagtgttttttgttgggatcatttgttgcatttttagtgtaacagtggacttagaagttaaatgtcaacctttggccgaaataatctgctagtcaaagaccttggacatttaggggtttttaaattggaagtggaagggtatcctcatttattattcatagctacagtatgttagttattattcttttgttaaaaatgtgacaaaattaaaggcaaatgtagttttaaaggctccagagtaaattagaaaactgatttcgtacatctgcaaaaattttattagctgattattttacctcaattaatattgggaatgttgacagataactacacatcgctgtttcacaagaaatattttgtgtatgtttattctttatgatcagaaaaataaatagtgtagattggacagtgttcatttttcataaatggaaaagaacattgttcttttactagccagagttggaagaaagtacttgggataagaaataaaaatgaatgtgtacatttcagtatgtgtagtggaatggattcaggaaattcattctttcatattaatttttctaaacattttttatgtagggataacagataagagagagtaaaaaaaatcccatttagtaaaaaaacaaacatatttgtatagatgtagtaaagatacacctgaaagttacataccaaattattaactgttcttttgggggaataaacctctaaccagggaccttttctttttaagaatttttatacctccatattatttgattttattttgaggagcatgtattatacctgtaatttaaaaaaattaagcaggcaaagagagagagagagagagagagagagagagagagggatagtatatgaagggctataggcagccccagaagagcaagaaaggcaaagaccaagcaggcatcagagctggatcctgacatagcaagcaattcagacacctgccgggcatcggggcagggtgaagtcttcttaccagaagagaaatctggagcagggaagttgggggacctgtgtggggtagggagtaggtttgtaaattggaatgttgtggtagagtaagactggaaaggttaggtcattcattatggagatagtctgaaataaagacatcagggatcatggagtgtagttaggatataagcattttgtacaagagtttgatgcttgtttcctttatatttttaccctgtggagcccttgggagttcaagtatgtgtctattgagagagatccatcatagcacctttatttatttattattactatttattagaaaatgagcaatgcttaacctctctagatagctttaatacagtgacatgacttcatgttgtggagttggacaggttatatgaacatgcagaaatgtagctattcagtttctcagttttggtgatgacccatgtcaaataatttttaaattgtctaatatgagattaggctcttacactgagaaattaaagtaaaacaagctatttattaacagagtaggtggactaatcctttgctagagtaaatatgaggagctacatcaacacacatatacattctctacgtaaggttaagatgtatgtagctaaatatattcattagtattacttaggagatgctctttcttttgtcatgtttctttggcaaaagctagcagttctgttagcagtggttttgatgataaaatcctgtaattcaagaggttggcttattcaactaaacaactgctaccttgggcaatactggaccaactgcgaggggactgttttcttgagacctggaaagctgttctgtttgctaaacaaaggaattgttgatttcagtgatttaattccccttttggctaaaggctgctgaatgaaaacagtgcttgtttgggaaggaatctgttgctaaggcaactgatatctccttaattattggccaatattcccaaatgagattggtctcttttgactgttggaaataaccaaattatcctgagcactttcaagtcttgaattttgtggtaatggcgggggttgggggagggatttctctcaagtatataaacagatatctcccatttgggttggcatagtgtgagcactgtgtttatgagggtaaaaatatagatgatatttgcaaaacctcttttattgtaagagatcttattacttaagacgagttgcaattctgagatgagtgacctatgtttaatctttttttaaaaaatgaattatttgatttctgtaagaaaatagaatacatctaatcatttatcctcaagaataggcagatatatggagaaacttgtaagtattatttgaatgatgctaacaaggactgtcttcagaagcgtctgcagccatttatgtgaggttctttacttgaatgtttctagcactgcatatgctgaccttggagagtgacctcttttctgtctattactttgtaggatcatgtaaaagacctgtggtttcttgtctcttggcagtacagttgtttgatcatttaaaattaattgaagctttgaatatagtcaggctcaagttctagtgtattcatatcatactttgtaattgctctctagtgtgaaggacatactaaaacatcagtacagttcttacaaaatgggaatttgtctttataattttattgtatgtcttttaaattcttatagtgaatcatagagatcacacattattatcttatatccttacaacaaaacgggaattcactgttctttggtacttgtcctgtgacaagcctggtgagtattgatgaaattcttctaatattacttggggtatcccagatcttccagttgagtgaacatgaggttctgaagtgtgactgtttatgatttctgtgttgtagaaccatgaaaattttgtaggagtctcacatgaaaggcttttggcacaatagcactgagtaaaatctgttttgtgatacttctgaatggttatagttcttacttaggagtagtctttccatgtttcattcatagagatgacattgggtttataccttgggttgaattgaatataaaaagctttgtgtactatgtattggaagaatacttgagttggatttcatgtacatatttattatctatcctagatttatgaaatttcactcttcattttaaatagcttcaagaagtaaatacaagattcacttgatgaaaatattaaaatacatgaaaaggacaatatcctgcgaaactgttgactaaaatataagcacagaaccacagaatataagttcaaagctgtccctacatgtctctagagtatcattaatctagttctcactagggttttagagtatctaagtaggttttacactatctactgaagttcttccatatcagactataaatataagcatacagttaaatctgtgatacattttgaattagcctccctttttaggactcttttgagcttgtcttatttaaaatatgttgaagtatgaactatcagacttcaaaaacattgttctttgaaaaacatttttgtgctgtatttttaaattccttgatatttataattatttaaaagatttttgttgtagtcatctagtttataagattaattttttcctggattattgtaggaaaaaaacaagtttttaaataagataatgtaaagagaatttatatatttatgttgattagatcataaaaatttgacccaagttattatatatgttaaattctatgaatttattactttgttttgtcacatattagttgactcaattttccaacatttccagcattttgcccttttctcagatacttttttttttttttttctggagtcttgctctgttgcccaggctggagtgcagtggcacaatctcagctcactgtaacctttgcctcctggattcaaacgattctcctgcctcagcctcctgagtagctgggattataggcacgcaccatcacacccagctaatttttgtatttttagtagagatggggtttcaccatgttgaccagactggtcttgaactcctgacctcaaatgatcctcccactttggcctcccaaattgctgtgattacaggcatgagtcatcatgcccagcctcagattagttgaagatcaaagatatagagagaatattttgttagcaatttcttagctttttttttaaccttatatattttggtttttttttttcctggagacttgtacttagtactaacttcagtttgcataatatatatttatatattcaatgtgaatattttatatacatacctatgacaaatcttaatttttatatacaaatatatggcagtgttctttttctttctgcaatggtaggttttttcttcaattcaagactaattcagtattttatttacctttatttataaccacgtgtggtatctttcttttgagaaagcattgacactctattgctattaaacactttcactgggtgagatagaactgttgttgactgtacattatgtgtgtgccagagaatataaaggaacaatggagaaatgtcccatcacaattttgaaagggtctattttaaatgctacgtgtttctactagaatatagagctgtaatttggaacaggagtgaagaaagagacttgtagaatttaagttgcctatctcctatctcctaactcattgggaggctgggtcttcattgtgaagtctctcatgtatacctgttaaatgaatttgtatgccttttgtcctattaaaaaattaattaataaagggctcggacaaattgaaacactgggtctactcaggaaatatttttataggtgcagttcgaatgtttgaattaggatgtaacattagaaaacgtaaaggagctgggcatggtggctcgtgcttgtagtcccagcaggaggctgaggcaggagtttcgcttgagcccaggagttggagttgaaggttgcagtgagctataattacatcactgcattccaacctgggcaatagagtagcggggtgggttggaggcgaaacaagaataaaatgatacaacaaaaacaaaaaagcaaaacaacaaaaagagaaaatgtaaaggctatgtaaggcttgcctcaggcaaaaattatcaaataggccaggcgcagtgcctcacacatgtaatgtcagcctggccaacatggtgaaacttgtctctacaaaaaatacaaaatattagctggatatggtggcaggtacctgtaatcccaactactcaggaggctgaggcaggagaattgcttgaacccaggaggcagaggttgcggtgagccaagatcgcaccactacactccagcctggacaacagagttgaaactctgtctttaaaaaaaaaaaattaccgaataaatatacatttatctttggtgtttcccaacttagatttgaattgttgtatctctcccctaaaccctgccctgtgctcttgtgtgccctgtgactgattagtatccttgtctctgtcactccaggtctgctctctttttcttttccctttctgcacttcaagccttccttacctcccatgcccttgtacccttttaactttctttaaaaatggccagtgctttatttcagtttcactgtgtccattctctagaaattaatctgatgcactaatcaccattaaattgataatgcttgataatgtcttgccttgatctggtttgccatcttaattagaattttaacttagctttttagaggagaacatttcaagacataccaccttgattgttgaacttgggttaggtaatatttcaaggtggttcataaaggtatttattttaaaggaaaaagaacactgagagcccagcatgcatatccaccttcaagatttaataatttgagatttcaactgtcccttaaggaaagctgattttagaagagagaaggtaaaactattcaataattattatccataataaaatatattatagttcctttttcttagccaattaaaggaaaatactatgtattaataggatatgtaatttgggggtatagaaaacatttttttaactcatctaattatttttagtttttgtgatgatgactactgatttgtcctgtgctacatataattctttgtcacagttttattagcatatattatagccaagtgcttgcttggctatgaagagggcatttttattctgttccatgttatttttcttaccaaaaaatgcaacaaaaaactaaagtctattcaaaaaaagcttatttcattatttaaaaaaattctttcccatattccatatttcttttgttagtgtaataaccaatttttttttccagaaatttaacctctcccctgcttgtgtcattcaggtttggcccaaaagcaaacaatggaagtacttctgacctacctttgttagaaactttgcatatctaaatcattgcttgcaagagtgtgagggaaagtaagagtaaagaggatagaatataagagattgctctgtcctaagatattgatggtctattgggaaatcagataaccacatatgacacactctatcagcaagccagattacttttaagttctaagatatgtgaaaaagttaatagtatcagtcttcagagagaaaagagaaattacagcaggcttgagatgtcatagaagttttagactaaactttggtgataaaagggaagaggacctttgagatgaaaattttcaaatattcctatcagaattctcagcccagagatgatacatgcagcaaactgagaaaaagaggaaaaaagaatcgcttctaggcttcttcatttgtccacgtgaagtctgtccaaacccagtgtgacagagttgtagtttcaagcacgctgttcttagatcttagactgctgtgacaaaataccttagactggttggcttaaacaacagaaatctatttctcacacttctggaggctaggaaatctaagatcaaggtgcctccagattctgttcttgctgagttcgtctcctggcttgtcctagaagggctgtcttatccttatgttcttacatggcttttccttgatgaatttacttgtggagagaggtagagaaagaggaaaagagagaggggaagagcgggtggggagagagagagagagagagagagaaaacgaaacgggaagggggagagagagttgtctctttttgtaagggcccagatgctgttatgaaggccccatcttcatgacctcatctaagccttattacttcccaaaggccctatcttcaaataccatcacattagggattagggtttcaacatattaattttgagggacacaaacattcagaccataacacaacccagaactcatctgtgttatggtgagtcccacccttgccttaattccctatcttcccccagaatcctagaagataagacacactgctcaaatgacttaggacttagtttagggcactccctttagggtcatatgttgtattagttcagatttcaagtatttatagatatttttgaatttatgtttaattctttattcaaaatgagctttttgagagctcataattggcttaccttatgattccataaaagtgaatatttggctttagacaagtgtaatttgtttatttaacaaccatttaatggatgcctatgatgtgcttctttctgatttttggcctaggggtttgttcaatttcctatgcctcttacaagggcagaattgaggtggggccttttagtttttctgcgtccttgccagcctttggtgttgctgttatttttattttagccattttaatagatgtatggtgatatctcattatggctttaatttgcatttccttaatggctgatgttgtcaaagatctcttaatgtgcttattttccatctgtatatccttttttgtgaaatacctgttcagtgtcttgcccattgtgttagtctggttttttgttgctatgaaggaatatctgaagctgggtaatttgtaaagaaaagaggtttatttggctcatggttctacagcttgtacaagaagcatggcaccagcatctgcttctggtgatggcctccagctgcttccactcatggcagaaggcaaaggggagccagtgtgcacagaggtcatgtggtgaggggtgggaggagagatgccaggctctttttcacaactagctctcactgaatctaatagaccaagaactcacttattactgcaaggatgataccaagccatttgtgaatgatcccatccctgtgaaccaaacacctcacgttaggccccacctccaacactggggatcagatttcaacatgagatttggaggggtcaaacaaaccatattgaaactagagcacccactttctaattgtttttttttaataattgagttttgagaatttgtaaatatattctacatgctactctttgttggatatgcagtagtttgcaaatgttttctctcagtctgcagctactcttttcatctgcttaatagggtcttttgctgagcaaaggcttttagttttgatgaagtccaatttatttttctttgtgggttgtgcttttggcatcaattctaagaactagttttgtagctctaggtcctgaaaacttttcttctgtttttatctgaaagttttatagtcttatgttttacattaagtctgtggtccagtttgagttaattttttgtataaggtgggagtttttggtgaagattcacttttttgctgatgtccagttgctctattctttatcataaaggtcttcatcctcatcatcttaccattgaataggctgaggtgaaggaggcggaaaaggaggagtttgtcttgctgtcagaggcggaagaaaatccatgtgtaagtggacccgtgcagttcaaatccgtgttgtccaagagtcaactgtgcttcctttataaaatgtcagcttgttcctgttacattaaggagaaacaaggagtttatttactttatttatttatttatttatttatttatttatttatttatttgagacagagtctggctctgttgcccaggctgaagtgcagtggcgcgatcttggcttactgcaacctcctcctctcgggttcaagcatcctcccagctcagcctcccaagtagctgtgcatcaccatgcctggctaatttttgtatttttttatagagacaggatttcaccatgttgctcaggctggtctcgaactcctgggctcaagcagttcattccaccgtggcctcccaaagtgctagcattacaggcatgagccaccgcatcctgtgaaactaaaagtttaaatctgtgcttttttcaaggaaagaaggagcaaatggtaaatgttcctaagctaagtggtaggggtataaaagtgagaaaatgaaataaggaaagttgaaattcaaggagaatgagttgaagactacttgtatacctcatctcttctacacaatatatttatttctattggagaatttttctcatgccttaaggattttgtaaataaagggatgattctcttccttgcatgtgagacagttttcagcgattttcatttaaatatgtgagttatttttcatatttctttctgattatactgttttaaacatctggggataatagtggttggttttagtcaatatctgtataatttattctttgtttatattttgggatagatattatgttaaaatcctagttatgttctggtcggacagaaataaacgccatttctcaatgtagggggactctatgaatacagatactggtaaacccagatttttagtgctaataatgaataacaacatgagacatttcacatagtataaatatagttcaagaaatccatctccttataccaaattggatttctgtaataagtgtgctttactgactaattttctttcaaaattaactctgtttaaaccgttcttgctttttgtcatatttcaaaatgtgttagctaatattactttaaataatcaaggtatcatttttatcttgcaaatttatgctgatcaaaaaatcttcaaatctgaaatgtttataaaaatgactatgtgacggaatggcaaacatactctttaaaacgttttaattcgaaaagctcacaaggcatttagaaaggtagtgcctacaagaaaattcttatcttcaatattatttacctgttcattttggaattcataaaatttgtgcaatctttttttttttgaatatgtgtgtccttatcagaaaggaatagaaaaattgaaggcagtttggagctgaatagaagttattaatgagcttaactttgactgaaatgacagattaatggctaaattttcttctatagcaagtctgttagaacttctaccttgcttcagtaaattctttttgtcattacaaattggaggcaaaaggcaaagtaggtttaatttcaattttgaaactcagaccttaaatctttaatgaccttcactcagaaccaggattggttgtacttctttggagcacttataaaaaaaaccttatggatagtgtgcatcatggaacacatcacattttctcctttttattgactgcaaaaaagcactgaaccaaattcatggtggcctacttctaattggtgtactgtaccatgtagtatgccttttttgtaatgaccctgatttcatctcatttttttcttgtctattttctgtttgcagtgatctcctcatcattttagaagtcctgttgtgataatagtaaaagtaataattattcatatttatttagttctgtttataagcactctacatgtttcattaagtttaatgtttaacatcgctttgtgatagttactctcattatccccattttactgatgaagtagagtagtgctactcaaagcactagactgagaggagtttagcagcttgtaccagaattaaatcaacttactgcttccttcatcaagaaagtcatgctgtgaaaaaagtgtcagccgaactaaacaatgtgcttaatgatctgcattctgatgcaagaaacttacctcggcacaaactggcaacagacacttcattgtcagcctggacatcaaactttgagtagcactgttccagaacagtgtttctcaaactatctgtggtgaaggacttttatgcatgtgtttaaatgtttagcacttatgggctgagactttgataaagtaaaaacgttgtggtaatgtgaaaagtttctaagtactttaatgtaatgaccttgtcttgaacaagtaacagtgactttaaggactggcataggtagaccctgttttgagtagcactggtatagagtgaattagtgtatcaattgtgattgattctagatcctagggagaatcacagtgccttattcagcatcaacacatgagagttgcctaatttgcgtaaatgtaaacctatagccacattggtgggaaatagcagagcaaatatctaggtattaatcctgtggcatcagcaccttaggtttatctggtttgcatatagccagtcacagcaagggagtgagtaggcagtatacctataggtatagaaccagttacaggaagggagttccccactacagtgtttaaaaattccgagctttcatgcacaatgaaagcatgtttctttccttccctcacactcaaaggttgtgaacatcctacaagagaccattgtagacatccacctagaggttccagtactgtggctaaacgtttaccttatctcaaaggaatacgtatgtgtatatgtaggatgtgtagtaaaaggaaagtttggcctggatagattgaataactttctatgggattttttttcctttaggtaaataatcctatgataaatataagtaatctggttaggatatccttatcaatttctataatattatgttaaaggcagtggaaaaatatgatgtaacttgtatgtcttaaattgtatgtctcagctgggtgtggtggctcacgcctgtaatcccagcactccgggaggccaaggcaggtggatcacctgaggtcatgagttcgagaccagcctgaccaatatggtgaaaccctgtctctactaaaaatacaaaaattagccgggtgtggtggcatgtgcctgtagtcccagctactcgggaggctgagacaggagaattgcttgaacctgggaggtggaggttgcagtgagccgagatcatgccactacactccaggctggatgacagacccagaccccatgtcaaaaaaaaaaaaattatatgtcttaaattcctgtagctttaatgtgagaacactgaagcacagaaaggtgacaagagctaatgagggactgagccagggtttcagctcagccaggatttgagctcagggaactgtctccaatagcctaattatttttctttgtttttaacttttagttattttagactattacaaaaaaaaagttttttgtttttgttttttgttttgttttgttttgagtcagggtctctctttgtcacccaggctggagtgcagtcatcttggctcactgcaacctccacctcctggactcaagtgatcttcccacctcagccttctaagtagctgggactacaagcacatgccaccatgcctggccaattttttgtgttttttgtagagatggggtttcaccatgttgcccaggctggtcttgatctcttgagctcaagcaatcttcccacctcggcctcctgaataaaagttttaaaataagtataattcctgctgtggtttgagtatgtcaccagaattcatgtgttggaaatatggtccctggtatggcagtgttgggaggtggggccttaaggtggttaagagggattaatgctgctcttgcaggactcggtaattctcatgggagtgagttgtcactattgtagaactgaattggtaccatgagagcaagttgttataaagtgaggctaccctttgtgttttgctcacttcctttttgacttctgtgctatgttacaacgtgggacaagactttcaccagaaaccaaccagttgtggctgcccaatcttgggcttcccggtctccagaactgtgaatcagaataaaccttttttctttgtaaattacccaggctcaggtattctgttatagcaataaaaaatggactatgacagttctcaaatacttttcccctggcttccctgaatgttaacatcttacattaccatagaataattattgaaatctcaaaattgacattgatactgttaactgctctacagagcttattcaaatttcaccagaattttagtttttctattaatatcctttttctggtccatgatccaatccaagagcacatactgcatttagctgtcattttattttagtctctttaaatctgtggtaattccttagtctttctctgtctttcacggccttgatactttaaagagtactagtcaattattttgtagaatgtctgttaatttgagttcatctgatgtcttctcatgattacattgagattttaaagtttaaactagaatattacagaagtgatgtgctccttctcagtgaatcatactggggctacatgattctaacatgactcaattactggtaatgttcaccttgatcacttggctgaagtggtggatcctaggatcctccattacaacactactattttcccctttgtaattaatattaataaatatcttgttgagacatactttgagactatacaaatatcccatttctcattatactttccctctcagattttacattccactgattccatcgcctacattctttttaaaaaacttcatttcaatagttttcggggtacagatggtttttggtcacatggataagttctttagtggtgatttctgagattttagtgcacccatcacctgaacggtatacactgtacccagtatgtagtcttttatccctcacctccctgtcaaccttcctcctcgagtccccaaagtccattatatcactttttttttttgaggtggagtcttgctgtgttgcccaggctggagtttcgtggcatgatcttggctcactgcatgctccacctcttgggttcaagtgattctcctgcctcagcctcccaagtagctgggattacaggaatgtgccactgtgctcagctcatttttgtatttttagtagagacggggtttcaccatattggccaggttggtcttgggctcctcacctcaagtgatctgcccgcctcagcctcccaaagtgctgggattacaggcgtgagccactgtgcctggcccattatatcaatcttatgccttttcatccccatagcttagctcccacttttaagtgacaacatacgatatttagttttccattcctgagttgcttcacttagaataatggcctgtggctccatccaagttgctgcaaaggacattatttcattccttttattttttaagacggagtcttgctctgtcacgcaggctggcgtacaatggcgccatctcggctcactgcaacctccgcctactaggttcaagcaattctcatgcctcagctacctgagtagctgggactacaggtgtgcactaacacgcctggctaatttttgtatttttggtagagacagggtatcaccatgttagccaggctggtctcaaactcctgacctcaggcaatccgcctgcctcagcctcccaaagtgttgggattacagatatgagccaccacgcctggcctatttcattcctttttatggctgactagtatttcacgtcctacattcttaatcgttacattggacttttgtaaattatctgaaagtaaaaaggtacttcaactgagggctgagagatctgcctcctaaaaccatctggggctcttgctccctccagctgttccctcctcctggactgttcttccctcagattttatcttttggttgggtccctcacttcaagtgtttacacaaatttgaccttgttagtgagacctccttgaccaccctatttaataatactgcaaaccaatctgtccaacctgcttactctgcccaccccccatcttctaatagtactgtactttgtgcttacctaggctgtccctcttgtagctccttgtaatttcagactttagaacaggtatgaatgaaaacgttctgagaactttctctgcttgtgggtggaggaaggagtgcacagtgaaattgttcttccgattgcgtcttccttacgtcagccatgacacttgtagtcactgctgctaccacttaccaaggaactcagactccaggctgccactaccttgcaggacaatattagctgatgcttgaccatgtctatgtaattttgtacacaagacaaaaaaggggcaaaaagttactagctcctccccttagccaacattttgactttggacaaataagttcacctttctgtttctcattttctttataaactgaggctaataaatcataggtttgctgtagggatgaaataagaaaacatataaagcacttagcatagcacctggcatgttgtaagcattaaatgagtggcagccattattattattttctagcttttatggatgtattttacacatggcacaaaattgtactttcatttatctcattttgacagtatacctcttcttctgacctacaggtacctaaatttaaagaacagtttttcctaccctttcattgttgctagcctttcaagagtctcctactttttttgtgctttctcaattcctgtatgatgtttctaaactacaataaattaaagctagtatttcttctctattggaaggccagctggttaaagacaacatcaaaatatctatacctaaatctgtatgaaattttgaaagacatgatgtatagtcaacttacaatgggcttcattatacttgcttaaaattatatttttatttgatttatattttcaatgtttttttcttaagataaatgcaaaccaacttccattctcaaagcaaataaaataaatgtcagtattcctaggatctcctgaagagcttggaatgatatgatgtatgctgtcccccatctgtatggatgaagccagttcaggaaaacaaaaacaaaatatctatttaattacatttggtgttaatcttttcacaagcagtcctgcattttcatggaattaaaaaacattctgatgagagctttggtaataaaacattctgatgagtgctttggtaatttgctgtatgtgtttattttcacatctatgctagctattgatcacaatttccaagccatttagagggagaaatgccctcaggccgctcttctgtgtggcctactgcagacagccaaattaccccactgacaggccccttcctgcacccacccccacccacccaataccttattcttcacacagaatgcgacaagggccaaaggagagggggactggaacataggagtgtgactagtacatagtagtagctcgataactgttgttgaattaatgaattaacaaatgaacaaattatgtttctagtacactatgactgctagtaaggtcagagctcaatttgctattccattgcatcagctaggatagtgtctgatataccttatctctattcctacttgtttttgaatttttattatcctgcttatggatgctttaatatcataagctccttcccatgtttggactgtgaaacttaagaaagatgtttcaagttcttggtacacaagaaaggagagctcctctcgggaccataggccagttccaaatgcgccttcttctaatcatagcccacagaacttacttctctttcccttcttgggtaggagcactggaaaggacatcttcaatcactatggatgttgacttattctgacagtgcagagcagtgtgccgtaaaatctggggcagacatttcccccaacttccaatatagaagagaaaaaattactaagaaaatcctggccaggaatggtggctcacacctgtaatcacagcactttggaaggctgaggtgggcagatcgcttgagcccaggagttcaagaccagcctgggcaacatgatgaaaccccgtctctacaaaaaaatgtaaaacttagccaggcatggtagtgcatgcctgtagtttcagctatttgggagtctgaggtgggagaatcacctgggttcgggaggtggagtttgcaatgagttgagattgcgccactacactctagcctgggtgacagagcgagaccctgtctcaaaaaaaaaaaaaaaagaaaatccttcagtgcttagagaaatcagagggtgaatggttatatagaagccagcaggaaaagcatcattagaggaggtgaagaatctgaattaattgtccggggctaggacctatatccaagaagggcaaatgtgtttaggagtaacataaaacttaatgtttatgccagatgatgtaggaaaaataacttctgccagaccttggtgactgactagatagagaggctgataaagaggtgagcctattgaatgaagcatttttagtatggcatgatataggtggcccagagtgtctcgagtttgcccaagctttttcctctctaagaactaaccaagcctagtgcttctttgctctgagagcaggcggacattggtttatggtggctagtttgtactaggtagaaaggcaaaagagggaatgctacatggattaatcaaggatgtccaattctaaaacaaaggatgctgagatgacaagaaaggccaaggaagaactattgagattgtaaatgccctgagagcagggaccttttctgtcttgttcactgctctgtttccagctcctagactagggcctgacacatggcagatagagtaagtaagtttgaatgactacattaataggagaaacttttgaaagataaaatgcaaggtcaattatatgcaacggttgttgctatagcaatgatattcgtgcctagattcttccccatatccttcctgaatattttaagataagtatatataaaaggaatatgatggatactcataaatcataggatatggctgctatgacttatgggatgggacagatgagaacttggtatatttacgagaaagggaactgcatagcctctgagaagttgggtagtcctgtgtagaccactcacttatttctaccaggccaagaggcaaataaagctgacctgatatacttttgtgtcttaatctctatgttttaactctaaggggtgggagaagccagtggctagggaaagacagaggttttaggattaacatcacaatattagctacagagattttacctagaagtaactggagcctcatttgtgttttgaatttccataagggagggtttgatatactgccagatcagtactggctttggtgtctgaaagctttttgggagagtggctctggtcactagtagaggcttttcagtgggactgggaggagttaggtagaactttggatttgggtataaagggacttgtaaaactcagtcaaaatgcttacaatctggcaaaggtagctcttcaggctctggtaagggatatctataatctctgtggaatatcttagaacacatgggattaggggagttacatgatcaatggaataggcaattcattcacctgtcagtcacagagatcttacttctagggaaaatctgaaattggaggacttactctgttacatgaatcaaagatatgaccttgaaaaatgggagtaaccatggcaccagtgagtgagtcagtgatttgggaggggaaactggtttgggaagaaggattatcatttcggttttagaaattctgagtttaaagctacagcacatgttgaaatttgtagtagacagctgggaggaactaatggaagcttaggtgagaagacaagttaggggttgttagctctgtcttcttctttgtccaactcctctgagaaagcagaaagtaaagatgccagctttagtctgtggctacttagtttttaggccctttacctatttttagtctaagacattgctgggatacatcaaatggggagagcacaagcagttgcatctatttatgagaaagaacaagtctaaagaatgagagtcacggagaagcaattttctttgcattttatttttatttttattttttgagaacttctcattattaccaagcttctgtcaggaaatatgtactagaagccaaacaaaattatttcattgcttacggtgaaatgtaccaggggtgctgatgggcaaaaaagagcgcctcatatgaaacaccaaatgttccagtaatcctgttccaaaccatgcccgtttacttaaaatttctttcacagttcacgttagactcatgcagtaaataaattaagtacctttcccactgcgagttttttagaaacacttaatgaagtaaatgccacagtgttaggccagggggaagccatgcagttaaattatttttagcatgcattttctagtttaatttttgttggtttcttttgatctgggcttgagtcttagccagatagtgtgattcaggggacagaggacatggatgaaagagaggtttgtctttactgcctagtgaatataactaagggaagcttcttttttttcccaaatgttaaaaaattttgtccctctctaaatatatttaggattgcctctctaaatatcaaaataattctatttgggatagctataaagagatatactattaactcattacccttgaatatttagaaaagctctgtatgtttaattttaattatatggcctttcaataaaagtattatatatgctatttttaaaatacttaaaaacataagattattttaaatatagtttaatctttctaattaaggatgtttcttgagattttttttttttttttttttgagacggagtctcactctgtcacccaggttggagtacaatggcacaatctcagctcattgcaacacccgcctcctggtttcaagcgattctcctgcctcagcctcccgagtagcagggattacaggcatgtgccaccacgcccagctaatttttgtacttttagtggagatggggtttcaccatgttggtcaggctggattcaaactcctgacctcaaatgatccacctgtctcagcctcccaaagtgctgggattacaggcatgagccaccctgcccggccttgtggttttgaagagcttgaatcatcattttgagaattaaatgattattatattataaatgtgcataagtgtttgttaatgaaatttctgattaatatttccttttaaaaaaacaggaactataaccacattcttttaatagctaaaagcatttgttaaagtgaccaaaaataattgtttcaaaaatttttttttgaatgaagacaacgcaaaaatgtatcagagaagatacactgtgtctggaaacaatctgtgtctagaaagaagtcttcaattttgattaatatgttttatgagcaacttaagaattaatgcaatatgttaggtaaaatacagcaataatttttcattgctaaattgttcagcagactctcctaattttcaaggggtgtgctgttgtgagtatgggattttattctgaaggaacaaaaaccaaagtcaaaaagatggtttcctttttgcacagaactctctaatacctctgtcactatctcaacagggagtggtgcttcttattttaacttgaagagtatagtgaggactgtccagcctttctgcaatctccaagtaatcagaaagtattgaaaggtgtaataggaacaaagtggaaaacggcagtatcctcaagttacaggccaaattggtaaccctaagagaaagattttgacagccataaatatttcatctctcaaggccctgatgctactgtgtgagagcaatttagttagaaagatcatcaacaattagttgacatctctatcacacctattactgagttgaaatttcactgacatgaataataaggggtcttgtttgacatttagcagtttaattaatttgtttcctaaagtgaatgatgttttacactgtgatttttcaataccccgtctccatacacttgaatttttttattttgcttttcttggggaaaccagttaattttccttttcacttaacaaactacctacccatcttggctctggtgccagccagtgttttgtggggcttagggggcggggatagtgtggggaaattgaggaagtgctgcagatcatcctctactattcaattttggaggagagataatgtaggagtatggaaaaggaaaacaaaaacacttttttttttcaagaaaatttagtactttttggcattattgttagacaaaaatacaagtcttgtctctctggttattctagtcatcgagaatcaacaaggaaggggccgttatgggtagtcattgcctgccatgtggcataactatttgcattattctttatatattactggctttattggtttctgtacaccttcaagatatgttgtatattaatgtgatttctgtaatgctatttttgaaaataaaaaacataatgtttgctaaaggtcacttctaaaacagctgatgtgaaagtaggaggaataatccaatgtaacaatagaacacatgaatctactgtatattcttacagataaaaatagacttttgaaaaattagtcaactcaattaaattatttactctaattacctctatacaaacccctaaatacctaccttaagctgcttccctttgcagagttttttaaaaaccgaagatatgtggaaaagctatttctctcccactctaaactgtaggtcatgaaggtaaatgatattctgtattcgccagagtgcaagtgtccttaactacctgatgatgatgtatatttctgatggatggggcttagctaggtagacgtacccagatgaaatcaagtgagtgcatattcatgacacatgtgagtgggaagaatgtcttagaacatgtcatgctgaagagacaatgctgaagtgttgaaggttgaatgttaaaaggggaagataggctccagcttttggaggaaaggcagtccagtatatacctaccataatgatacttctttccgtgttgtcggttcttattttataatggtgtctaaaaaataaacaggtaccactactttactaacctgcttttagaccaaatgtaatgaaagtgatacggaactgatttttaactattgaacctctaggatagatgaactcttaatgctatcacaaaccaccatgagatacttcagcataatagagtgctagcaaagttgaaattgctgctattgtgtatctcagacttgttaaagctgttccagactcatggtgaaatagattgctttcttctactggtggacattgaactttttccctctatacatgtgtttataaacaaacagtgacataaacttttccattggaacatattttgaagcagagatatgtgtttgtagagagcattatatatatcatttaaatgtattttttttccaaaacaagtttccaggtcataattttgaacctgtataattttcattatgattttcctgtctgaactgaaaggccatgcaataagtgaaaatattttatgtttatttttgttaagtacctctccctctctgccttagtacgaggcatagcaaggaaggattaaggataatttcataaagataattaaacataagccttgagtgacttctttctatcagaaagacttcagaaaggaaagagttgaattagcatggtatgtttaaaaacgaaacaaaacaaaaaagtgtgacttaggacacaggagatgtacgttactaaaaagttttactatgtgccgggcactgtgcttcaaactcaacatgcactatttcatttggtcccaacaacccagtgaggtagttgtattatcttaattttgtacatggtggcatgatcatagctgagaattcctgggctcaagtgatccttctgcctcagcctcctgagtagctgggactacaggtgcacagcatcatttccagatagtttttaaattttagttgagatggccgggcgcggtggctcatgcctgtaatcccagcactttgggaggctgaggcgggcggatcacgaggtcaggagatcgaaaccatcctggctaacacggtgaaaccctgtctcaactaaaaatacaaaaaaaaaaaaaattagccaggcgtggtggtgggcacctgtggtcccagctattcgggaggctgaggcaggagaatggcgtgaacctgggaggcggagcttgcagtgagccaagatcacgccactgcactccagcctgggcgacagagcgagactctgtctcaaaaaataaatacataaataaatttattttagttgagatggggtctcgctatgttgcccagactatgttgcccagttctagactagtctagaactactaccctcgagggagatcctcttatctatctcagcctcccgatccgcctgccgtggactcccaagttgctaggattacaggagtgagccactgcatccagccctcaaagcattttaaattactatgcaatacttctactcatcaaccctctatcattaagtggttatatcatcatgagtgaattacttaggctttgagagaggtaatttctttccctattaagtgatggtcatggtacctgctcctcttatttcaaatgcaacatgatacaatggaaaaggcaatggacttagagtcagagaatatgaattcaaagactgactctattagttattagttgtattatcctgaattatgcacctaatctctctgatgtggtttggctttgtgtccccactcaaatctcaccttgaattgtaatccccataatccccaagtgtcaaggtagggacaggtggaggtaattggatcatgggggcagttcccccatgctattctcgtgataatgagtgagtcttatgagatctgatgggtttatacatgtctggcatttcccttgcttgcattcattctttctcctgccgctctgtgaagaggtggcttctgtcatgactgtaagtttcctgaggtttccccagccatgtggaactgtgagccaattaaacctcttttctttataaattacccagtcgtgggcatttcttcatagcagagtgagaacagactaatacactctgtaaacttggtatcttcagcatgtaccatgggaataatatcagcacaacctatctccacaaggttgatactgaagttgaaagtgacataatgtaggtgaatatggcttgtggtaaatggtatggatttacgtttattagatgctctgctcatggtaatactgttttcaacagcattttacaatttatctcttttattttgaatgactttatgttgtaggcactattatcccaatattttttttttaatagacagagtcttgctctgttgccaggctggagtgcagtggcacaatctccactcactgcaacctctgcctcccaggttcaagcgattcctgtgcctcagcttcccgagtagctgggactgcaggtgtgcaccaccacacctggccaatgttttgtattttttagtagagatggggtttcaccatgttggccaggatggtctcaatcccctgacctcgtgattcacccgccttggcctcccaaagtgctgggattacaggcctgagccatcacgcccgtctagtatcccaattttatagttgagaacactgaggcataacgaggttaggcaacttgcctagaattatgtagctaataagtggcagagccactcagtttgaatgtagtaatctccctgcagatcccatgctctcagccttccataaagacaggttataatgtcagctactgggctgactgagatgggagtatcccttgaactcaggaatttgaggctgcagaatttgagggttgtaccattgctctccagcctgggcaatagagcaagattctgtctctaaaaataaaaataaaaataaaataagatagaattgtggtaaaatacatgtaacataaaatttactaatgtaaccatttttaagtgtacagttcggtagtattattaagtacattcacagttatgcaacctctgttttctcttcttttctttctttctttttttttttttgacagactctcactctgtcaccaggctggagtgcagtggcacaatctcagctcactgcagcctgcccctcccaggttcaagcaattctcctgcctcagcctgccgagtagctgggactacaggcacatgccaccactcctggctaattttttgtatttttttagtagagatggggtttcactgtattagccgggatggtcttgatctcctgacctcgtgatatgctcgcctcggcctctcaaattgctgggattacaggcatgagccaccgagcccggcccctcttttcatttcatattctatctgtctctttctgtctaaactgatacaattcctttaaaaattttgtaggtttactgtgtatgttacaatctatcacattagacaaaagccacactcactaataagcacttctctctcttgggctccttgtaaacctgctgtggggcaatccccttaagatacttagaacccctattgttatcacaggaggtcttctacacatagccttaagatcttcagaagttcttttgtctgtctgaaagggtttataatgcattaccttaaatcattctggggtcattgagggttttacagccacactctgagatgctttcttgataggacctgggattttatttttaccttgaaggcatttcttaatttgagaagtatttcctgtctgaagagtctgggaatgagaaacaaatttagttttttaacgcagcaagtcctggatcctttacattacctctaaattttgtttgagaatggaatagttcattcttcagttcatctttctcctctgacattttattatggggagcaagaataagccaggtagcacttccagtgttccacctgcagaattccttagctagatcacaaatttattaagtacatttccttttttcatactaccaaatttcaagctgttacacaaggatcttctttctcctaagttccagtaacatctttgttacattttttatttatgcttcagtgttagcctctagagtactgttccaaaactaatgccatgtgttttagattttgttacaacagcaccaaacttttagtaatgaaatttgttctggttagctttgctgcattaaaaaaaaagcctaccaatattaattgtgtaaagtcacaactttttaactttgctcatagattctgtaggtcaagaatttgggatagtcacagcaggcatgtctcttctctgctacatgatgtcttgggcttctgctggggtcaaggggacccactttttttttttttttttggagacagagtctcactctgtcgcccagggtatagtgcaatggtgcaatcttggctcactgcaatctctgcctcccaggttcaagcaattctcctgactcagcctcctgagtagctgggattacaggtgcctgccaccacacccagctaattttttgcatttttttgtagagaaagagtttcaccatgttggccaggctggtcttgaactcctgaccgcaggtgatccacccacctcggcctcccaaagtgttggcattacaggcatgagtcaccacacctgtccaaggggacccacttataagatgatttctttgctcacatgtctggtaactgagctaggatgacctaaaggcttaactgggaccatagactatagagtacctgtatatgacctctatggggcttggacttcttgcatgattgtgctgggttcagagaagagcctccagagagcgagcatttttttttttttttttttttttttgagatggagtctcgccctgtcacccaggctggagtgcagtggcgtgatctcggctcactgcaacctttgcctccccggttcaagtgattctcctgcctcagcctcttgagtagctggaattacaggcatgcaccaccatgcccagctaattttgtatttttagtagagatggggtttcatcatgttggccaggctggtctcaaactcctgacctcaggtgatccgctcgcctcggcctcccaaagtgctgggattacaggcgtgagccaccgtgtcgaacacagagagcaagtattctaagaagatcaagtacaagttgtgtaaccttttctgacctagcctcagaagtcacagagcatcacttccactgaactctattggtcaaagcagtcacaagtctgcctagatttaagggatggggacatagaatataaaaaaattgggggctcatgttttaaaaccaccacaggggtggtaaaattcaaggataatacagtccatcttcgtagccagtaacattactccccaatccccccatcccataaccaggagttgcttttttccaggactaacgttggatgcttggagataattattttattaagaatgggaacatttctacccaaaggtgcattattattattgttttccattttgctaatggtcttctcctttttatttttcttctcttcttcctctttcttcttttttccttctcctcctcctttcttttttttcttcctcctcttctttcctttaccattcttcttccttcctcttccctcatcttcatcatcaagcagtgtacactggacatcccttagcatctgttttcatttagttttgcagttagctatgccttacttcatgctccagaaatactttttatatccctctgttagcctttatctcattctgttggaattatttgtgtatttacctgtatgtcacaataactgggactcctgatgggcaaaggccatgtcctgttcatcattaatccaccaggccttggcacagtacttggaatccagcaaatgtttttggaatggttaaatcattgaatggcttttttctgcctatcttctatgcaatagatattatgcctcctaagatcttttgtttttactttgagcagtttaagagcctctccataagtgcaaatttcataaaaaaaaaaaaaaaacttagcttgttaatcatcccttttgtattattttcattaaatattcatttaaagccttttattttatatgaggataagtgagattaagatagcacacgttagtagttatagtagtagtaatactggaaatttttcaggcatttatataaattttataggttagatgacacaaaatatatagtaaattagattattattttagaactgttcatgtttagcttgttgatgactgaaatccaacagtaactattataaaattgtcctaaaattactaaagagatattttttttttgagatggagtcttgctctattgcccaggctggagtgcagtggtgtgatctcagctcactgcaacctctgcctcccggattcaagcaattctcctgcctcagcctccgagtagctgggactacaggtgcttgccaccatacccagataattttttgtatttttagtagagacagagtttcaccatattagccaggatggtctcgatctcctgacctcgtgatccaccctcctcggcctcccaaagtgctgggattacaggcgtgagccaccatgctgggctgagatattcttttcttttgaaaatattactatacattttcacagaataaattttaattgtttctagttttttgagtataagctggtttataccatcgtatgtcatgcagttcttttcatcatcttattaggtgggaattagtgtacttattttatagatgagaaactgaggctggaagagggtaattcatttgtatgaggtcaacagctaataagtagctgagctaagattcaaatctggatctatcagacccaaaagcctcttaagcaatatgcctctttcccaagaattcttttcttttcttttcttttattattattatactttaagttttagggtacatgtgcacaatgtgcaggttagttacatatgtatacatgtgccatgctggtgtgctgcacccattaactcgtcatttagcattaggtatatctcctaatgctatccctcccctctctggattaagaaaatgtggcacatatacaccatggaatactaggcagccataaaaaatgatgagttcatgtcctttgtagggacatggatgaaattggaaatcatcattctcaggaaactatcacaaggacaaaaaacctctttcccaagatttcttaagcaatatgcctctttcccaagatttcaaagtgaaattttgtcccaataaattgaacataatctgaataattttatgaaattaatattgtctgcctagaaaatgtataatgctaagagcattcactagtaatttcctatttttatacatgtagatataaaatttctattagggttctacagagaaatagaaccagtagagtatatatagatggatatacagagagagatttattatgaagacttggctcaggcagttatgcaggcagagaaggcacaatcgattgtctgcaagctggaggcccagaaaagctggtcatatagttccagtccaggccctagggaccaagaaccaggtggccagcagtgcaagtctgtaagtcctggtctgagtccgaaggtccaagaactgggagtcctgtttgagggcaagaggacggatgccccagctcaggtagagagagagcaaattcacccatcctttgtcttttccctctgtttgggccctcaactgattggatgatgcccacctacactggcaagggcgattttttttacagtctactgattcaaatgctaaccttttctggagggttcccaggcacaccccaaaatagtattttatcagctatctgggaatcccttagtttatgcataaaattaactattacaaaagcccccaaatattttcttttttataaggacttcagtaagatatagttcatacacataccatacaattaatccctttagggtgtataatttagtggtttttagtatgttcctaaggttgtgcaaccagttttaaaacaattttacaaccaattatagagcattttcatcacccaaaaagaaaccctatacccattagcagtcactgcccatttcctccagcccccttattccttgacaaccacccccagttttttttttttttttctttctaagacagggtcttgctctgtcacccaagctggagtgcagtggtatgatcacagctgactgcagccttgacctcccaggctccagtgatcctcccatctcagcctccctagtagtagctgggactacaggtgaacgccaccatatctggcaatatatatatgttatatatattatatatatataatatacatatattattatatattatacatatatacatatataatacatatatacatatataatatatatacgtatatacatacatataatatataatatatatgtatatacgtatatatattatatatatatatatatttttttttttggtagagatgaggtctctctctgttgcccaggctggtcttgaactcctgggctcaagacatccagctttggcttcccagtgggattatagacacaagctaccactcttgtttaatgtcaaatctttaatatcctacaatattttaaagatttactcactgagacaataatagagctttaagaagcagcagtgttctgattttgtgcaacatgttcatgagtgttttacagttcctttttttctttttaaaatacttcattttttagaacagtgttaggttcacaggaaaattaaacacaaagtacagagcatcctcatgaccccctcctcccacatgtgtacagcccccccccccattatcaatatactcaatgtttgttacatttgttacaattgatgaacctaccttgacacattatcacccaaagtctatagtttacattagggattactcttcctcttttgacattctgagttttgacaaatgtataaatgacatgtatttgccatgactgtatcatagagaatagtttcagtgtcctaaaaatcttctgtgcttcacctattcgttccttgtagttcttttaaaaactacagaattacagaaattcgtcgtgggaaggtattgagagattatttggtgcagcaaaccagttgggaaggatgtagtcaaaattcccagtctcttcagctgaatttgtccctttctttcttttgttgattgtcataaatataagcattttttttctttttttgtagtttcccctttcttaccacaaagggtcatttcctaacttagaatgagccaggcaacaaattttagaatttaacaagaaaacagttatttccttagttcttgttttatgaaaaataagttatttatattagaaaaatttaaaaatatacaaatagtagagagcacaaaaatagttatccattccccagttaccaacacttggccaatctcttttcatttgtccttccactcattgccacccccttaactgcattatttcaaaatgatttatagatatatcattttatttgtatgtattttaaaagatacactttaagagaaaaaaattatcacaaccattatactgtaatactgctaattccttaataccaccagattggtaatcattatttaaattcccccaataattcataactttttctttattgtcagtttgtttgaatcacatccaaacagtatccacacattgcatttgtctctttcaatctatagcttccctcccttgtttgcttcttctcccttgcttcttctttgttgaagaaactggactattcatcttgtttcttgcacacaggatttgcttattgcatctctgtggtatttaatgcatttttctcctgtgaactggcaggttacttaagaagtttgatctgattccagggtgtttttttgttctgttttgttttggtaagaatacttcattgatggtacactgcattttaatttctactaagtttctgtttgtctattttatgatgttagtggccattatttcgttaggggtttgcaaagtggtgatattctaatgtgtttatctttcttcatttattagttggactatttctataaagagaaacttatcaataacctgaggtatagtttgtatagaaaaggcagattaaatgcttgatttctttccctttaaccgctagttttcagaataatgaattggttcactagcatcctccaaaggagaccaatcaggttttgtttggtttgtttctttaatatcattatgaactcctagattttttaacctatttcatgtgtttcaatcaaatacagttattattctactgatactcaaacttgaaaatcaccataaaatttaaaaattgtatcacttaaaggtggttttattataaattatttccccctagaatttatgaaaatgaaaagcttccctgtgtagttacacatgaatgttcaggagtatacctaccatgtaaagtgggttgaactttcacaggggtttatttatgcatatacactgaaataaatgtgttagtgtggttatctaagacagtctatgatactctaaggaatgaatacatgttcacctttatacaagaaatctggagtcatgtactttgggctagggttgcttctgaggtggcagccattctgcagcagcccttctgtaccttaaaaaccagcacagtctccttggaacacattcttcagctctgaccacaggagaccagctgggctaacactcagtgatttgtcagatttacctgcattttcatagtatttctatcaaagaaatttgtcctaagtgtcaaattgctgatttttccagtaactaaaaggtttcatgtggacttctgttgttatttacatgtatatggagaaaattgcaatctgtgagtaatttgagaaatttcaacactttcagcagtagtgatctagaaattaaatgggtttcaaatacaatgttccagtgcagtgccgcatatataatgtatgtgcagcatatgctgaggtctttttcaaaacatttacattaaacctgtcaggtatttatgaatagcaaaaattaatttcccctagttctgtcatcagttagagaaatggatttcagcatggaagactgtcaatatttcctgcatactagaacagctcacttcaatgtcatagtattacaccaggtggccttctaagagtcagcttaatgtgatttcaaatgatagggtagtgaatgtgagggaaattaaaatagtatcatacttatgatttaaaagcaagttaattacaagggcttgttaataaacaaagaaaaattctgaatgtattatctgttatatagcatatcaataacaagtgtgatgctttgaaaacaaaaaactctaccactatgtgactttgagatgacttaaaaatatttaattaaattgttgacaaatgtgttaatctactaatggccttatagcatttgaaagaatttttagatattcatttagctcttaaggcacttctaaaagcattgtttaactgaaaagattagctacattgttggcattttatctagaaaatcactgatgtgtttgctgtgaatgatcctaacagcactgtactttgtcaatgttcagtcaatgcatttttcccaatcgggtacttttaaggttcttatagggccaaagcatgtgcaatatcactattactaaaatgagagacattttatttgatgaattatttagtattttttgatggttttgggtgatgtgcctccaccctgcccctatcttatatattagggggaggaaaagggaggatatctgatgcattttaagaaattattaacgttctgatttttaaaaatattgtgaaattttaattttagaaggtattaaaaatgtccactatttatgaacctgtgaaaatttcataatatttttaaatctagaggtttagaaacaattattattaataatttcatagtgtggtagccttagaaggaacaagatatgatgacaaagatcttccccattgtgcatatgaacttgctgggagtctgatatatatatacatatatgtattaataattaatatgaggaacacaggctgattttttaaatatatggcttatgaaaatctcattttctagtcacaagacaaactgaggataattcttcccttcctggattatactgttatgtagttaataaacctattcttttaaagattatttcaaggaattttaatagtttttgttctgcgcggtttttaagattaaaaattaagcccaattcttaagaggttgccttttaaataatgggtctaatacaccagggtcacatagagttcaaatcctggaaatatatggctctacttacacaacgttttatgtggtttttcttttaaaaattgtcctctttaatatactgtggaataatgtgagtctgtacaatcccattttaaggacttctttgtaaaatccagctgttttaaggttctttaaatatcctggctgacaaccacaactgacactgctgtgctgatgtggatataagaaatttcatttgaatgagaaggacagctgacattatattcatagttttatcagcggccatagggttattagtcatgggagccaatactttgttctggtcatgtatcccttttttcatagggctttccactttatgattattgtttgttaacattttatcttttaagtaaataaacagtgatactgcaaatctctgtggtacaaatctgcatctgttttacttgaggattgtctatgttattgcaattttgataaacctttgaatctcatgatattacacttgtatttccttggttatatacagattccttttaagaaaactaaggcaaatattttaaaatacatttaaaaagaacataatttttgcatgttttgtcttatcacagttttaaagtgctataattctgaggcttcttctagaggaggttaagcattacaaaataaaaggcaggaaaggacaattttaggaactgtgcaactaagttaaaacaaatattatatcctagtaattgaggattaggactcttgattccattccttgtagtgctctcctatagacctctgtacagaatgtgtatatgtaggtatgtacatgtattttctgaatacggctacttgctggtatagtgtcattttaatcaacattttaatctagtcgttattaaaatgctacttacaatgtagagagaggctggctatttgcttttaaagtgtcaacaaaaatgctggaacagtcacatgtttttgttgatcaaagaatgtacaaatgtctaggagatcacaatcactattaccatatatggattatgttgacaaaatacctgggtgtgtgaattcaaaagggaataaatctgatgatctgttaatttgcaaacagaaaattattataagaactgtgcagctggagtgaattcaaaagttaaggaaagtttgaatatctgcttgcatgctatagcacttgaaatacatttagacctgtgtcacagacattgagttcctactatagtcagcttctgtatttggtgtattagatgagtatgacaatttgcctcccctcaaacagcttaaaccatactggggaaaaatggcatggaaataaacagtgacaatgcataatagctgtaataggatgcatactttccaatgggaaagcaaaagggggcaaatttatttttatgtggaagccagaaaagacttcaccagtaaggcacatttgtaagggaggcacaaaatggaaataatgaagctgaaaaaatttatgaggacttcataagatcatgttaaacaattttacttttatcatgaaggtaactgtatgccattaaagtttttttttttttttgagacagagtctcgctgtcacccaggctggagtacagtggtgtgatcacagctcactgcaacctccgtctcccaggttcaagcgattctcctgcctcagcctcctgagtagctgggattacaggcatgcaccaccacacccggctaatttttgtattttttagtagagacggggtttcgtcatgttggccaggctggcctcgaactcctgacttcaggtgattcacccacttccacctcccaaagtgctgggattacaggcatgagccaccgctcctgacctaaagatttttaaacggagtaatagatcacatatctgtgttagaaatacaactttaagatggcagataactgcatcttttttctgaggggcaaatccagtaatctcattaaaaaataattaataacagatttttttttttttgagacagagtttctcttttgtcgcccaggctggagtgcaatggtgtgatcttggctcactgcaacctctgcctccttggttcaagcaattctcctgcctcagcctcctaagtagctgggattacaggtgcccaccaccacacccagctgatttttgtatttttagtagagacagggtttcaccatgttggccaggctggtcttgaactcctgacctcaaatgatccatctgccttggcctcccaaagtgttgggattacaggcatgagccactccatccagccaagaatattatatctggcaaaattattcttcataaatgaaggagaaataaattctttcccaggcatgcaaaagctgacagaattcattaccactaggccctagaagaaatacttaagggtgtcctaaacctggaagtgaaaggttatctaccattgtgaaaacatgtggaagtataaagctcactggtaaagcaaacacacaaatgaggaagaggaaggactcaaatgttaccgctaaagaaaaacactaaaccacaatgataaacaataagagatgaagaaaggaacaaagaatatataaaacattcagaacacaattaacagtataacaggagcatatcaataataccctcaaatgtaagtggattaaattttccacttaaaacatagaggctggctgaatgaattacaaaacattacctaactatatgctgcctacaagaaactcacttcacctgtaaagacatgtatagactgtaagtaaagggatggaaaaatatattccatgcaaacagaaaccaaaagcaagcaagaatagctatacttacataaaacagactttaagtcaaaacagtaaaaagacacaaagaaaagttatataatgacaaaggaatcacttcagcaagaggatataacaattcttaatatatatgcacccaacactggagcacccagattataaagcagatattactagacctaaataaagagatagacttcctatacaataatagttgggaattcagtattccactcatcgtctaatgcaactagcattagacagatcatccaaacagaaaatcaacaacgagacattgggtttaaactggactttataccaaatgggctttatagacatttatacaacattttacccaacagctccagagtgcacattcttctcatcattatattgaacattctgcaggatagaacatatgttaggccagaaaacaaatctcaataaatttttaagaatagcaatcctatcagtatcttctcagatcacaattaaactagaaatcaatagaaatcaacaataatttgaaaactatacaaatatatggaaattaaacaacgtgctcctgaatgaccattgactaaatgaagaaattaacatgaaaatcaaaaaatatcttaaatgaaaatggaaacacaacataacaaaatcctcaggatacagcaaaagcagtgctaagagaagtttatagcattcaatgcctacatcaaaaaagtagaaagatttcaaataaataatctagcaatgcacctcaaggaacttgaaaagcaagaacaaaccgaacctaaaattactaaaaggaaagaaacaataaagatcaaatcagaactaaagaatatagagattatcaaagaaaacaataaaaaggatcagtgaaatgaaaagttggcttttttaacatataaagttgataaatggctataaccaaaaattgctataaccaaaggggagagggggagagagagagagagagagacccaaataaaatcagaaatgagaaaggagatattacaactgataccacagaaatacaaaagatatcagaggctattatgaacaactgtattcgaacaaactttaaaaccttaaggaaatgcataaattctggggcatacaacctaccaagattgaatcaggaagaaatagaaaacctgaatagaccaataacaagtaatgagattgaatcagtaataaaaagtctcccaacaaagaaaagcccaggattaatggcttcactgcctaattctaccaaatgtataaagaaggactcactcctcaaaccattccaaaaaatgcaagaggagggaatactccccgacttgttctatgaggccagcattaccctgataacaaaaccagtcaagaacaaaacaacagcaacaaaaactacaggccaatatttctgatgaacataggtgcaaaggttctcaacaaaattctaacaaactgaattctacagcacatcaaaatgataatacaccatgatcaagtgggatttaaaacagggatgcaaagattgctcaatatatgcaaatcaacaaacgtgattcatcacaccaacagaatgaaggacaaaaatcatatgaccatttcaataggcacagaaaaagcattagataaaattcagcacccattcataataaaaactctcagcaaacttgctctagaagcaacatacatcaacataataaaggccatatatgacaagcccatgtaacatcatactgagtgggggcaaagctgaaatcctttcctgtaagaactagaataagacaaggttgcctactttcaccactcctattcaacataggaacaatcaggcaagaggaagaattaaaagcatccagattggaaaagagaaagttacattgttctttgcagacaaaaataattttatatttagaaaaaccaaaagactccaccaaaaaactcattaaactgttaaattcagtaaagttgcaggatacaaaatcaacatacaaaatcagtagcatttctatacaccaataatgaactagctgaaagagaaatcaaataagtaatctcatttgcaatagctgcaaagaaaatatctagacataaatttaacaaaggaagtgaaagacctgtattagaaaaagtataaagtactgatgaaagaaattgaacagaacacaaacaaatggaaagatattccatgtttgtgggtcagaagaattaatattgttaaaatgaccatactacccaaagaaatctgtagattcaatgcagtccctattaaaataccaactttttttttttttttaaggtggagtctcactctgttgccccggctggagtgcagtggtgtgatcttggctcattgcaacttctgcctcctgggttccagtgattctcctacctcagcctcccaagtagctgggattataggtgcccgccaccgtgcccagctaattttttttgtatttttagtagagatggggtttcaccatgttggccaggctggtttcatactcctgacctcaagtgatccacccgcctcagcctcccaaagtgctaggattacaggtgtgagccactacacctggcctccaacgttatttttcgtagaaatagaaaaaataatccccaaatttgtatggaaccaaaaaagagcctgaataggcaaaccaatcctgagcaaaaagaacaaagctggaggcatcatactacctgactttaaagtatattacaaggatatagtaacccaaacagcatggtatcagtataaaaattgacgtatagaccaatggaacagaatagagaacccagaagtaaatgcacatatttacagccaactgatttttgacaaaggcaacaagaatatacattagtaggacagtctcctcaataaatggtactgggaaagctggatatttatatgcagaagaatgaaactggacccatatctctctccacgtaccaaaaagccaactccagatggattaaggacttaaatatcagatcccaaactatggaactattagatgaaaacataggggaaacagtttaggacactggtctaggcaaagattttatagttaagacctccaaagcatagacaacaaaaacaaaaatgtacaaatgggacaatattaaactaaaaagcctctgcacagcaaaggaaacaatcaacagaataaaggcataaccttctgaataggagaaaatatttgcaaactatttatctgacaagggactaatatccagaatatacaaggaattcaaacaactcaacagtaaaacaaacaaacaaacagttccattaaaaagtgagaagggacatgaatatacatttatcagtagaagacatacaaatggccagtaggtatatgaacaaatgtttcacatgactaatcatcagggaaatgcaaatgaaaaccacaatgagatattgttgtatcttacgtcagttagaatggctgttattaaaaagacaaaaaataacagatgctggtgaggatggagagaaaagggaactcttttttttttctttctttctttctgagacaggatctcatttctgtcactcaggctgagtgcaatggtgcaattatggctcactgcagcctcgaccccagggctcaagtgatcctcccacctcagcctcccaagtagctggtactacgggcatgtgccaacacggtcagctaattttttatattttgtagaaacagagtcttgcaatgttgtcctggctgttcttgaactactggactccagtgattctcctgccttggtctcccaaagtgttgggatcacaggcgtgaaccactgtgctgtgtaaattagtacaacctctatggaaaacagtatggaggttccttaaagaactaaaagtagatctaccattcaatccagcagtcccactactgggtatctacccaacggaaaagaaatcatatgaaaaaggcacatgcacacatgtgtttatagcagcacagttccaaattgcaaagatatggaaccaatctaagtgcccaccaatcaatgagcagataaagaaaatgtggccgggcgtggtcgctcacacctgtaatcccagcactttgggagaccgaggcgggtggatcacgaggtcaggtgttcaagaccaccctggccaagatggtgaaaccctgtctctactaaaaatacaaaaatttagccaggtgtggttgtgggcacctgtaatcccagctactcgggaagctgaggcagagaattgcttgaacccgggaggtggaggttgcagtgagccaagattgtgccactgcactccagcctgggcgacagagcgagacgccatctcaaaaacaaaaaaaaaaaagaaaagaaaagaaaaaagaaaatgtagtatatatacaccatggcatactactcagccataaaaaggaatgaaataatgttttttgcagcaacttggattgagttggaggccattttttaagtgaactaactcaggaatggaaaaccaaatatggtttattctcacttataagtgggaactaaactatgagaatgcaaagatacagagtgatataatggacttcagggactcaggaggagaggttggggtgggggtgatagataaaagactgcatattggccacaatatatactgctagggtgatgggtgtgctaaaatctcagagttcaccactgtggaattcaaccatgtaaccaaaaaccacttgtacccccaaagctattcaaataatcatttaaaaaaagttttttagcttcaaacccaaggaaaagttgcataccatttacttacacttgtatgccctttataataataccaattattacatctgtcccatttattatataccaaataattggtataccaattatttgcatctacacttttctttctctctctttctgtgtgtgtgtctgtgtgtgtgtgtgtgtgtgtgtgtgtgtgtgtgtgtgtgtgtgtatgtatataatacttctcggctaggcgcagtggctcacgcctgtaatcctagcactttgggaggccgaggtgggtggattgcctgagctcaggagttcgaaaccagcctgggcaacatagtgaaaccccatctctactgaaaatacaaaaacttagcctggcatggtggcggatgcctgtaatcccagctactcaggaggctgaggccagagaatcacttgaacccaggaggtggagtttgcagtgagccaagattgtgccactgtactccagaagtctcaaaaaaaaaaaaaaaaaacccaaaaaacttctctatatctctttatatcttttaaatctattttaatctgtctatattgtttttctgaaccatttgcaagtaagttgcagacatgatatccctttacttaaaagtatttcagtgtgaattttctaagaacaagaatttcctcttatgtaaccacagtacaattatcaaaatcaggaaatttgatgttggtgcaaaactgtgatctaatccttaaaccatattcagatttcatcaattgcctcaatgatagtctttatagctatttttcttatgctagtgtccagttcacaatcatgcctttcctttgcttgttgtgtctatttactctcttttaactttgaacagttcctcagcctttctttggtctcttttgccattgacagttttgaggaggccagttattttgttgaatgtccttcattctgggtttgtcttctgttttctcatgaccatatgcgggttaggcacttttggcaagcatattaccagaaatgatgatgcactttattggcatgtcatatcagggaatgacattgatgtgtctcattattggtgatcttgactgtgatcaattggtgatgacaaaggtgatggcttccaggttttccagtgtaaagttactgtttttctttttataactaataagcaatcatgaggcgatactttgaaactattgaaacatattgttcctcattaaactttcagttttagcatacattgacaaataatcatgcccaaatcaattattaatataattgttgccaaattgtcccttctacattcattaattggcattctgttataaggagaggcttcccattttccctctcttatatatgtatatacatatatatatatgtacatatgttttagtatggattaattgattcctgtgttattcagtggattaaaatctttgctttcattatttattttgatgttcaaattgtcccagattttgtctgtgagaaccccttcaagctggtccctttgtccttttatcttaccattctttgtgtactttttaactttctaatacaacagtgtgttccaggatcatcttgtactttctctgacatagccatggaaccagtgagtcctccagggaacattgattctttttagtggaaagtgttatttaaaaactcagatacgaggccaggccagtggctcatgcctgtaatcccagcactttgggaggccgaggtgtgcggatcccttgagttcaggcgttcaagaccagcctgggcaacatggcaaaacctcatctctaaacaaaacacaaaaattagccggacatggtggtacatgcctgtagtcccagctacttgggaggctgaggtgggaggaacgctggaccctggaagggcaaggctgcagtgagctgtcattgtgccactgcactccagcctgggcaacacagcaagaccctatctcaaaaaagaaactcagatatgggttctagatatactcattgttactgagatgtaattgcttttaggcccccagaggggacaaagctaaaaaaatttatatttatatatgtggatctgtgatccatttgaagtttattcttatgcatgatgtaagatatgtgtctaattacattttttccaaatggctcagcaattatcctagcatcatttaccaaaaagttcatctttgtctcaatgatttgacatgtcattttattatatactaatttctatatgtacatgggtatatttctgtaccttttgttctattctattggtcagtctatttgtgtgccagtatcacaatgttttagttatagaagcttaatgttttaatgacagtatggctagtcccatctcataggttttcattatcagtattttcctgactaaacttgcatgttgttgtttcatatgaactttagtaccaacttagttccattttaaaaaaagtgatatttttattgagattgcattgaatttataaattagcttagagagaatagacatctttatgctgttgagtcattctgtcttatagtaggagatgtctttccatttgttcaagtctactcttggggctttcagaagtctttaaaaattttcctcacttaggttttgccatttctttttatgtttatctatattttattatctttgttgctattaaaaggaagttttccggttattatgtatgtacagtatttgaaggctatcagtttctgaatataattttatatcctgctacctcactgaatttttactgttgaaggatacatatatatatgcctgggtaacatggtgaaatcccatcttgacaaaaaatacaaaaattagctgcgcatagtggtgcatccttgtagtcccagctgcttgggaggctgaggtaagaggatcactgggtcccaggaggttgaggctgcagtgagccatgagtgtgccactgaacaccagcttgggtggcagagtgaaactctgtctcaaaaaaaaaaaaaaaaggatacatatatatttttactaagactattacttcagaaaagctgtaaaaacagccatatcggccgggcacgatggctcacgcctataatctcagcatttgggaggctgaggcaggcagatcacctgcagtcaggagtttgagaccaacttgaccaacatggagaaaccctgtctctactaaaaatacaaattaaaccgggcatggtggcacgcgcctgtaaatcccagctacttgggaggctgaggcaggagaatcgcttgaaaccgggaggcggaggttgcggtgagccgagatcgtgccattgcactccagcctgggcaacaagagtgaaactctgtctcaaaaaaaaaaaaaaaaggccatatctttgtctctaacagtatagtcagctcaaatctaagtcttcccctgtgaacataaattattttcagatactgtttggtgcttaaggaggcacataatttctttcaagtcatttggagtttatgcagcaagcatagagttgtcattgtacaaataaatgttttccatatagggcccccaaaaatcaactggaaaattctcaaaccagtacttactgagatatttccatgcataaacactgctaggcatttgggtgttgcaacaaaaaaaatagaagatgctgacagcaaagacctccactcaagttgcttagagtctaactcaggaggtaagacacatacacatacacacacacacacacacacacacacacacacacacacacactctctctctctctctctctttctctctccatatatgtatatatttctatacatgtgtaaagaaacttggctggcaattcaaggcattatatagaaagatctaaatgagttagttgcaagataagaagaggtcagagaaagaaggaagagggagaggggaggtttcctggaagaggcagaaccactgtcaggcctagaagcagggacagtattccgagaaactggggtctcaggatagcagttatggggtacttaagacagagaccagataaaagatcatcccagaatggcttcatctggtgagctgtgtgtgggagataaaactggaaacctagactaatttaggtcagatggcgggagatcctgggtgtcaggttagagagcttagactttacttcccttcatcctccattcctcactattattaagcttttaacagttatacttacttattaaaatagagaaccgagtttaagtatcatatagcttcttagatgcaaattatcgtttactagtatctttaactaggggaataaagtaggaataacctggaaattatgttcatttatatgtgattttcctgctttttaaattaatgctttgaagcaactggggcacactttctcccaattaaagagaaatctcattacttactgaagaccttaagagaaaagctgagaatctacagaagtgccttcttttagtgtaaatagtggctcatttagtgccttttagagcctctatttcttccagtatgatttctgccgtgtaagtgtagccaccagcacaaatgaaaaggatgcaaagacatttccctgtattaaagcaatgaattaataaagagagctctgttctggattagttatgcttttaattttaatataaaatagtctctttagaatcaaatgccctgtgggacctatatctagaaggaggaagaatgagcccccaggattaaggctacaaagaactgactgtggtgctgaatgtaaacatcagctgagattaactatgctagtatttttattagtattgttattatttttctttatgtgccgggtagagttttgagtggtccaacccaaccctatttttcttataagccatattattattttttggtgcataatttttgagaatgcaaggattttcaggaaagctaggtggttggttttacaagatagaaaattagaaaataccaaatttttacacaacatagttgatgtaatgtagtaatcatgtattttatttctctggaaattgtatcctcacttatgaaagccagaatactattttagtagcatttatctatttaactttcattgtctgttgacagatgtatttagaaaatcaaagttaatgtaggataacctggtcgagttagcatttattttagtttctgttcagaaggtagcaaatattggtttaaccaaagctcaggggctaagataggtcaaatgaagtttatgagattccatacactttctggacaaaaatctactatactactcttggaaaaataatttgaaaaagacgtttttgagtaggcttaatgttcttaatttagtgctccccaaaagaggagtatgagaaaaacatttaaattttggtattatgttaaatacatcccatgtttatacctaaaatagtcaatgaaattcttttcctgtgtcaatgattatttcagtgattacctggacatttgggaaagttagcaattaatgccaagggttatttattttgtcactggttcagaaatgcctgtttatacaaatcaagacttccagcagcttgagccttctttttctttttgagctggtagagtcaatggttaaaggacaaaaattctacaattgattgagttacaaatgaatacagtgttaattaagccaggccattgtctttaaagtggagtcagtacattggaagtcagatttctcttgctgtttagtcaaactgcctaaggctgcaactgcttccttattaggttactagctttggggagatgtcattgtttgctgctgtagctaggctttctgttaaaaatcacagcatgaggcttaaactgctgcaaccattatccagtgctaacatgtcactaaaggtctgctaatagaacaagaggaaaaatatcaatctttaattttagatcagccaagtaatctgtagcacctgttcattttctctcatcaacccatttaaaacaagactagagtgattctttgatgggcaggctataagattctaatattttttgccttttcttatcagaggaaaatttagactttaagactaaagaatagaaaaaataaactgtaagtacatttcctttaaaaattttatttaagaggtagaattatctgatgtaatccaatgatgactaggttattataaataattttttaaagaataattttgtttaattttctgaaatttactttttagataaaagctaatcaatgaggacataatacactggtccaaacagcaaattttccatagagagcagaaactctttcaagctttagatgacaaccaacttacatttacctattcagatataataaacagaattagaacttagcagctgctagctttcccttacatagacctcaaggctctgtcacggtatggggcaaaattaaagaaaacattgtgtcctgctcttaggagaggtgaaaggattgcttctgcaaaccaccattagcaatgcgagttccaaaacattcccagtgatgctagaccaagtactacacttagcaaataaacatataataagagaaacataaaacttagtaaacctttacagtccccaagtatatccatcttttatttaaattaaaaaatcagttactactctgagcctgtctctttactaggcattgagaacatcaaaatgagtcataatacatgtaccctgctcttcctcgtggaacttatggtctattattgatcctctgtataaaacctttctcagagctagtacacatgcagtttttgttttgttttgttttgtttttgtttttgttttttttgctggtgaggaagttgagatacagggaggttgtgacttgtctatggtcacaagataagtggcagagtaaggattagaagaatccggtgttctaacttctagactcggtctttttttttttttttttaactatatcaagatgaagataccggaggggagaaggggattatgaaggcacagttttaatggacaccttgtagaataatacaagagtggagtgacagtatgggagcctttgattaaaaaattaattctaatgatgaaaatctagaagccagatataatttaagtatcttcaaaaggagggatcatcaactcatttaaaacaagtctacagtgatcctttgatgaacaagctataagattctaatattttttgccttctcttatcagaggaaaatttagactttaagtaagactaaagaatagaaaaaataaactgtaagtaaatttctcttaaaaattttatgtaagaggtaagattagcaaattgcatcttttatatagagagttatcttttgtctataacattcatcagtatctgatcatattcttttggatctggctatcttagactgctaggacacacacacacacacacacacacacacacacacacacacacacacacatacatgcacatacccctatacctatgaccaatttcacatctaagttctgacatttagccctaaaatctccttcttagcccaaagccgctgttggccttgtcctggaaattccaacttttagcattttcttcagtggtcacttgtgtgatgcatctctcctgaggtctacatcagagcaggctcagcctcattctgccacgaccatttccatcatcacaagtacttgatctgtttcacgttttatggaatcgataaatctcatccctaaagagtccagcaggcctttgattcctgacctgacatttgctaatgctattcctgatgacctgccactacggatctgcagcactgcactcttgtgtttgacaacactcataatatgaatcaatattcagcattcagtaagtgagctggggagtcatttcactgctgcaaaaggctgcgttgcccctgggcagctgtcagaaatgggtagttattaatagccctctcttttcacttagcatagtcagtaggggtcaggcatgaaatgatttaatcagtttatgatatctgtgacagagagcacttaaaatgtaatcacaaaatttaggtagaagtgtccctgggctgttgtaatgtttttctcacttaattttccctaatgctgatacagtgtagtgcacactgagagactgaccatacaacaaaatgacatatgagttggtgttggtttcatttctctctcagtaaagttgcctttttagtgggggtttttacttcacaacatagaccacaaatcctaagggtaagtgagtataaatcccttgggttggcttgcttggctctgcaaaatgtgtccaaaatgtgttgaggggtcctgagggtggggaagaacttgattgagcagaaaaatatcaagcttaggttttttgttattgttattttctgtatcctcaaagaaaatgttaatgtgctaggattcagaggacattttccaggtacacaaacctagttgaacaatatcagtagtcttattgggtcctctagcagtcacttggaaataagctcagcagaagtaaaagtaaaaactgttctatgctgatagttggaaagacagtacctcagcagggattggtcaagctgggaattcagggttcaagtaagaagagtggctctaaaaaatgttagatgatgctgacgtggtggtgcatgcctgtggggctactccgaaggccgaggcaggaggatcacctgagaccgggaacttgaggctgtagtgcaccatgatcatgtctgtgaatagtcactgcactccagcctgggcaacatagtaagacctcatctctaaaaaacaagaaagatatgataggtgaaagatgaccctaaacttaaaaggcagtgaaaaaaatcatcacaggtgtaaaagttagcaatgcatggaacaagattagtacaatgtttaggtcttggggtctggaatacccaggttcaaatgccatctctgtactatcatttcctcatttgaaataatacccatttcatagggttactatgagaattaaatacgagcttatgtaatatatctgacacataggagaagttcaaataacattacttctctctttccttatctctaacggcctaaatttggttaattataatgcaaaagggagggcaagttttgagctgaagctgcagtggaaagggatcatcaagacagctgtccttgagtgtccctcctgcagtactgtctctcattggctgcttgcccatcagaggcacactgatcactctaaatatcctggtagagagtggggaaaaacttggccctggacatcttcctgcagatttagggagacagaagaaagaaaaaagcacagaatatgctgagttcagatttgtgattctaatgttaattaatgcttgccttcaaatgggcttagttcttttattcaacaagtatttacttagcatcctactatgtgctttctatgtgctggcaaaatttatgggaacaaccagctcgaagtcccctcctgcctcattcctgactctgttgggtatcataggatgaacattagacaaagacatacgccttctgtgtttctctgtgaatccagagccttaaaagctctggcattgtctaagacccacttatctctaagtgctttggtttgtactggttctttatctttctaagctagaaagccatggtctcacatgaaaccacaagccctgataacaggtgtctcctgtggtaggcagaattctaaaatggcccccaagattcccggccctgctgtacacacaccctctcccaggtatttagccatacgttatctagatactgctgtggaaggattttgcagatgtagttaaggtcccaaatcagttgaccataaagcagtgacattatctgagtggatctgacctaatgacataacccctttaaatctgggtctagaggtcagagacgggaagtcagagacgaagcaggagaaggatttgctggcttgaagatggaggcagctacgtagcaaggaatttttttagctgagagtggcccttgtttgccagccagagaggaaatggggacctcaattctacagctacaaggagctgaattttgccaggaagaatgaggttggaagcagaacttttttagagcctccagatgagaactcaatctggttgccactgttatttcagccttgtgattccctgagcagaaaactcaaccatgccataccagacttctgacctaaagagttgtgaactgataaatgagtgatggtttaagctgctaaatttctggtgatttgttatgcaccgataaaaaactaatacatcttgtttacatcttgcctgttccacatttgtttcctccgagatcagatggaaacatgatcccctttttctgttttcaaatcttatgtctctttctggtacatcggctaagctcttctttctgttggagaaaaatgttctatattcatttgccaaaagagatgattgcaatcttctgaatctggtgaatgcctgaggctctctcaccagtttaccagctctgtccacttctttgggctctctttggtgactaatcactcaagcatcctccttcccaacccctatgggaattctctgccagattactatgattatagttttataatcctaaaaaaaaagacctgaaaatgtacagagtgacaaacataattcaccccaagggaagagaagaacctctctcacacagcaggaagactcagtttttcctgtccagtcacttgccacaatgtcttgaactgaaaaccacaattacttttgcaccaacctaaaatgtatatataattttttttctttttttcttagacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagtaagtaagcctatgtcctacatgatgtctgtaaactccactccctcttagacttacatcctagaacaaagacatagggggcttcttcaactgtggccatacatttttgtcccagacccagcttcattgtgttaaaagtcttggtgttatgtgaagagtgtctttatccatccttccgtcattcagtgtagagttctaggatttttgaaataggatagattcattctgacctgcctgaattgaaagtcatattaaaatgtgggcagggaatcgggaagggaaatgtggagaaaaggaatgtgtgtgtagtcatattcacaaaaataccttgataaagagccaataccagcacaaagaacatcagcatatatgtttttaagactgacagccactgggcgtggtgattcacatttataatcccatcactctgggaggctgaggtgggtggattgcttgagcccaggagtttgagaccaaccagggcaacatagggagaccccgtttctacaaatcattaaaaaaattaggcaggtctggtgacacatgactgtagtcccagctactctagaggctgaggcttaagcctgagaggttgaggattcagtgacctatggtagtgccactgcactccagcctgggtgacagagtgagactctgtctcaaaaaaagaaaaaaaaaaagaaagaaaaaagactgacagtcatgtaagatcacatttacatataaaatgcatatatgtaacatttcttatatgaagatgaatagtaaaggaattaaatcaatttaatttctactagtatagaattaaatgtctactataaagttatcactaagctgagctcttagggagacactgaacccaaggaatttataggctccgtctatcttttttctattccatgtggtgtgagagaagtcagttaccaagatctattgaccatctatccactcttttctgaaccaaaggcatactctaaaagcttgcagtgactggatgagtcaaattctgtcacttcctctttacaagttgttttgtaatgattaaaccagtgatacattgtatcatacattgattgaggaggcatttaatacttaaagtgagaactgttgcaagttatcaaaggaactgtgggtgttctgtatattctctgtatatcttcatagagactgccgagaatggggcttgagactaaagttttaaacaactcattcatgaatgtccatctacctaaacttctgtacacaatatatgacaacttgcaagacctggaaaccagatgtttttaaaattgttttcttcagtgttttattgtaaaaagtctcatctattctacctagccacataattccaggtggtgttctagggttcagggtagagtacgtggcagtaatgtagtcacaagattatgtagtcctgtttaatggggcagaaacccacatctgcaagatctttattctctcagattgctgagacaaagaactggatacggggctttacacagtgtcatgcagtgcgtgggcatgccttctatgtcacattaattgtatttataaatttactccagaaacctgagcatgaagactctaaattctcactgttcaggtgactctaagcagatggcttatgcataagattggaaggattggaagttctaaagggaattgtgcgtgttgccctttgtgttccataggccattaccactgggccttgaaactccctggagttttatgcataagaaagaaagatgtcaaatttgccttcttgagtagttttatcaaggtcacctatgatctgtatttaacatttggttgcaagggagagttcccaacaaaaagatgctggaacacagccagtccattagcattgaggccatgctttcttcaaaacatcctgggctctataccaaagtatgctttttaaatggcagcagtggaaaagatttgtcgaaaactcatgtcactgtagatgaatttgctctgaagaatagagatcattatcagcccagtaaattttgagacatcagagtgaagcactgtactaagtgcttttgtacatgtcacttcacttcatcttcataatagtcctgagaatcacataattattattctcattttacagaagagaaaactgagtcctatatatgacataccttgtatacctatggagagctttcctttgttggcaatattataccagaaacagtttagcttactcagggcgaagtgtaatatgggtttctaacatatagatttttttttagttttcattttttaatagatttagagggggacaagtgcagttttgttacatggacatattgtgtagtagtgaaatctgggcgttgaatgtaagcatcacttgaatagtgtacattgttttacccattaggtgatttctcatctctcatcctcccctccgagtctccagtgtctattattccactctatgcccataggtatgcattatttagctcccgtttgtgagtgagaacactaacctacagtttgaatgtatgttcacagtgatacacaatgatatttcgattgtactcattattacttttgagtcttttaaataaaattcagaagagaattttatttaaaagactgtggctttctcattaacaagacaggcaaactgaaccaattcatttacctatctagtgcttgacatggaggatttaagaaatcctagaaaagatttctaaaatggaagattttacttggtgatctttacagtcaataacaactccaaaatcctggaatcttatgcagatagagtcctttcatacaaaatactgtggcagtgctcagaatctggtgtgaggtctgaggcaaccactcacctccatattttccatttattgagcacttacgtttcaggaaccatgctaagcgatttacatacatcatctcatttaattcttacaactgttctgctaatattatttccattttacatatgaggaaactgagatacagagaggcttaagtaatttgtccaaagtcatatggtatgtgatggtagagctgagatgtgaaaaccagcctgtttgaccatcaagctagcctcttaccattgggctatttactttatttatttattcagccttagggacaggataagtttatgtcatttagtcaggaccctttcccctgataatctttggacaaatcagcaataattttaaaagaaagagacaaatattttagaggaagggaataggataattggaaagaaactaagagggtgctgtgaaagtatacataaggcgaaaggaggcttagccaaagagttcaaagtcagaatgctcccttgtcacagaaattaagtactagatgtgtgctatgatttaaattttcatggcacattaaagtcttttgttgaaaaacctgtaacatcttcagcaagtagtagacactatttaagtacctgtaattgaccaatacgatactatactactggtgttctgttcactgttgacccagaaggccacatgtgtagatagcatatgaaccgtcttcattttatactctgttctctcatacaagtgctctaaagtgacttttaatctctgttatatatagttttatccattaagaggatatgacatcttttcattcagagtgagacacttttttttttttttttgggacagtctcgctctgtcacccaggctggagtgcagtagcgcaatcttggcttactgtaacctccacctcctgggttcaggtgattcttgtgtctaagactcctgagtagctgcgactataggcatgggccaccacaccccactaatttttgtgcttttaatagagatggggttttgccatattggccaggctgatctcgaattcctggcctcaagccatctacccaactcagcttcccaaagtgctagaattacagttgtgagacaccgtacttggccacgtttttgttgttgttgttagaaatgtgctctgagactggcatttcctctctgtgactaatcagcattagatgggaagatagtcaactgttgcattctttttctattctaattattgtcatggctctggtagtatttctaactataattttacactaaaataaaaagaataatttatcaaatgaagctattttagtgaatttaaaatgtatgacatccctctcataaggtagctttgcttggttacttttattgttttgttgagtattctgattctataaaacataacatttaaaaaagaggttgtaggcattaatataatattaagtgacttgcaaataaagaagtatggagactcttaggaggtgggtgcctatttatctctttaaagaacacagttttagaaatgtttgctttatccattatgaccttttgctaactcattcattcattcagtagacatttagtgtctgtatgttcagtcggagttcctggggtaagaattagacattcaaagacaactaagatagagtttatacctttgagaagctgactgttttgtgagggagatagacaagggaggaggaaaatccagtagttagttaaacattatgatagaggtatgcactggatggtgtgtgagcacagaaatcttcctagtaacccagattgcctaggttcaaatcctggctttgccacttgttgactatgggtcttggacaagttacttgacctttctgtgcctcatttttcatacagcccttagaacagtacttgatacacaataaatattcgccgggcacagtggctcatgcctgtaatcctgacagttcaggaggccaagacagaaggattgtgtgaaacctggagttcaagaccagcctgggcagcatagtgagaccctgttcctacaaaaatttaaaaaattacttgagcatagtagtacatgcctatagtcccagttacttgggagtctgaggtgggaggatcacttgagcccaggaagtcaagatcagccttggcaacatagttagaccttgtctctataaaataaaaaataaaaaaattacccaggtgtggtggcatatgtctgtaggcccagctatttgggaggctgaggtgggagaatcgcttgagcccaggaggtcaaggctgcagtgaaccatgatcataccctgcactccggcccgagtgacagagtgagactgtcctcaaaataaaatgaaatgaaaacacaataaatactgcattaggatctgttaaataagatatttaaagcagaatggatgaataggaattaaccagatgaagggcgttctggttggggtgggagtagggaagataggatggttttgaggaaactgcatatatggaaggccttggcaagagggatctcggaactgttgaaaagggtggaaagggggcagcagcaaaagaataaactggagaagtaagcagaaaccatattacacagtcgtgtctgaaaacatggcaataatttacattattcattcaggttcatatttttaccatattttcatggaggatggattggagtagggaaaccagtcagaggctgttgacatggttcagataaaaactgattgagaccttaaactaggggtattggtggtagggatagagaagaagtgaattgattagaaagctgttgaaagtgtgggataagggacaagggacaggtgggagtcagacacatctgacggtttctggcttgtttgacatattgctgaagcagggactacaggaagaacagattagggtgaggatggggagggaggatgggttccattttagatatttttgagtgagtggagcctgtgggacagttagaagagctttcccaataggcctttggctgttgagaaggtctaggcatcaggagagtggtctcatctgtagaaattgatttgggagtcatcttcaaatgaatgtgggttgaagccgtgagagtgggtgagattaagaaaaggaataaagaaagaatataatagaatttaggatagattcctggtgatcactaatttgaggactgggtatatagactgaaacagactgaaaggtaatgcccaaagaggaggaaaaccaggagttgtcatagaaaccaagggaggagaaactttcaagggcaagagagtggccaaccatgtcaaatcctgcagagcttttggttaggatggggacagaaaagtgtccattgaatttagcaacaaagaggtcattattgattttggccagagaggcttccagcagggaagaaggagtggcagccagattgcagtgggctaaggggtgagtgaatgggaggagcagaagtatagcttgtctaaaggaaaatcaagacatggggcagcagaaaggggaatgcagggttatacctgtctgtgttataggtagcatcttcattgcaaagtgaaaggctatttaaaaatacctacaattttttttattttttatttttatttatttacttattttgagatggagtcttgctctgtcacccaggctggagtgcagtggcgccatctcagctcactgcaacttccgcctcccaggttcaagtgattctcctgcctcagcctcccaagcagctgggattacaggtggctgccaccacacctggctaatttttgtatttttagtagagacagggtttcaccatgttgtccaggctgttcttgaactcctgacctctggtgatccacctgcctcggcctctcaaagtgctgggattacaggcatgagccaccgtgtccagccaatttttctttcttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtcttgatctcctgacctcatgatccacccgcctcggcctcccaaagtgctgggattacaggcgtgagccaccgcgcccggccctcttttttttttttaaaggattaatccgctaggcacagtggctcacgcctgtaatcctagcactttgggaggccgaagcaggaggatcccttgaacccagaaatttgagaccagcctggcaagataatgagaccccgtctctacaaaaaaaatttacaaaatgatacaagtgaggatgatgtaagtttatttcagggagaaaatgcacaggaactacccactccctgctggaatgcaacagcatgcaaaagttttatcttttttactttcacctatgtggtttgctttaactcttttcactgaggaaatgccttgtttattaacttttctagacataggattcattcatcattaatgataatgtggtttccaagtattatttgtcagagaaatgtccactagaaatgataatggtactaactgtgtcctctttctgccatcactttaatcttactcatatctctgtgggaggatggagctgaaagataaacctttggtacattttctagttttgtttctggcttttttttttcctatttaaaagtgttagtacattctcttatttgaggaaataaaactaacacatgaaacaaataggaagcaaaaataaacggtgcttaagaaggtagttaattttatggtacaataagggcaggccattggttggtttctttgtttagagggcagtccttttttgaggaaggggaatattagtggaatggtctggtgatgttgctcctcatcttgacctgagggaatgtcttgaacaagtcaattaacttatttcttccttctttcctccctccttcccttctttccttcctcccttcttctatgtgtaaaatagaaacagtaacaacagtaataatctctttagagaagcttgagaaaaaaaggtttctaaataaatagaagaatggttagcaccatatttctgagtccttgtccattttcttgttaccgggaggtgatcactttttgtggagaaagtatttttaagtcacttttttttattttctacatttttctaatttcatgttgctgtttttaaaatataaggaatagacaaagaaggaagtttaagattaaccattgctctctgctctgtatcaatttaggttggtctccactccccactgcgcatgtcagtcagtttaaaatatctgttatcaggaccctgattggcattaaaggaaaacttacataatgagtttcacccagggatgatcaactgcaatactattgtgagttttatttatttatttattcattcattcattcattcattcattcattcattcattcgatgagatcttgctctgtcatccaggctggagtgcagtgatgtcaatatagctcactgcagcctcgaactcctgggctcaagtgatccttctgcctcagcctcctgagtacccaccaccacactcagctaattttttaaattttttgtagagatggcatcttgcaatgttgcccaggctgatcttgaactcctgagctcaagtgagcctcctgccttggcctcccaaagttgtaagattacgagagtgagccactgtgcctggataattgtcggttttctaagagctctattgcattgccccagtttccttggtacttgctaagtttagacctcgggtggaccaatttacatatatgggaatatgcaggaaatgcttttatcatctgttgtatcctcaaaagatagttcctaaggcagaagtctatcttcaatagatagagttcagagagacaaattaattaattctcagaggtggattggataaggaaattgtggtacatatgccccatggactactacacaggcataaaaaagaaggaaatcatgtcctttacagcaacatggatgcagtgggaggccattatcctaagcaaattaatgccagaacagaaaatcaaatgtcacatgttctcacgtataactgggagctaaacgttgagtacacacagactcaaagatgagaacaatagacacttgggactcctggggtgggatgtggaagagaggtgagggttcaaaaactaactattgggtattatgttcactaccttggtgatgggattattcgtacaccaaaccttagtgacacttgaattactcatgtaacaaacttgaatacataccccctgaacctaaaataaaagtctggaaaatgtgtctctgtgtgtgtgtgtgtgtatgtatgtatggatagatagatagatagatagataaacagacagacattatctgtctatctaactatctatctatcatctatctagaatccaaaataaaattaattctcagtttctacaacagatggttcttcaaaggcttagatccactaaagctatccaacttgaacacttttggattagggatgcaacttagtggtggtgctgttttaattaggacacactatttgcagaatcatgaaatgatggtgttggaagggactgtatagtcctctattgcagcttccccttcagttgaggaactcctccgagagcatctgtcacagacttgtgagcatcttcactaataggaagtgcattccttttgaggtggtacacagttaaactgttgcaggtgtgaagaaatgttcttcatcaagagcctatgtgttcctctctgtgataatgtacattctttgctctgctctctagagcaccaccttattttcatgacagtccttcaagtatttcatgacaactctcatggcttttgtaaacctttatttcttcaaactaagaatttctattttacataaccactttttttttaatgtggtcttcagatttttcaccctcttctctaccaaatctgttatccctttgaaagatgtgtcttacacagggtctagttgagcagactagtatgtctgtagagctgaaccctctatctacttactggaggataattatggaggaggggaaagagtctagctcaatgcctgaaacagttattgatttaaatttacataaatggttcatgataaagcattttatgactattcagaatcaagttttttatttgaactgctagcaaactaggtcttgtccaatttgtacatgggacctaattttttgtttaagataaaaaagcttctctatgtttttgcctgcaaaatttcatttgactttgaataatattggtttttaaactcatttttatattgactttgaataatattggtttttaaactcattttatgccaatcaaagtcaattcaagtttttattcatcatctgtattattaactagccctcttgctttggctattgggaaatgtgtaagtttgcctttgaagtcgcttttcaagttgtcagtaaaatatttgaataggctagagctaaacacaacacactgggagtttctgttaggaaaaattgacatccatcaactgacttggccagtttttcttagtcttgtccataagaatctatctgaggcttagttaaatgtcttcttggaactaagagatactctaacatacttgttttttaaaatttattttcttttagagataaggtctcactctgttgctcaggctggagtgcagtggcatgatcatagctcactcctgggctcaagcgatcctcccactcagccacctaagtagctaggactacaggagcataccactatgcccagctaattttttaattttttttttctggagacagtgtcttgctatattgcccaggcaggtctcgaacttctggcctcaaacaatcttcctgccttggccttccaaagtgctgggattataggcgtgagccacggtgcccagcaggtggcatccttctaatgatagactgattgaccagtctaaaaagaaaaaagcatgctctcatttattaatatctaatattatatagtttgaggtggtatatttaagctctttggacaatagttaacctaatctaattttatccttcaaaatcatctgaacaaagcctacctatgcccatctccatttccctggcagctcccccattctttgggatgtctcaaagttactaatattgattttgcacacttgccctcaagttgtttcagaaccctggagtgtaatttgtctaagcttgaaaagttgaattcacttgaagtgacttcatgctgttttcctactatcttacaccttagatgggggctttgagtctttctttttgattcttgttctaccattttcagagagaaaattaaatctaagcaaaacaggaattgataagtatagctgccttcctgtcaccctttattattatgtcatatggcctgaccactggttttgtaacattcttgtttgtcttcttattccaaacaaccttcttataatctttatcatttttttttctttcttcttgcatgcctcagcattctggaatttagcctttctgatactgtgttttgtaagttcctaccaacttggcagcatactcctggtgaggtgaagctcctcaacattactacgtcttaccaaaatcatggttttgtatctagacttagaaatagattatctgaattctccatctagctggtggtttatagtatgtgtacttccacaagactaccattactgttttcctttcttaatctccactttttctttccttctttgtgtttgatttttacatagataaatatattctgaacatacagtttacttattattcatcactatgaattgataaataagcatgtgactttcttttcctcgttgctttcacttgggataacctggtgacatttcccaatataattcttctaagtcatacctgtaggcctttttattaatattcccatttactctcaatcaattcagctagttttttgtcaaacatgttctgctcccttttcaggaggtgaatgatatctcttattaggagtttttcaatctgccagcttaagctatagatagacaacaatattatggggtttagagcaagttgcacttaagacattgatgagggaccttaagatctggtcacattggatcccctcactcatttctgataaagaaaataaagtagatctgatactgctaaatgaacaaggaagtggaattgtctgtaagagtctttgaggacatggatgggtcaggaaaagtcaaggaaatcactaggcgatggccaggtagggaagtgagccatggacagggctggagaatataagagggagaaaaaagtgagcctccattccaagtgatggtgatggtgtgaagcagttgtggtggtggacttgcttgtgacaggtggtgaacttgtgtgaaatgaaaatagaagatcaagctgatgcttggaaactgggtaggaggtttattggggtattctgccaagggctttgtaacttgccacccagctgctgtctttgagtagaaagtcctctagtggtgagccagtgagaggggctaagagccatgtcccccttcccattccactctgtgttctacatcagaatttcaggtccagagcagtttttacaacaaacgaattctatttttcttggcactatccacagtctctgtttacccttctttcttttctaatccatttgcttattataattattattacaacagaagcataaccattaacaacaataatagctagcactttatgagctttcattatatgccgaatataagtattaactcatttaattcacacaacatccctgggaggtgagtattattatttctatttcacaaatgatgaaaccaaggcttagagaggttgggtaacttgcctaaggtcacacagctagtaagccgtgacttcaaagccatgctctcttttttttgagacagaatctcactctgtcacctaggctggagtgcaatgacacaatctcagttcactgcaacatccatctcctgggttcaagcaattcttctgcctcagcctcccgagtagctaggattacagatgcctgccaccacacccagctaattcttgtatttttagtagagacggggtttcaacatgttggccaggctggtctcaaactcctgacctcaagtaatctgcccgcctgggtcttccaaggtgctgggattacaggcgtgagccacagtgcccggcccaaagcagtgctcctaatatcatattcccatctgcctcccctgctcaagaggaccttactctctcagtactggtggtatttgtggtaagatatggagaaaatgataactaagtatgtatttcacaatatgtaaaggttttttcttttttaacagacattacattatttgatctaaccaactcctatgccataactagtgttattcctattttatggaagagaaaaataaggccgagagattaaattaaaacttacaaggtttacttttattgaattaatttttaaattattgttataaaaataatcctacaatcccacaacttagaggtatctactcttatctcttcgggatgtatttcccataggtgtatatacaaatttttgtttctttcttaaaaaaaggattatactacctgtactgttttataacctgactttttttacttcaaaatgtactatgaatattttcagtgtgattaaattttcttctacaatattattttaatagtattattgttttgccttatgtagatattaccatttgtgctcctgacacagtaaaacagtaaagatgataatatcaagggagagtatagtcattagtttctttttttttattattatcccccatactttaagttctagggtacatgtgcacaacgtgcaggtttgttacatatgtatacatgtgccatgttggtttgctgcacccattaactcatcatttacgttaggtatatctcctaatgctatccctcccccttccccccaccccatgacaggccctggtgtgtgatgttccccaccctgtgtccaagtgttctcattgttcagttcccacctatgagtgagaacatgcggtgtttggttttctgtctttggcgatagtttgctcagaatgatggtttccagcttcatccatgtccctacaaaggacacgaactcatcctttttttatggctgcatagtattccgtggtgtatatgtgccacattttcttaatccagtctgtcattgatggacatttgggttggttccaagtctttgctattgtgaatagtgccgcaatgaacatacatgtgcatatgtctttatagccgcatgatttataatcctttgggtatatacccagtaatgggatggctgggtcaaatggtatttctagttctagatccttgaggaatcgccaaactgtcttccacaatgattgaactagtttacagtcccaccaatagtgtaaaagtgttcctatttagagtcattagtttcatattatttatacagttggggttcaaagcatactagttgatcagaactttttttttttttttttgagacggaatctcactctcttgcccaggctggagtgcagtggctcaatttcatttcactgtaacctccgccttccgggttcaagcgattctcctgcctcagcctcccaagtagctggattacaggagcgcgccactatgcccggctaatttttgtatttttaatagaaacggggtttcaccaccttggccaggttagtctcaaactcctgacctcaactgatccacctgcctcggcctcccaaagtgctgttattacaggcgtgagccaccacacatggcctagaacttttctcagagtgaataaaggcctgcattgctattatttgccaagctgataacacattttgtttgtttgtttgtttgtttttaggcagagttttgctcttgtcacccaggaagctggagtgcagtgtggcacgatctcagctcagtctcccaggttcaagcgattctctcctgcctcagcctcccgagtagctgagattacaagcatgtgccaccatgcccagctaattttatatttttaatagagatggggttttaccatgttggccaggctggtcttgaacttctgacctcaggtgatccacctgctttggccccccaaagaactgggattacaggcgtgagctaccacacccggcccaagctgataacactttaaaccttggttggacttggtagtgtcattacatatatgcaggtatccactcttgtctgtaagtgaatttcatgaactaagccaccctgttagggttgtgcaagatgaaaccatagtccaaagagatttccagggctatccactgtttcctcacttggtctgcctggcgttgctgtcatgtgtattcgtgtcctaatttttttctactgggttgagggttcttcggagaaggcatctttctcatctttgtctctcacatttcctagcatagtgctggccaaagggaccccccaagtggtttaactttatattcacttaactatggcaagggtggcttgatggcaacaccttcaaacatttttatccatatacatttgatctataaattggatcaagaatgctcagaaaaagaaataaacattaaaaaaataataaagtaggcaatgtggtgtcctggaaagaacactgaattgcagcaagaagatgtagctgtaaagctttggcactaacttctggagagaacttggtaaagtcacttgacttctctggttctccatctctccttttgaaaaatgaaggagagatgagatacttttttagatccttcccattagtgatgtgtgaggattacgtaatttaatattgccagagtttgtgcttactttacaaaaagcaagaaaaaacttcaggaataaacagattctaaagcagttcttctaaaatttggctacacattggaagcacatagtgagctacaaaacaaaacaaaacaaaaaaacgatgcctggatcctactcagagaatcggatctaagtaacctggagagtggtctgagtctggaattaaaaaaacaaaaaaaaaaacaaaactccccaggtgattttatgtggagccaaaaccactgttttaaaagttttccccattgtcttattcacaagtgatcaattactgggcagggcacaggtattactattttgaccctaaaaataaataggaaggctgactgttctaaagttgatgatgctatttcagatcttttcacacagatgtcacttgccctacaatattgttttgtcatgccacaacatgtgtttgtgtaaccgcacatgcatgtgtacgtggcttgtaaatctgtggggtaaattagatggcgctaaaaagtaattgaggattacaaattatctctaccggctgttgaatattttatgtcaattaaacatttgtaaaaaccaagtatagtattatgatctactcataactattagaagactggcacatctccatacagcaagagccattgctaaggctactgtactactctggcatgaatcataataaattgggatccccctggacataatgaacagtaatataattttgtagttatcctcctagcatgatgaagcagcaagccaaattgagtttctagataaattttgacatatgggtcttattcctaaagaaaaagagctattgttgctttggctttgttccagaattctgcagaaatccacatggtagcttattgttgtattacaaaaaggtactacaagtatttttttatgaaaaagaataaattgctaagttcaattagtcctttggggcagaatttggaatttcttttcagtcaggctgctgggtcgtatgtgaactattgtttgactcacacaggggctgtcctaaaggcctgtgagccataaggccaccgtgggggcttctagttgatggtggaaggatcaagcagccctctttgccacagcagcaaaaaatgatgttgacatcatttaaaaaaaaaattagccataggaaggaggttaagaagttgtggcagaattgaaacaaatctaggcctctcaactgacaagctgagaaccctgcttgacatttatgagtggatgcgtttgaggaattatgtaagaatagtaagttaaaggatgcttttaatttaaaaaattaagataacctgaaaacatacctgtaaaaacatttcagttgacacagtctcttatgcttataacaaggattactgttaatgtgtttttgcggagttgggctctgatctgtaaatatttctcagggagataagagtctatggttaaacagtcgtagtagtagtagcagaatttgggtgtcattgtatagccaaattcagaagcttgggggaaaagaatagctaccataggaaccagtatttcagaagcaagttctgcttgtgagagttatcagttgaccaagggattcctgtgtaggtttgtaaagagtgtcagatctggcattctcagtatggaattactggcatgatgcaatggaggaacaggaatttttctgcagctctttcagtagtattggtttggtgttgggttatccaaataatgctcagattgtcctaattaacattaattcatcccctctgttgggctcatgtgacatatgcaacccgaccatcagtcagtggcgtattaaaatgctctccacaggaccacagagcagtgggtgatctctgcatggacgtgatctttgttgagcaggaatactcatatttctgccctaagcacagagcaaccggctatcaactgggatagaaaaattatgttcattcaggagactactgaaacatcttgcttctctcccatgtcaatcctttgtaatagagtaagggaaaagtacatacacttttgagtaacagtttccatacaaatgctctgatgaaagtagggtcccatttggaggaagctcagttcagggctcagcttgttttctggaagcaaaagactgctattagacagagacagacatgggaaggatgagaattgaaataagataaaaagagaggattttccttgtcaggtttcttctgcagttatgtcttgtcctgtcacgtcctgctagcacaacttttggcagaatccaaaatttgggagccaaactagacattaacaatgtttcttcaacagctcagccatagaagctgatttcaaagttaacagtaactgctctctttggatcgagagtcattcattcattcagcagttatttatcgagtgcttacttagcactggggaaactggtgaatgaggtaaaatgctactcctgttcttatttacaagtaagtactggggaccaaggttaattgtttacttgcagttatgataagggtcgctcttagagcttataataaggagctctaactttgccaggggccagggtgggggtgggtgatcaaagcatgcaaccttgaggaagtaacagttgagcataaatctgaaggatgcactggagagcgagatgaaggagtagggcaaagtgttctaaacaatgggaagagcataggcaaagtcctgaaatgagcaaaacgagcaaaacaagctgagcctgaattgagcttcctccaaatgggaccctactttcatcagtgcatttgcttggaaactgttactcaaaagtttatgtgtgttgtgtcttttgccttagtctattacaagaacttacataggagagaagcaagatgtttccagaccctcctgaatgaacataatttttcaatcacagttggtagctgttgctctgagcttagggcagaaatatgagtattcctgctcagcaaacatcatgtccatgcagaggtcacccacagctctgtggtcctgtggagagcattttaatatgccactgactgatggctggactggatatgtcacataagcctgacaggtagcaaggagattggttttagaggaactgaaggtctaaaaaggccaccctggctgaagcaggtcagcataacaggagaggaaggagaaggggccagactgtgggtccatgagggcacctcatggacatggcaggggtttttgcctttatcctaaaaccaataggaagacattgaaagtacaaagctggggaagtgacatgtgcagcccctgcttacagagggcacaaaagactaaggttagaatagggtgtgggttctgagaggccctgtggaggctagtgcggaagcccagaccacagaacaggaacgagggagatggcagtggaagagaagtggaagcatgcaagctacatttccaagttacaagggtcaagtcttggcttagaagcaatggtggtggttgaaatgtcagtctctagggcagtgtcagaattccacctgatggctctggccatcacatctcagtttctggattgttcgggttaatgctagacaggtagagccccaaactaagtatgtgctctgagagactctgcctcatgaataaaaatcatgctgtcctgtgatttttattcatggaacaattgtacctagagacaactcaataggaaaactattaataactggtgataatatcatctcacttcttcaaaataaatgtttttcattttcaaaagttctaagttcagttacttgcaatatttctgcttacatggtaaaggtctataaatcaagatgcaaatatcatcggcttcttacagggtattatacgaatggcgattttctaggagttatttcactaaatttgcatatgtaatccaatggaatatattcattgcaaatgattctgaaaatcattttctttttttattttaaaaatgagtttttgtttaataaccttacattcccaatctgtgtactgttactattgtcattctccttcagtagtgctgtgaaatctcttccaactctcagattccatgattttcctttgtccctgcctctcttattatctttcattgcatctcttctctcagtgtcctgtctttctctctttgtggaggtagtagctggcatgatagatggaagttagaatgctgaggaagggtagttatcaagggaagcttgggccctagtcatcgccaatcctctttcctctatttcctctgtgcattagcttcaagtgcagtcattactcatttagtcctcaaataaaatgctctttgttgcaatgacaatttttttctagtataaggcaaaatggcatatcagtctgatgatgtggattttatagcaaccggcagattttatttgtgtaaggagtttttatagttgttggttaccttttttttaagttgccatttggatcaaggaggattttatttcttaactaggattattcctttatcggatattaacttagccttttttctctaaataccaaattcatagagatgctacatagttaatttttttctttgtaactagattatccccatatcaggtatttcataaagccaggataaatgtatttaacagaaaatatccatcttataagtaatgtttcccccaaatacaatgaggtccatttaaatgaatgtctgaaataaaaataatcctaatgatagatctaatgcactttgtatcagacccattgagtttctttaaactctattcaataaatgcctgattaataaataatcctgttaaatgaataaaaccccagtgtgccaaacggagacatacaaagcaatcatgatcagacttgttatgggagaatgatagatgaataaatctactgtgcaattaatttatgactgaactatgatgaaatcccagtggcaatactaaatctgttagaggaatagatttatcatcttctttcaaacaattacattccaggaactttacaaaaatactattatctgaatcttatcataatagagatatctgttcatttacatggggaagaattccttctgtgccgtcagagctaaattagtgtttattatttttgatgctaaccaaaacagaaacaatataggacagaaactactaatgtggttagctattcttatctgcttctgtttcttcaaacttgattaaaattgcctaatttttagacagtttttttgtttgaataattttactttttaaaagatgaaaagcaaacgaataaaaaacaggttataggctattttgaaagcaatctgtgttacttcataatgtggttacatgtaggttatgaaggcacaaatttggggaccatgttttaagaagatcattggggattggtagtatttcaggttattgttacatattttagcttcaaaagacagtcgactgtattttagtgctgtcgttcttttagacaggcacttattgataccaaaaaacaccacgaaaagtaaaaaggaaaacccaaaccacaagaaacattttgatttaaaggttagatagtctgaattcatgagaacttagattcagagcatggcaaggttaaaagaaattttattaggatcaagacacaaaccatgtttaatgcagtctttttgttttgggggaactagagctgatattttaaatctagtcgtttttaccaatgtaagggaatttaagagataaaatttgaatagaaaggtaagatttgtatagtgattacaaagatgtgacctttaacagagggttttgttgtgtttgttttccacataaaagaatgaagaatttgtgagggtgaggtaaaagagaaggggtctccttaaaacttgagagaaggaaagaatttgtcccattgtagcaatatttgaaaacaggttttattaaggttttaatatgtgttgaagtaaataattatgcaaattgaactagaaacttcttagtttaaatctagtctgctatttacagtgttagtagctggacatcatacttttttaaattaatgtaatattgataaatagcaatcctgtgtattctcttatttctcagacttaataacaaagactttataaatccacatatgtagtgggtttcagttgtttgcacgttattcatgaccaatattatgtacatagcattgttctaaggccttctttgatctgatcttgggtataaagaaacaaaaacaagccgggtgaggtggcctatgtttgtagtcccgggtgccctggagactgaggcaggaggattgcatgaactagggagttcgagaccagcctggtggcaacacagtgagaccctgtctctaaaaaataaaaattaaaaactaaaaaagagacaaaacaaataacagttattacttgcagagcttatacttgagatgatattaacatatgaaataacaaattcgaacactgacacatcactcatttgtgaactaccttcatgaattattaccaaaaatcctattttaaaatattttttatcatggtaaaacatatataatcttttacgtatcttaagtatacaattcagtggcactaagtatatttatgttgttgtgcaaccatcaccaccatccatctctagaactttttcatctccccagactgagactgtacccattaagcagtaattctacaatctccccttctcccagtccctggcagccaccattctacttttgtctctgtgaatttcttttttaaaaaatttaattcttttgtagagacaggttctccctgtgttgcccaggctggtcttaaactcctgggctcaagcaatcttcccatcatggcctcccaaagtgctgggattacaggcgtgagctgccatgcctaggctctatgaatttcatataagacgaatcatacagggtttgtcctttagtgaatgacttaattcacttgagataatggcatcaagattcatctgtgttgtaacgtgtcagaatttcattcctttttgaggctgaatattattctattgcatgtatatattaatactatattttgtcagtccatttattcattgatggacatttaggttatttccgtctgttggctgttacgagtaatgctgctgtggacacaggtgtacacatgtctgttggagtccctgctttaattttttggggtctatctctggaagtggaattggctgttatgagtaatgctgctatgttggctcttatgagtaatgctgctgtgttggctgttatgagtaacgctgctatggacacaggtgtacacatgtctactggagtccctgctttaattttttggggtctatctctggaagtggaattgctggatcatatggtaattttatgtttcattatttttaggaaccaccatagtgttttccacggtggctacatcgttttacattcccaccagcagagcacaagggttccaattgtatctcttgtggtttttgatttgcatttccctaatgattaggaatgttaatcttttcatgtgctgtttggccgtctatatcttagtaatagtaatcttttcgtgtgctgctattactgttagtaatagtaatcttttcatgtgctgctattagtaaaagtaatcttttcatgtgctgtttggccgtctatatcttagtaatagtaatcttttcatgtgctgctattactgttagtaatagtaatcttttcatatgctgctattagtaatagtaatcttttcatgtgctgtttggccatctgtatattttctttggagatatgtctatccaagttctttgtccagttttcaatcaggttttttgttgttgagttgtaggagttctttataatattatgagtagtaatgtcttgttagatatatgatttgcaaatattttctcccttcctataggttgctttttcactctgtttttttttagtgtatattatcttttatttacctatgtagtgactttaatcagtgctcattatttctttgtgtggattccattcattctgttgataatgtcttctgatggacaaaagtttttaattttgatgaagtttgattttttaattttcttactgcctgtgcttttggtgtcatatatagttttcattttgtagtttcctttaagtcttctggcttttgtgttttgttagggaggccatctacatcataagattataaaaatattctctgaaattttcttcaaatactattgtaatttttttaaacatttggttctataatctcatctggaatttagttttgtgtatgatgtgaggtaaaattccaaatttattttttctatgtggatattcatttgttcaaaccaaatgtattagtttattttttcttcactgttctgaaatacaacctctaccatatactgtatccacatatgtaagtatgtctatttctgaatactctattatgtctcactgatttgtgagtttctgctttaattattttatagttatgttttgatttctgatagggcaggtcccttctgattattctctgtaaattttttcttgagtgtttttatttattcttccagatgaacgtttgaatctacatattggatttttagaaatacagtagtatattacagtttacccaggatttgttttaatcaggtttggtaagacatgcagacgtggacataattatcatgaaggaaatgtttagacttatatatccctagaaacggctattatacaatgccactcagagccacatggggaagaccaagattgggcaagaggcagaaccagggagcatggcccagtgcctttattggggttttcacaggatcgaatgggtgaggtagggtaggtatgttgaataagtttaggattggagagtttgagtaattttggtgggctctgggttatagctgcggcccctaattatctgatatctagccctaggcagatttaggctggcaggaatattggcttggtgtgtgagagttagttacaggagatggttggggatgtgtggtctggattggttgacttaaatatcaaaggtgcacttgcaaagaaatcctttgtcttctctaggaattagctagccctgagaggggcaatctaagatgaagactccaaaatgccagagtatcaagaatacagggggaaaaaaaagtcaaaacaagctatgattttttttttttgactgaggttgcgttgacttatagagtaatttgataatgaaatgacatcattactacagagtgctcccatctaggaaaatgatatgtcttattaattaattaattaattaattgagatggagtctagctctgtctgccaggctagagtgcagtggcgcggtctcggctcacagcaacctccatctcccaggttcaagcaattctcctgcctcagccttccaagtagctgggactacaggcatgagccaccacgcccagctaactggctattttttcgtttttgtatttttagtagagaccaggttttaccctgttggccacactggtctcgaactcctgacctcaaatgatccacccaccttagcctcccaaagtgctgggattacattgtgagccaccatgcctggccatgtttctccttttatttattttttattttattttattttttgagacagagtctcactctgtcacccaggctggggtgcagtggcgcaatctcggctcactgcaacctccgtctcccggtttcaagtgattctcctgcctcggtctcctgagtagctggaattacaggcacataccaccactctcggctaatttttgtatttttagtagagatggggttttgtcatgttggccaggctgatcttgaactcccgacctcaagtcatcctcccacctcggtatcccaaaatgctgagattacaggcatgagccaccacgcccagcccttctccatttatttagatattcttttatattttcagtaacattgcatatttttcttcacataggtcttgcccattgttgttattcttataaatattcctaagatttttatcgctattctttttttctgtatggctttaccaaacatgacacccttacagatcttgttcaatattcaatcattcatttattttcccagaaaatatttgttgccaggtgcattggctcacgcctgtaatctcagcactatgggagactgaggtaggtggatctcttgagctcaggagtttgataccagccttggcaacatggcgaaaccccatctctctactaataatgcaaaaattagcttggcattagtaccagctattcaggaggctgaggtgggaggattgcttgagcttcggaggtcaagactgcagtcagccatgtaactgcaccactacactccagtctcggtgacggtgagaccctgtctcaaaaaaatttaaaaaattgttaagtgcttgtaaagtatgagtgagactctaaggtagccactaggcagtccccttcctagtgacttattatatcctgatctgggaaatgttgaacatagagagggcacaggtggtgaaactggtctcagagaagttgagaaaacatgggttcaagaacgcaggtgggaggctgggtgcagtggctcacgcctgcaatcccagcactttgggaggccgaggtgggcagatcacctgaggtcaggagttcgagaccagcctggctaacatggtgaaaccccatttctattaaaaatacaataaattagccaggcgtggtggcacatgcctgtaatcccagctactcaggaggctgaggcaggagaattgcttgaacccaggaagcagaggttgcagtgagccgagattgcgtcattgcactccagcttgggcaacaagagtgaaactctgtctaaaaaaaaaaaaaaaaaaagaaaagaaaaagaaagaacacaggtgggagaaaggagaaacagaagcaaaggaagacacagggaatctgaagtagagtatagaagttgtgagacatagtgttcagtagcctcaatatatttcaataacttgggaagcagtcatctgctaaaaatgagagggcagggacaagtcttcctggtggagaataatttgttgtaataaaagcagcttgttagattacatgagggtccagcgtgaatgtgatcagtggtcaaagtcaatgtgattttgtgacttacactgatagcattcagcaaccacaggagtaggtgaggacagtgtggttggtgagattattcaggtctgaggagtggcatgttaggattagtgagagaaaggtcaaaaataaaagtaagtgtgctgtggaggctagagtgctaccatttgctcagaaatagcctcacttgcacagttttaaaaatgcaactcaaaagataattattgacaattaaatagccccatggcttcaacactaatcataacaaaacaaaaatactgcaaggaatgttcattcattccatttttgtggaaagaatacctgtgttagatgctggaactgttttcaaggagctcatttctaaaaaatttactttcttggaccatttatccaaagaagaaatgccgtttcttcaaagatgtgtgtttttcaaatctgcactatcttctgtaagcattctggttaaataattccccaggataggaaagtcactttgatgctggttgtacaagggaaatgccatgaattcccagatgcttttaaaatacaggtgggttataaagacaaaggtgatgcaacttgttgaatgtctcatttttaaattataactttcaaaggagtgaaggacttgccatcccaaaatatgtcaaactggcatattaattattttgaaaacattggagaaattgtagtttcagaaaggggtagctgacctgcatgcagcaagccataaagcttcttctgtggctcatgcctgtaatctcagcacttcgggaggccaaggcaggaagatcgtttaagtttaggcattagagaccagcctaggcaacatgatgagaccccatctctacaaaaaatatggaaattagccaggtgtggtagtacatgcctatagtggcagctacctgggaggctgagatgggaggatcatctgagtctgagaggtccaggctgcagtgatctatgatcacaccactgcactccagcctgagagacagagtgagaccctgtctcaaaaaaaatgaaagaaagaaaggacggggagggggagagagagggagagggagagggagacagagagggagagggagacggagagggagagggagatggagagggagaatattcctttggacgagatcctccctttactagagccaggaaatagctcttatcaaccagaggctgggaacagggggctgcagtggacccaattaaatatattttccaaagtaacccttatcttctactagttttacaccccgcttgtatctcctagtgactcccctaggaatttattgcccgtagacagatcgcctttgtcctatcatttcttcttaagtttattattcttcatccaaaaagtataaaagcatcttgctttggccacttcttcagacttcactctcttgtgaagatccccatgtacatgtaaaactaataaaatgtgtatgcttttctcttgtaaatctgccttgtgtcaatttggtttctagatccagctgaagggcccacatgagagctcaggcgggttggaggtgatctctcattacctacacgttatataaattcagcataggaataatggttgagggtaaattaacattgttaaaaagaatacaccgtaacataaagtactttaacatttataatatgagaccatttattaaagaaaataccattatataataatgaggctaataatttcatatggaaataatactgtattaattcgatgtattcatactaacagtgaacatgatattttaaattttgctgtcacataattatgctgctgctttatgaaatgttatactgtcacctagaaaaacccttatttgagtgtagatctgcgatcttcagcctcatatggcaggttgtaatgtgttactgaggtatttttaagtgaagaggtgggaaaaactcctggctgagtcataaaactgaggattctttctttcctaatctgcctggagcaaagctgtctaggctaacactggcctttagcaaagaactgaaacactttcctagttctacaaggcaaattgggtaatgggatgtggtattgggtaatgggatgtggtgttaagtttggaatgaggagatatcttagggttgtgagtcatggtccgtattatttttaagttgttgcttaaaaataaaaaagcaacaaaaagcaatcaaagggaaagtgagagttagaagaagttgaagaccaaataattttgtactagtcagtaaatagtagtattgtgactacaaatgactatttggtacaggcatcttaactcctcagctctgttagcactgattaaaagtgaaaaagttgattcattgtgtattggaataaataatgtctcaaagtttacgcagtggtggaagtgaaaccaaaatacaaagctccatttgtgactgaagtttgctaacatttcaagaagtaggttgaagtgacagtgggtaataggaaaagcagacatatttctttgccatgagattttatagctgtcattggcagtgtgttttcttaaactgatatcagctaccatttatacacttaacaatttctggtcagattagggcagaaggttgtggtacccacatatataaaatagtataataatgttctattttttttttggaacaaatttgttacatgaaatgtcagatgagtcattttgctcatgtcaggtatttaaaagtaatggaaagatgccaacatggaagcccagtaattcatgcgctggtgtaatggagcaaatgaaatgcaaagctcttgtacaggtccaatttcagcaccaaacgcttacctgtcagtcagcaaaattgtccctgaataaaaatgaaccccatctgagaggcaaagcattttaatgtacatcacattctttgactctattgcgaggtagaagctgcatggaaagaaagagaatgctgttgaaaaagacatttaacagcaacctctgagcatgctgaaaatctcactcgcattactgcccacaaaaggtttttggtttgccctttctctcctgagctattgacaaactcttgagcattgctgccctccccggctctgtgtctcttatctacatggaaaggcagctgatttactccagacagtgagagatttggccactcagggatgtggagaccaagttttagacaggtaactttattgctgcctgggtgcagctgggggatgtatttatggacgtgacaattaaaagtgtgtgttgcacaaatcgaaagtcagacatacccttgtataaatgattattgtggtccaaagtgactgccatttcttttggaaagcctttcatttggaatcagttcccagttttctatatgagcaagcatcttacagaaatgaggtgtcctagttttttttagacccaattcctgtggtttttaaaaagcaaatgggaaagttaagaatttgtgtgcttcagtgcccacgcacccagggattcttgtaccctacctctaggagtcatgatttgttctacctttgaaatgtctgttttccatttctgtgttttaagactctaagtgcttataggaacccaagcagctattgaaaaccagtaatgactagttcttctaaatgctaatgattgagaatgaactagcaatcagggctcaaaaataaaataaaataaaataaagtaaaataaaataaagtgtgctgaattagaaacgataataattaaatcaagccaaggtgccctatacttatgactgcactaatgcttgaaaaattatgagtacagagaaaatttacataaatcctctttaaatgatgtatgtgaaaaaaaagaaagaaggaaaaaccatggtcacaggactgaatttattttaatcccctggttcaagtggtcctagaaataatcatacttgtatcaatctatattgcatgacttttgtaagatgtgaaaatagtgtttttcactaaattgtcacttattattgttcatttagggccactaacatagaaaaatttctcagctacagtgtcaaaagaatagggacaatttgatgttttcttttgatgctgtttgttgatatctagaccactgtagcttgattgcctaacattaaacctataataacagtgcaatcatagcagtatcatcatgaatgttgttacaatagaaacaacatttacacggcttcagaatggtaattatcaaactttttgtcatgaagcgcttatttgctagcattgatctgccccggtcagttgttagctcttctcatctgaggtgtattgattgtataatcagtagatagaggctgtgggcagatgaaattcagtgttgttgggcaaattatcggctgcttgcctgttgacctggaccctgctggttgtaccttagatgctggtgggattattactcatttcagtgaccctactttatgacagagcactctgtattattataaaagataaatgccatcctgcttgctgtggttgtggttgactacacaaatgtcagaatatagctagtctgcaaactaggcagtgcaagtatgtttccgatgagatcaaaaggagaaattttcaaagattaccttttctgaatttgtctctttgtaagaatgtaataacaaaaagcctatgtgtatctagctgatgataataatgaaacctttatgtatatagctgtttatcatgtgctaaggattatgacaaatcacttaatattttgttttaccagcaagaacactgaagccgacattaagctaagcaaatgggctaagatcacatgtcaatgagcagtagagcttggaattaaatctgtttcttctgaatacaagtcaagtttgttatattctactgctctgtcttattaggttatccaggctgaccattaaatatgtgtatactgacagatctaaggtttcatccaactggattaaaaaataaagacctcaatgttacttaaataaattattgcattgggtaatttttgagactatttgagctattaaataattataacattccaaagcccaaggtctaacatgggattacttttatagacaaaatcattttatataaagagcactgtaaattttatagctggtggctgtttttaaaaaatctagatggtttttgccgggcgtggtggctcacgcctgtaatcccagcactttgggaggctgaggcgggtggatcacaaagtcaggagttcgagaccagcctggccaatatggtgaaaccccatctctactaaaagtacacatattagccaggcgtggtgccgcgcgcctgtagtcccagctatttgggaggctgaggcagatgaatcgcttgaaccatggaggcagaggttgcagtgagccaagatcgtgccgctgcactccaggctgggcaacaaagcgagactccgtctcaaaaacaaaaacaaaaactagatggttttaacagaatgttttgtttatatgaaaaaattctcaaacgttatttatgttaccatgtcctattttccttgtactttaggatcattctatccatcgtaggtaagtacaggatggcatcacatcctaatacctaaaccgggcctttctgaaactacatggaagaacagaaagaatgtctttagtctattttgacatttagattgcttcacaaatacatatatgtgaacttgacagtgttcacagtgtcatttttgctctttctctctgaaaagaaaagagcataaaaaggatgtacctcactaacagtgcaatgccataaaaatattaatgttttggtgctgatcattcaaattcccaaatagtaaaatagatgaagcgatacttaaacataattctccatttctaaatgcactcagttgtgcctggtaagctgtctcattctttctgccaacttctgggccattgttttataaaggtcagtggttacctgctcattgtattttaaaggcacactcacagcacatagtccaataagcaagtccagcaataccacattcctctttggtcttaaattctgcagctgttgaatcatgattgggcaatgattttttttcctcctagttaactactttatgttcttacttttaaaagactaagtgactgatctcttacccaaaatgttggaggagataatgggtggagtacatgaaagttacatgcagaggtggcttagagttgagatatttagtagtttccctctctgtgaataccagaaaacacagctgtttgagtactcccttaacattgcttacctaagcaggggaaataactaagaaagtgactcccagtttctagcattgtaagcttttcgagagaagcctaaatttgtgtgtatattcctttcctttatcttttggctgctgaaatacatactatcagcatagtatttcaacaaaaatgatgatcttttttggaaattcgaattgttctgatactccccacaaaaaacccttaaaatacatataatacataatagtcattatttgggtattgatcctattatactgttagctcttcacatctgacctattttagtatttcctgcattgctcactactatgctttgtgtatagaaggagctttattgattaaaatggactggatattcattcaacaagtatctattggatgcctactagctatgaggcatggtgggagccatcagatacagtaatcaatgagcaagacacacacacagtccctgctctcaaagagctcatgatgagaaagatgtaagacaggcattaagtgaccagttacataatttttaatgcaagttttaccttaatattatatgcttaaataaaattcaggatgttagaggattcttcaataagaaatcagatcaagtttatgcttctccaggacagggacctttaaaaatcaacacttaaaactcaattttttgcacttaaaaataaaatgaggctgaggaccatggctcaccctataatcccagcactttgggaggctgagacaagaaggtttcttaagaccaggagtttgagaccagcttaggctggtctcatagggagattctgtctctacaaaaaataaaaaaatagctgggcatggtggcacacgcctgtagtcctagctacttgggagggtgagggggaaggatggcttgagcccagaagttcaaggctgcagtgagctatgtttgagccacagcaccgcatcctgggcaacagatcaagaccctgtctctgaaaagaagaaagaaagaaaaaagaaggaaggaaggagacaaaaaataaaatgcacacattgcaagtgtacatttcaatgaatttagacaagtgtatacaaatatccatatgtgagtgaataggtagagatgagtatatatgtatgtataagcatatacatatataactgtatacatacccacacatcccctcattcaacatacaggatatttacatgacccagaaagcttcctttgtgctctttccttgagtacaactcatcattttccccaggctcctggattgtttttcgagtttcagataaatgaaatcacatagtatgtactctgtgtctgacttcttttgctcagcctgatgtttctgagatccatccatgttcttatgtgtatcactggtgttttccttattattactgattagcattttattttatagatacaccacaatttatttattcatttatccactgactgacaaaaataaaccttaatttattgctcataaggtaagatgaaagaagtggtacatttttatttatgagctgtgaaaatgtactagaggacctgggatattaccttatattcaccacatatgaatagtgttggcccacactgaagtaatttttatccccaaatgagctataaagacatgtcccacctgaaaaaacagtttcattgataatttatggataatataaaatgcttcctaagttgttgagtagaatgctgaactaacaggtaaaacactaaaattaatctgattctgtgtattgtgggctacttacagaatgcaacaattatttttggaattcaaattcaagtcaaaaaatatttatgaatgtctgctatacataaagcatggtattcagttctataaggcaatagaagataagcaagatggagttccttccttggaggtctagtggcctaaagtgggaaattgggtgtctgcatgaaataattaaaaaaaatagtaggccgggtgcggtggctcacacctgtaatcccagcactttgggaggctgaagcgggtggatcacgaggtcaggagatcaagactatcctggctaacgtggtgaaaccctgtctctactaaaaatacaaaaaaattatccgggcgtggtggtgggcgcctgtagtcccagctacttgggaggctgaggcaggagaatgacatgaacccacgaggcggaggttgcagtgagccgagatcgcaccactgcactccagcctgggtgacagagcgagactccgtctgaaaaaaaaaaaaatgtaaaaaggcttgttgattaaaccaaagtagttttagtgcccagctttttaaaaggggagtaaattatacctcctataagccagtcaagttaattttgatacctttaaagattctgcactagatgaaatcattgaacaatcaattagtcaccacataggagagcatgaagcactgggtagtcactgtcttggctttgcaaagagcaaattgtaccagatcgatttaatttccttcatgaagagattgacagtttatacatacatttaggaagcaattcagctgaacttcagaaaggattttgattcagccacacatgacattttagcactaactcaaaggatgtggtgtaggccagaccatattcctgtaggaagtggcctgcttctctggggggttatatttgaaaagtgttatgaagggcttagtgtcaaccatgaatcttgttttataaatacatatccaaatgctggagttattctgaatttctgtgtcatgcataaataattgaaaataaactcatatgttggcaaaggaaaaccttgatatgagtactctggaagattgttatagattaaatgaaatgatcttaaaccataaaagtgacaattgtgtactttatgaagggctgtaagatcaagttcaagtaacatgctatggtgatcctacgctttaccaaagatagatggaagatgggaacagctaggccataaataagacaagagacttaggagtcatagtggaattcaatccatatattgctgatcaattctgtgttattatttataaacaatgcataattttagagtgtgtaaaggggaatatgatttgcaagcatatggagcccaaaggtcgttactctgcaatagtcaattttaatcacaactctcagactgttctaattttacactacagggaagctagagggtccagagaaaaacattctaaatatacaagaagataaataaatgtttctttaaagttcagactagagaagagagaccactcttcaaatcgtacagaggtatgtacagaggtacgatttgcctattctgtttggaaacagaataggcagccttctgcccaaggtggcataggtgttaaaggcttggtttagtttaagggttccaaaatctgatagggtttcaggatcacttggatagaattttttgaaacacagctttattgaagtataattgatttgctatacattgcacgtatctcaagtgtacaatttgataagttttaacatatgtatatatatatatatgttaaaaggattccctatttaatgaaactattaccacaatcaaaataatgaacatatttatcacccccaaaagttttcccctgctcttttgtagtccttcctacccttccctaggcaaatattatctgctttctctcactatagattcattttcattttctagcatttatgtaaatagaagcaaacaaattgtattctttttcatcaggcttctttcactcagcataactattttgagcatgctttcactcagcataattatttatatttaattcttgcatattgtagtgtgtttgagtcttccattccttttttattgctgagtagtattctgttgtgtgcagttatatgcagtatatttatccatttatccattgatggacatttgggttgtttccagctttgggttattatatataaagctgttgtgacatttatgtagaatcttttatttagacatatgctcttatttttctagagtaaatacataggagtagaaatgcttagatcatgtggtaggtatatgtttaacttttaaagaaactgccaaactgttttccagaggggtggttctattttacattgccagcagcagcatgggaaaggtctgtcaacacttggttggtgagtcctttccattttagtcattctagtagatgtattagaatctcattgtggttttaatttaaacttctcaaatgatcatcttttcattgcttatttgtcatctatgtatcttctttggttgagtgtgtattcaggattttttttgcccactgttaaatttgataatttgttttcttgttattgaattttgagaattctttattctgaatacaagtcctttagcagattctgatgagaactgcattgaatcaatagcttaatttgggaagaagtgacttcttaacaatactgagtcttctaatcaatggacatggcagattttgctgttattttaaattttaaacttctttcagcaatattttgcaattttcaaagtacaggttttacatatcttttgtcagatttacccctaagaattgtatattttttaatgctattgtaaattttatttaaaaaatttttagctctccctctccctccccctccccctccccctgtccctctccctctccgtctccctctctctccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttccttttttttttttggtggagacggggttttgctgtgttggccgggctggtctcagctcctgaccgcgagtgatccgccagcctcggcctcccgaggtgctgggattgcagacggagtctcgttcactcagtgctcaatggtgcccaggctggagtgcagtggcgtgatctcggctcgctacaacctccacctcccagccgcctgccttggccccccaaagtgccgagattgcagcctctgcccggccgccaccccgtctgggaagtgaggagcgtctctgcctggtcccccatcgtctgggatatgaggagcctctctgcctggctgcccagtctggaaagtgaggagcgtctctgcccggccgccatcccatctaggaagcgaggagcgcctcttccccgccgcccatcgtctgagatgtggggagcgcctctgccccgccgccctgtctgggatgtgaggagcacctctgctgggccgcaaccctgtctgggatgtgaggagcgcctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggagggggggggtcagccccccgcccggccagccgccccgtccgggaggggaggggctcctctgcccggccgcgcctactgggaagtgaggagcccctctgcccggccagccgccccgtccgggaggggggggtcaggcccctgcccggccagccgccccgtccggagggaggtgggggggtcagactccctcccggccggccgccccgtccgggaggtgaggggcgcctctgcccggccgcccctaccgggaagtgaggacccctctgcccggccagccgccccgtccaggagggaggtggggggtcagccccccgcccggccagccgcccagtccgggagggaggtggggggtcagccccccgcccggccagccgcccagtccgggagggaggtggggggatcagccccccgcctggccagccgccccgtccgggaggtgaggggcgcctctgcccggctgcccctactgggaagtgaggaccccactgcccggccagccgccccgtccgggagggaggtggggggggtcagccccccgcccggccagccgcccagtccgggagggaggtggggggtcagcccccgacccggccatccgccccgtccgggagggaggtggggggatcagccccccgcctggccagccgccccgtccgggaggtgaggggcgcctctgcccggctgcccattctgggagggaggtgggggggtcagccccccgcccggccggccgccccatccgggaggtgaggggcgcctctgcccggccgcccctactgggaagtgaggagcccctctgcctggcgagccgccccgtctgggagggtggtgggggggtcagccccccgcctggccagccgccctatccaggaggtgaggggcgcctctgcccggccgcccctactgggaagtgaggagcccctctgcctggccagccgccccgtccgggagggtggtgggggggtcagccccccgcctggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttacatggattaaaggcggtgcaagatgtgctttgttaaacagatgcttgaagtcagcatgctcgttaagagtcgtgtcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaagaaaaaaaaaaaagaacgaaaaaaaaaaaattttaatttccaatagtttgttgctggtatatagaaatacaactgttatttgtgtattgaccttgtgtcctgcaacctcactcaacatacttgttagttctagtcagttttctgtacattccatcaaattttccacatggacggtcatgttgtctgctaatattgacattcctttcccatctagatgccttttatttcttttcttcccatactgcattggctagaacctctagtatagtgtttaatagaagcagcaacagagaatatctatgtctatgggggatattggtctgtagtcttctctttgtctttgtctggtttttgtattggagtaatgctttcttcattaagtaagtcagaaaatattcttccttttcagttttctcaaagagtttgagaaagaattggtgttatttctccttcaatatttggtagaattcaccagtaagccagctaggcctagaattttctttgtgggaaagtttttaaactacaaatttctgactttttaatgattgccattctatctggcgtgagatggtatctcattgtggttttgatttgcatttctctgatggccagtgatggtgagcattttttcatgtgttttttggctgcataaatgtcttcctttgagaagtgtctgttcatgtccttcacccactttttgatggggttgtttgtttttttcttgcaaatttgagttcattgtatattctggatattagccctttgtcagatgagtaggttgtgaaaattttctcccattttatgggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggagtcctttccccattgcttatttttctcaggtttgtcaaagatcagatagttgtagatatgtggcgttatttctgagggctgtgtcctgttccattgatctatatctctgttttggtaccagtaccgtgctgttttggttactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggttggcattgaatctataaattaccttgggcagtatgaccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagtaaagacttggaaccaacccaaatgtccaacagtgatagactggattaagaaaatgtggcacatatacaccatggaatactatgcagccataaaaaatgatgagttcatgtcctttgtaggaacatggatgaaattggaaatcatcattctcagtaaagtatcacaagaacaaaaaaccaaacaccgcatattctcactcataggtgggaattgagcaatgagaacacatggacacaggaaggggaacatcacactctggggactgttgtggggtggggggaagggggagggatagcattaggagatacacctaatgctaaatgacgagttaatgggtgcagcacaccagcatggcacatgtatacatatgtaactaacctgaatattgtgcacatgtaccctaaaacttaaagtataataataataataaataaataaataaactacgaattcattttttttatgggtactgcaatattcaggttatttcttcttgaataatctttgatagttggtgtctttcaaagaacttgtgccttccatttcatctaagttgtcaaacttactggcataatgttatttataattttcctttattatctttttaccatctatagaatctatagtgatgccatctttcttatttcttacattggtcatttttgtcttttctatagctgtcttggttatcagattaatggtcctcagtgcttgggttcaagtaacccttattttacttaataatggccccaaagtgcaagaccaacgatgctggcatattgttataattgttctgttttattatgttattattgttaatctcttatactatgcctaatttttaaagtaaactttatcataggtatgtaagtataggaaaaaacatagtatatacagggttcagtcctatctgcgatttcaggcatccactaggaccttggcttgtatcccccaaggataagggaggactactgtactttgtgatcagagaacatattttgcatggcttaaatctttttaagtgtattgttttgtggcctagaatatggtctagcttggtaaagcttcaactggcatttcagaatactgtattcagctctattgggtggtgtgttctataaatgtcaattaagttggttggtaatgttattcaagccttctatgtccttactggtttctgtatacttgttatatcaattataacatgttaaaatctctgactataatgataagtatttataataaatattcttgagttttgttttgtgaagcagatgtgttactgggaaacagcttgatcctttcagatcttgcttttaagatttgttaggtgggaccagcaatatttatgtagggcaaatttttccacaccactgaggcaaaactcttttgtgtactcaactcaatgttcaatgcattaagaagtttttcttgtcagactggcagaaacatgcacaatttccagttctttgtgaacactggatactatttcctttaatcctttctgataggtctttccctggcctcctgtagttttctcagatacatgtgcttatcaatactctgatgaatactcaaagggaggcatttttcagatatgctgggttctaactctttgcagctctgtactctctgatactctgtcctttgaactctagccacattgttttttccagactttcaactctggtactctgcagggctccatttgggttccctgtcccaatgccacagcccggaatctctcttaaacttgagataattgttggactcactcacctcatttgtattctgtctcccagggataactgtccttcctgcctcctgcccactgtcttgaataccatagtttcatttattatatttgatttgtagttgttttaggtgagggagtaaatctagtcactgttgctccaacttgaataaaagcagaagtctccctggggaatttttgaaaaagacaacttcctttttttttttttttttgaggcggaattttgatctttttgcccaggctggagtgcaatggcgtgatctcagctcaccacaacctctgcctcccgggttcaagcgattctcctgcctcagcctcccaagtagctgggactacaggcatgtaccaccacgcctggctaatttggtatttttagtagggatggggtttctctgtgttggtcaggctggtctcgaactccccacctcaggtgatctgcccacctcagcctccaaaagtgctgggattacaggcgtgagccaccatgcctggcaattgctacaaagagaataaaatacctaggaatacaacttacaagggttgtgaaggacctctgcaaggagaactacaaatcactgctcaaggaaatgagaggacacaaacaaatggaaaaacattccatgctcatggataggaagagtcaatattgtgaaaatggccatactgcccgaagtaatttataaattcaatgctatccccatcaagctaccattgactttcttcacagaattggaaaaaactactttaaatttcatatggaaccaaaaaagagcccgtatagccaagacaatcctaagcaaaaagaacaaagctggaagcatcacgctacctgacttcaaactacgctacaaggctgcagtaaccaaaacagcatggtactggtaccaaaacagatatatagaccaatggaacaaaacagaggcctcagaaataacaccacacatctaaaaccatctgatctttgacaaacctgacagaaacaagcaatggggaaaggattccctatttaataaatggtgctgggaaaactggctagccatatgcaggaagctgaaactggatcccttccttacaccttagacaaaaattaactcaagatggattaaagacttaaatgtaagacctaaaaccataaaaaccctagaagaaaacctaggcaatgccattcaggacataggcatgggcaaagactttatgactaaaacaccaaaagcaatggcaacaaaatccaaaattgacaagtgggatctaattaaatgaaagagcttctgcacagcaaaagaaactatcatcagagtgaacaggcaacctacaaaatgggagaaaacttttgcaatctatccatctgacaaaggggtgatatccagaatctacaaagaacttaaatttacaagaaaaaaacaaccccatcaaaaagtgggtgaaggatatgaacggacgcctgtcaaaagaagacgtttatgcagccagcaaacatgaaaaaagctcatcatcactgttcattagagaaatgcaaatcaaaaccgcaatgagataccatctcatgccagttagaatggtgatcattaaaaagtcaggaaacaacagatgctggagaggatgtggagaaataggaacacttttacactgttggtgggagggtaaattagttcaaccattgtggaagacagtgtggcaattcaccaaggatctggtactagaaataccatttgacccagcaatcccgttactgggtatatacccaaaggattataaatgaactcccgaccgcaggtgatctgcccgcctcagcgtccaaagtgctgggattacaggcgtgagccaccatgcctggcaattgctacaaagagaataaaatacctaggaatacaacttataaggacctcttcaaggagagctacaaaccactgctcaaggaaataaaagaggacacaaacaaatggaaaaacattgcatgctcatggataggaagaatcaatattgtgaaaatgaccatactgcccaaagtaatttatagattcagtgctatccccatgaagctaccattgactttcttcacagaattggaaaaagctactttaaagtttaaaaaactactataaagacacatgcacatgtatgtttattgcggcactgttcacaatagcaaagacttggaaccaacctaaatgcccatgaatcatagactggataaatgaaatgtggcacatatacaccatggaatagtatgcagctgtaaaaaaggatgaattcatgtcctttgcagggacatggatgaagctggaaaccatcattctcagcaaactaacacaagaagagaaaaccaaacactgcatgttctcactcgtaagtgggagctgaacaatgagaacacatgaacatggggctgggggggcatcacacactggggcctgatgggaggtgggggactgggggaggagtagcattaggagaaatacctaatgtagatgatgggttgatgggtgcagcaaaccaccatggcacgtatatacctatgtaacaaacctgcatgttctgcacatgtaccccagaacttataatttaaaaaaaaaaaaagaaagaaaaagacgaattcttggctggacacagtggctcacacctgtaatccaagcactttgggaggacgaggtaggtggatcacttcaggtcaggagttcgagaccagcctggccaacatggtgaaaccctgtctctaccaaaaaatacaaaaattagctggcgtggtggtatgtgcctgtagtcccagctacttgggaggctgagatgggagaattgcttaaaccctggaggcggaggttgcaatgaactaaacatgtgccactgcactccaggctgggtaacagagcgagactctgtctcaaaaaaagaaaaaagaaaaaaaagaaaagaaagaaaaagacaaattcttacatccatcacagacctactgaaacccagtctgtggatgaatccagaaatctctaacaagccccccatctgattctgtagtacacacattttagaaccactgatttgatcaaatgtaatctcttaaagtccagtccaattcatcaagcagccaaggcagtggcatctctcaagagacaatgaggtcatgatcagtttctcagtttcaactttgaattgtgcttgcatcatcacagacctacaccagtgaaccgtggaaatctcaccccgagaaaatcccaggcaaaaaactctgtcaggagactactggttataaaaattctaaggtttactcagtcattaaaattatgcatatataatagattcctttctattttcattgccaacagaaaattgaacatttgcttcaaccttcatgaaatcaaaacttagagaaaaacgatctttttataaggaaaatgagttattccatgttactaattagatcttagctgttaaattttggaatgattaaaatccttttcaataattgcaaaatttgctttgataaagtcaccctagaagttgattatgcagtgtagtttcaagttcgtcatgttgtcttcttggggacagctttctgtctgggggtgtcagtagtggcaatcccctaagtgcatgatggttgttgggttgatgtagccacaaaagatttgataaactgtgatatgactgcttttatacaggtccaacttccacatagactagttaactctctatataactaagttccgtccttggcagatggattaatttgtgaataatgaatttcccttagctacctccatacttccattttggtttactaaatatagaatcatttaagaaatctgtccataattatttccagtgaatccacaattaataataacatcagccagtgatataccaacttacacagggagcatgtcacattctgaactctttgtcaatcctaatttacattccagtgaaaatgtggtagatggtgtgtaagtatgcatattataatccctttagctcagaggttcttaacccttgctgtgtcatgagcccctttggtatcttgtgattctgcttatggatcccttctcaaaataatgttacaagtgtgttaaataaaatccaaaaagcaattacattgaaatacagttatcaaaatatgtttaaaatacaattgtggtatagtaacatatatgcttccttattattttttgtttgtttgtttgtttgtctgttttgagatggagtcttgctcttcacctgggctggagtgcagtggtgcgatctcagctcactgcaaccttcacctccctggttcaagcgattctcctgcctcagcctcctgagtagctgggattacaggcatgcaccaccaccctgggctaatttttgtgtttttagtagagacggggtttcaccatgttggtcaggctggtctcgaactcctgaccttttgatccacctgcctcggcctcccaaattgctgggattacaggtgtgagccaccgcacccagcctatgcttccttattaatgccataaaataataagatctagttgtagctctaataatgattataatttttcattaagaatgagctactaaatatcatttccaaacaaacaatgacaaaaattataatgttagatgaaaatattactgttcatagcctacacttgtaatataaggaaatgctaaatttggttagtttagtaaaaataagaatattttttccttgcaagttcatggaccccctgaattctttctatgaatcctaagaacctctgccttccttctgttaatttttaatgaaaatttagattttagtcacaaaaaccaagttatgcaaaaatagattatgaaggaatatgggagaaaagaaatgaagttccagttttctcgtggaattggttgaaaggctttattcaacattaagatatatacactgtgcattttttttactttccattacttcctgctggaattagcattgtcctcttcaatgagtcactaatgaacagcctgacaagtatgacttaatcatacagcacttttagtctatgaaacctacttagaatgttagcacaaagtagaaatacaatgattaaaggagaaacttatatactataatgaaatcttagctcagaagaacctaatttgcagcaagcttaggacctttaaaatcagaagtcctttgggtcttgtcttagcaacttacttgttaaaggctctgggtggggaggtggttgtgaggcgatataagaaaatgaaaagaaggaataaataaagtcatggtttcacaatgtgaagttcaaaaaggctatataccatcacaggtgttcagtacatataccaaacctcatatttacaagttgctaactggaattgcatgattagattgagtaatcacacgtgtcggtaaaaagctgtaattacctaagaaaagcatagcatttttgtctgtgcagggctcacctatttcgtatgtctttaaaactttgaccaattataaatcttttagcaaggtagagagtaaaatcctatattttctgtggatgttgacacatgtaagttcctgatcattatttattaaacaattagctttaacatgtaagatggaatgggaaaaacatttaaacctaatgtgaattgcctaggtatgagaagccttagaactttgttagaaatttctgttttccatttctcaaatactgtgaccataactcatagtttatttataaatagaaagtgacacttcataatacctggcagctttcaaaactagattatatctgtctttgcctgaagggctccagtaacactattgtacaatattttcttctgaccatctggcagttcttaggaaccaacctctgtcaacattttatagctactgcactggttacagctaatcctttcaatgaatgagctggaaaaaatgtagatacatcaatatcgttttcctttagagcccatttaatacatgccctgttattattttgtttgatagggccattatcttctgtgagaatgaaaagtaatttgtcagaagcatttttttaaatttaaagatcaatctatgtaaatttttcttaaataaaagaaaccacagctttttaaaaaaagaacctcaaacataatcattaagagtctcagaaatgggaacttagggcttagattccacaaacatttttagctattattttctaatctgggttctaacatgtttagtctaataaccaagcctggattgggctatttctgagaggattttatgttaacagtggagttgacaccttggcaaggtttaaaaaaaaaaaaaaagtgtatgtttctcttgttgtttgctttaagaaactaggaagcaattcattccaatgtgggaatttttatgaatttttcttcaaaacgatttggtactctatggactttgaataactaatgattttaaagtactttattttgcagtttatgaataaaagttgtggaaactttccaatgttctcattctaacctatctttacttcataaaaacccatgttggttgaataattttcttagaaaggctgttagttatttctgtattctgaaatttacatttatcattgaattgaaatgggaaaagatattgatctttttttcagattcagagtttaaaactctgctcataataacagatgataaaagagattctcctcagcttcaccattccattacataccaccactatcatgagaccaagatttttttttttatttttgatttttgtgacagagtgtcgctctgttgcccagtctggagtccagtggcaccatcatagctcactacaccctcaaactcctgggctcaggtgatcctcccacctcagccttccgagtagctgggactacaggtgcacaccagcacacccagctaatttttgtatttttggtagagagacagggttttgccatgttgctaaggctggtttcaaactcctgggctcaagccatccttcgacctcagcctcccaagcactgggattacagatgtaagccatggtgcctggccaagatcaagtttttgacagaaaccttttctctgtaaatgttttgcactttcatatttaggtacctcaacttgggcaaggttgttcagttaacatatacagatacagacacacacgcatatgtgtctgtgcacacaaactgttcctaggttgttagatgaaattggtttgttattcctatagttttttggtatcaaaattaatgtttaaaatttctttagagagttttatggtgacttttagaaaatgttttccctttcttttctatcagatggagattaaaactactacaattatagtacaatgttgagtagactcgggaatttatgtaagatgtggctaacaattttgataactgtacattagagtgtgtcaagacaatgaggcttctttgatattgtcttttcttcttctaattaccaggtttctgtcatatcctaaatttagggagggaataatattcatctccaaattaagtataacatctagctatattttgatactttttagttgatacatataatataaccaatatcagttaaaaagtaccaaaatatagccagatgttttacttaatatatataaaggtatgccattactcttttagaaaaagtcatatggtggctcacgcctgtaatcccagcactttgggaggccaagatgggcagatcacctgaggtgaggagtttgagaccagcctgaccaacatggagaaaccccatctctactaaaaatacaaaattagccaggcatggtggtacatgcctctaattccagctactcgggaggctgaggcaggagaattgcttgaaccctggaggcggaggttgcggtgagccaagattgcgccattgcactccagcctgggcaacaagagtgaaactctgtctcaaaaaaataatgataattaataaataaataataaataacaaaattttaaaaaatcataaaattggaagaaacctaaagaggtcgctagtataatttattttcttggagatactatgtttctggtaagaggaaagctatagcctctgttctcacatgtagtgacttttgttatcaaataattccatataggtaaataaactctttcttactattctctaaattccattcattattttatttttttcttgctctaagacattgaatacctttgtttttttaagttatttttaaaaccagaagatttaaacttaatattaaacatttcctctcaattctcttaattactttttaatttttcctactaagaaggacagtttggaaaacacaaagctaaaaggaaaagtaatcatgattccatgtctagaggtaatagcttaacatatgtcctttgattgttttttctctatatctgtactttttaagttgtgttttacaaaaatgataccatattgcatatgctatattgtagtctgctttttaaaaatatatttatttatttatttatttgagacagggtctcactctgtcacccaggctggagtgtagtggtgccatctcagttcactgcaacctccacctttcaggctcaagcgatcctcccacctcagcctctctagtagctgggactacaggtgcacacccccacacctggctgatttttgtgttttttgtagagatggggtttcaccatgttgcccagtctcgaactcctgagctctagctcccaaagtgctggtattagaagcatgagccaccatgcctggccctgcttttagaaaatttattagccaattttgataataaacattcctccacctattatttttaatgactacctagtattctatagtgtgaatgcaccataatttactcaacctgttttccaacatttttattaagagaacaacaaaaatgttaaaataattttatagtaaacacacatatatccaccatttagattttacaactaacatcttattatacttgctattagtctgttctcacactgctctaaagaactacctgagactgggtaatttatgaagaaaagagatttaattgactcacagttccacaagcttaacaggaagtatgactgggaggcttcaggaaacttacaatcatggcggaaagtgaaggggaagcaagcacgtcttactacggcagagctggagagagagagaacaagggaggaagtgccacactttaaactatcagatctcatgagaactccctcacaaacatgagaatagcatgaggaaaattcgcatccacgatccagtgacctcccaccaggtccctcccctgacacctggggattacaattcgacatgagatttgggtggggacacagagacaaatcgtatcacctgttttatcacataccagtcaaactagctatctctccattattttttgtgtattgccaagtaagtggtagtcattagtatattcctctcacccaagtatttaagcatcattaaccagagttcagtatgtgcttatgtacccaacctatatatacacacacacacacatatatagatacacacacatatatatatgtgtttatatatatctttgttttttgagacagagacttgctttgtcacccaggctggagtgcagcagcatgatcttggctcactgcagcctctgcctcctggcttcaagcaattctcgtgcctcagcctcctgagtagctgggattacgacatgtgccaccacacctggctaatattttgtatttttttagtagagacagggtttcaccatgttggccaggctggtcttgaactcctggcctcaagtgatccacccaccttggcctcccaaagtgctgagattacaggcatgagccaccaactggacccccaacctatattttaaaggattcttttacatttattaattatacatatttattaatataactggatcagctatatattgccacacaacaaaataccccaaaatttagtggctgaaaacaaacaaatactttatttgcttttgattctgtgggtcagcaacataggctaaggtcagctgagtgatttttctgcttacttcactagagtttttcatgcaataatagtcatctggccattccaccaaggctggatggagaaagatggtctcacttgataaattcctggaattggagttacttaataaaaaggtatacatacacatagtcaaattgccctctttaattatttaaaatgtattcccctgccccagattctatttgcattctttcaattcaaagtcagtaattttttgagatgctggctggattcattttaatgaatatattgagtatctcttggctaggtattgagaaggatacaagagaaagaaatacaagatattgactgttcttcaggaatttataatctagttgtgtagataacaccaacactaataagatggtcaaactgaattataagacctggtacagttgtcaaattgcttacctctttctcctcttctcacaggacaggctatgttaattacttgacatctaataagtattcagtaaataattgtttagtgtttatcactgaatttaagagaagctctgagttaaagtcctctagatgaggggttttgttaaagaggtgggccttgatatggcccttgaattagaggtacaatttagaattagatcaaggaaaggaatacagatttagtaatcattttcttaaaatctgttttattttgtatgtatggctagaaattacttttcttgtttgtttactataaacacaagactatctgctaaatatttccctactgagttcataactaagattgccaaagtgcttgtttcactaccatattttaatttctgaccatcctttatcatacaaggtgtgactagaagggaaacaaccaattttctcaaacaaattcagaaacccttatctgaaaaccccatgtagtagggtaattcagagtcggaagattttcaacatattggaggaaatagttaagggagggttgtgggtataagcaaacctatgaaagccaatctggttttttttttttttttaacatttttaaagtaaaatatcaatttgggcaccctaaatacacatagtaaaatagttacaatgagattctgaaccattaatatacatttactattttttcactgtaaactttcaggatctccatcttccttgatttccactctatgcttagaagttcaggttgccttgttgctgagggtgcttatactaaaggtttttgcttttttcctgaatgtaattgtcagtcctccaggaaattttatgacacagagttgttgacttccattatctgattcccactatggtctcagagtcaaagaaaactgaacaaataggctgtttgtggctcactttcgttaaccaacctgaacaagtatttctttctgcctatttcaacgtgttattttcccttagttccaaatggagtgccatcagtccctgatgaactgagataaaaagttgaggacatgcaattacaaggccctcatatactttttctcaccttctgtctgtcttccaaaaattcatggtaataattctgttctcttctcctttatttccctgctctttttcttaattatttgtgtaatagggagacaaaaactcttgaggatgaagaagccgtaaataaaagtgaatttcacttaaggggaaatcaaggttgagaaattattattatatagtggcacttatccatacagatgagtgttgccctcttcacattttttatcttagctcaactgtgctgctgttgctcaaagtatgtttttgttatggcctttacaaactgtagcacatttttttgaacatacttggtggtggcatgtctttcttgagggtgagttttgttttgtaaacaagttatctacaatcaaaattggtgattttggcagatggaatcacactgcataatatgtctacccatatacacgttcatatacacacaggtatatcatcacacatacataaagtaatgagaataactcagagtttgtatatcattgaaaaagtgtagtttcctaagtgtttggggacaacattttttatttttaagaatcaaaaagaactgaaagagccttggaggtcatttatttcaatacctcaaggaaactaagacacagaacaagaaaatgacttgtcaaagtctcatgggcagtgattgcgaactccttagatttcagtttctttgttgatgatcacatatcttgcttgtcctaattcctttgagagtgagtgctgagggaatacagattagagtcttgcatgtagagattcctaagaaattattatgttggcatagaaggaaaaaaaccactcatacatagagcttctttaaaatattttaaaagctccaaattctattgatagaattataataatctataggcaaaatttcctttcaatcagaaaaatactaaagaaagtaagaattctatatagttcatgaaccatttgaataatttgagcctgcacctaataattcctgagtattgttcaaaatgaactactccaggaacgtcagttaaatgtttttgtgttttgtgagtgtttgtggctatgttttcaagcatgtttcttttacaaaatcagctgtctactactttccccaatctggacttctaaaatagccactaaagtattagccaaaagtgatccccattgctgtcataaactatgtatctgaaatacctattttgtttggaaaagaaaacagctcatgaggaaattaagtgataatatatgatcattcagagaaatggattggctgaaacgattacctctcaaaatgacaaatatctttttccatttaaataacctagtcaatctaacatttagagagtcaaaggtcttttagaccttatgattcccactcaatgttggaagaggctggagtgatggcattcaaacaccagatccacagactggtactagcctatgacaaggagtctgtgacagcattttagcctatcagtagtgaaatgaggaaaaagaagatgatatggtgagcttattagaaaactaaatatatccagctttttattatttaaatatcatttttgaaatggtagtgataatagatattttttgttgtttgtttttatcatgttcttaccttagcaaaggtgaatccccaaacttaaaaagtcatccaattcaatgttctaccctttcagaatataaacaaagtgcctgctatagaatttgagttattttataaaagtagaataaatgacttagaaatttcttaatgtgaccccccccccaccaagattactgtgagagttcagtttatctatagtttatcattaaaagtttactgcagctggttctatgcagtgattccctacccgcccttccattttcatgaccgtcttgaacctttcattgaagctcaggctgcttaggtagagtctgaattgttttgtcagtattagtagctcataatcaacattgtgatttgtcacataacacctctaactgcactattctatggtttcaagaagttattttggtagcagttcctttatgatcagaaggaacattttgctacaataggaaatgcattctgtgcagacaggctgcaaattcccatgacagggcaggctcatctgtcaaagaatattttttattcccatttacctctttgattacattcagaatgccccagtaatgctgatgagatcattctaactcttaagaacattttcctcatgttttctatcatctccaataacattaaaatgtttatcacagtggaaatggtagagaaatctctgtttttctctttaggaagctaatttggggaaggaaggttggtatatgaatgtctaaaaagtattttttaaattatcagtaccagtgtttattatttaactgaacactaaattgctcttgcatgtgtcgcatttgcatatactatggtttctagtagtgaacataaaagcaccagtgatttactcaaaaaaagatattttctatttattttcaattctacctatactatattgaaagactaggaaatactatgaattattgatatgttttttagtgaaatatggtgttttatgtaccataatgaaaaccaaaataggtaaacacttggttacagtgatttaagtgcagaaatgtgtaattgatgcaattaggtgcttcattggctttttaaatgaagtctgtatttctgcatatgtaattataatttgaatatattctgattttttgtcctctacttttttccaagttatagtgttatatatgctcattactttatttttaaaaaactttttattatgaaatgtaaacgattcaaaaaagtaaagaaaatagtatagtgagagcaatatacccattacccaatatacccattagcatgactgatcttattccacttatatctccattcaccacccttctcccaccactagattatgtaaaatcacataccaggtataattttatccttaaatactttcatatgtaaactgtataccaatagatatttaaaatatattttccttttttttttttttttttttgagacggagtcttgctccgtcgcccaggctggagtgcagtggcagcatctcggctcactgcaagctccgcctcccgggttcacgccattctcctgcctcagcctcccaagtagctgggactacaggcacccaccaccgcgcctggctaattttttgtatttttagtagagacggggtttcaccgtgttagccaagatggtctcgatctcctgacctcgtgatcagcccacctcggcctcccaaagtgctgggattacaggcatgagccaccgcacccagcctattttccttttttgtacttttaagttttatttttttaaaattgacaaataataattgtacttatttatggggcacctattgacatttcaatacatgtaatgtatagtaatcagatcaggtattatcgtatccatcatctcaaacatttatcgttttcttgtgttgggaacattcagtatccctttctagctatttgaaactatataatgtattataaaatatattttcttcataccatcaaatattcaaagagttaagttttcctccctcttgattatctctctctctttctctttttgacaatttgtttgaatctggatccaatcagaatccactgtatttggctgatatttctcctgaatccttaaacttaggtttcctcctcctccctcttttattttcttaccagtcatttttgaagaaaacagggtcatttgtcctgtaaaattcccatattctggattttgctgattatattcccttgtgggtattgctaataggtgcctctaagctgttagtttcagtattttaagattattttccagtttttactttgaatgtaaatctcaacatgtcttcatttttctattcaagtaatttaaatctctattcaagtccaatccaaaatctacctttttcttgccataccagtcaatcacttttgcagtattttaaaagaagattgcacatgaaaagattgcttttccacttgttcctagacctcaaagagagattaattgaaagacatatactgtagctcgtgtcctaagaaagttgatctcaccgaagtagagggtagaatggcgattgccagagactggggtggttaatgtggagggagaatgggaagatgttggtcaaagaacacataattacagttaaataggaggaataagttcaagagacatactgtacagtgtggttaccatagttaatggtgatatattgtatttttgaaaaatgcagagtggatgttaagtgctgttatcacaaaaatgataaccatgtgaggtaatccgtttgttaattagctaactattccataggtgtatatacacaattgtctgtcaatttttaaataaaacactttttaacagaaaaaataggagcttaatcaataaaaaatttagtttattaagttatgccacatgtgagtggcatagactgctacaaggaatataaaggccattttaatccctgtgggtaaaagtcttcaaaagtgactcctaatgtggccataaattcttcattactaagtgcttcttgaccattgcaattttataggatttgatttctgaaattacaaactttgttctgatgaactcattctctcctcttcataactgttctaatttagtgtttttctgcttgctatggagggatggaggagaaatggctcatttccagaagggtggattggaatcactcatagggctcttaacgcctcctgctgaattgatgattactgttgcagtgacccactgctactgatggaattacaaaacatctttcagatgtgctggggtggaaaaacagttgaaaaccattgtcaagagtctctgtaagactttcatgacaaagttgctgtataaagttgtaatatacctagttgactttcaaaggcatcttagcctaaggcattgactgtcaagaaaataaaaaggtcacagaacataatgacctctttttccccactaaggaaggaggtttatattatataccttgattattagtgaagaggctacatttctgaatatagaaatgtgttcattgagaagagatttattgagcatctatttaactgcattgtgtaagtctctgaggaaaaaaggaaataaaagtgtaaagtgtctcttggttccatgagagcttatagtctattaatagttgaagagaaaggcatatagggttaaaagagttaaataaaaatgaaagatactattagattaagcattagaatttgggatgataaagtcttaaggaagcagaataaagggaagaataaggaccaaataggatttctgaagaagtctggggtgtctcctatttgggaggtggcacttttatcatgtgaagtggaatggatgaccctctccaaaacctctaagtttcctccatatttgtgattcatactagaatattatcaaaatctaaagtttcgatggacaaaaactgtcagtatgaccaaaataatgtaaccctttcaactaaactgacaagctacatttgcaacatatttgccaaaaataaatgaaatatctcaaagtaaaaataagtatcagcagtaagccccaattgtgtcattgtttaaatgaagttaaaaatatataagagttcttaaactttttgtgttgagtctgtagagaattgatgaaacatatagaactcttctcctgaaaaatacttatatttacatacagaatattgtacatatttcagggattcatggaccctttaaaacggatccatagactcaatttttgagaattttgacatataagaataaaacagaatcaaactttctaatctccctcaagtcatgagaatggaagggcttaaagctatagacatttaacaaattgggcccaagaaacagtgttagtgggcagaataaagagaagtagatagagaagggcttatcagagcaaaagcaggagtggtccagggaggataatagtctcaagatagtatctgagattgggttttcttattcccaatatgttcctgaaggcatattctatggttaggctgagtccatttaaagagtatctactcagggctgggcatggtggctcatgcctgtaatcccagcactttgggaggctgaggtgggtggatcacccgaggtcaggagttggagaccaacctggccaacatggtgaaaccccatctctacttaaaatacaaaaaattagctgggtgtggtggtacacacctgtaatcccagctactcgggagggtgaggcaggagaatcacttgaacctgggaggcagaggtggcagtgagccgagatcgtgccattgcactccagactgggggacaagagcaagactttgtccccaaaagaaaaaaaaaaaaagtatctacccagatacttttaggagaatacagaacaattttgactacaattaatagtgaaaaaatgaagaaattacaaagtaagtcacattattcctagcagttttaatttaagaactcgtgttctggaacacccacaaaagggagtttaaataatattttcttcagccctttaagcatggtgtattaggccatttttgcacttctataaagaaatacctaagagtgggtaatttataaagaaaagaggtttaattggctcatggttgtgcaggctttacaggaagcatggtgccggcatctgcttggcttctagagaggcctcaggaagcttccaatcatggtggaaggtgaaggggagcaggcacatcacatggcaaaagcaggagcaaatgaggttgggggaggtgccacacacttttaaatgaccagctcttgtgtgaactcagagcaagagctcacttatcaccaaagagatggtccacgccatttgtgagggatctgcccccatgattcaaacacctcccaccaggccccacctccagtattgtggatctcaacatgagatttcagtggggaaacatccaaactatatcatctgggtaactttctaataaactatgtatgtgatgtcaaatgtaattaccatatgtaattttaaattttaaaagccttttacttaacttttatgcactggaattgtgttttaaacctaacaggaagccgttatcattagaatgatcaaaacctgataatagtaaacaaaagagaaagttaatttatgggaataatcattcgggcaatagaataaccagcatatattgctgtcttaaaggggagtagctgtcaacatgtgttactaatagttaaaggtttccagaaaattttcagtatctccctgccaatcaataaagatagcatcacactcatcaccatagctttagttgtcagaaatggtgtatttattgactaaatgcagcactttgaaaaggcaaaaaggagagttaactttgaggaagtagtgattacggaatttcagtagcagtaatttcctctcactctgaataatattacagttatggatatttccctattcttaggactaaatacttatttagtagttatataactttggaaatacagcacaatactttattagttcctatcattaaaaggtccatgaatagaaaatggcttacttgcatttggaccagcccaccaaaaaatcaacattggccaaatgcagatgaaaggttgattctggagtttaaatgcagagtttattaagtaacatgtttattaaattataacagggactcaaaagtgatataaaaactcattgaactgataactagtaagactattttaattattgttaagcttacttttcaatccccctcctttccttcctctttttctctctcactcattaacgtcattgacttttaaagcctaagtcaagattttctctagacttgaataggtctttgccagtctacaatttctgttgtctgcatacacatttcttccagatacattgtctggcaatatgggtaatggtgaaaggaaaagatgaatgggtagaagaatataggaatctatggtattctcttaaatttacatgagatttcaatgagtcttttggggagcagtaaaagatttctgtatttgacattattttggtaacatggaaatgtcactgacagaaaattttaactcttatgtttgttttttatttatgtaattagcatttgcctgtctactatatgcagcagtcagctggtatacagcagaacaaggataccagttgttaaaatactgaaatatttccttactggtagagaaatggcactttcttgaatgccataccccacctctcaggctctggaagtcctagatcctcctccagaaacctccagatctccctgtgacccagaaaataaaaggaaaatgaatagcacagcagcaggacttcaggaccctcatctagtgccagggcaacatcattctgattggtcaggactgtatgctgtgccagttgttaaaatatttaatatttaatattacctttggctatatgcaaagcactgtgtttaactcatcaggaaataaaaaggtgaataagtcacatcccctgctctcaaggagctcacagatgaatcagtagtaataattataccaacggctgacatttactgagcacttactagcagcattgttctaagtacttctcatatatcatctcattaaccctcatgatatccttaggagtttattttctcttttacagaggagaaatcttagacatagggagattaagtccatatcagccagtctgactccttaaagagtattggaggaagcacgtggagttctaatttgtcactagtcatgtgatccccttggttttcacgtccgtctctatggaatgaagaggttcaattacatgatgtctaacagtcttaaaaacctgttattccataacagtgataagacaaatattaattaaaggcagaaatcataagcataactcaaggcagaatatgaaaagccctataaaatagataaatacaaatgtagaaggggctatacataatttgtttccagaaaacctataatgcttttctttctcccatttctccttttcaattaaaataattcttagaaaaaagatcacacatagtttcttttgaaaggttgtatttggactagatattgaaagtgaaaaacagaagagagggcattttgggcaaagaggatagcatgaaccagtaagtgtttcacaggggaagagagagatgggtttatggaaacttgagtgtcttccctgtgccagggactgtgttaagtgtaaggaacacaaaactgactgaaatacagttcctgtctggtgagaatgacggagaagtaaaccaacagtaatgatactgtgactggggaacagttgcattgcattcttcatatttgtcgaaggcacatatttattgaatgtgcctgttttccaggcacatggaagatgctggagatacaccagagagcaaaacggaccaaaatctctgccttcatgaaggctatactcttatgagcaagataagcagaacataaataaataaaatatagagtataacagatggtgataagtgcattggagaaaaacaaggcaaggaaggggatgaaatctgctggagttgagagaaatgagttgcaattttaaatacagaggtcaagaaaagcctcattgaggagacatttgaataaaatgctgaaagccacaaagaggtagcaagtcctgtgactctagagtgaaagatgttccaagcagaaagctgtgtcccctccagagtcttgtctcagtatgcttcacacacaccagcaatttgcttctttttcttttgcatcatcagtctgctactactgtcccgtgcaccacccagtctgctactactgacccttattcactctaaccagctctttggtctccttgcttttttttttttttttttttttttgagacagggtcttgctctgttgcccaggctagagtgcagtggtgacatcatagctcacctgggctcaagcaatcctgccatctctgccacctgagtagttgggactacaggtgcaccccacacccggctaatttttaaaaattattttagagatagggtcttgctatgttgcccaggctggtggcaaacttctggcctcaagtgatcccccgacctcagcctcccaaagcattgggattacaggttgaattactatgccctgcctggtttccttgctattccattaacatgccagatgactttcacatcagggggtttgcatttggctggtatatagagaatgaattagaaagatgtaagtccaaagtcagagaaaccatttggggccggggaagagcaataatcaaggttaaagatgattagcaactgaattacggctatggccaggggaatcaagaaaagtagacagattgagagagatttagaaggaaaaaaattactagaacttggtgactgcttggatatggtaaccaaaggagaatggagacgcaagataattcccaggtttctgccttgggtagctggcaggatgatgatgcagttcactgaggagggtacagttttggaggcatttaggtgagatgatggatgtggtttggggaatattacatttgaggggcattgggcatgatttgagttggtataccatacagattaatttcttgtcaatatttttaaagtattgtaatgtgtttttttaaccacaccctataatttaagtaacaataggatctccagaatgagaataatagggggacccatagagagatggcctctcaaaggcagtagccttttagtgggctctgaaagatgagagatgccaactgtgcagttagggaagactccaggcagaggcacagcagacatgcaggcattcatcccatgtcaccaaaacatccagtatgttttcagcaaatgctgaaaactgaattacagcctattctctgtcccttgctctccctctagtttccctagatcagggtggaaactctccatccagccaaccgtgcacttcaaaaacccagaggtcagcctggacacctcttctcccccgacctccagtcataagtcctgtggattgtccttgaaatctgactgtcactctgctcccttctgtcctagctgccatcttctgtctcttgaactgtgcagcagccccctgccggtgccctgctttcattcttgtgctcttccaacccaatctccatattcagctgagtgatctttgaaaaacacaagtttgctcctgtcattccctgttgcaatgtatttttacaaacacatcctaagatagttagtcacgtaccaacttttagacctttaaaaattgcatttatctgccaagcaattgttccccatggaagaagagctctagtgactactttgttcctttgttgtctctaattttaatattccaaaacccacatttttttttacaattgtcatttgatttagatgacttaaaagctttttattacaagccatatatatactaatagaacaacctttaacaatatatttttttgattcaccagaaaaggtgatcatttcttgatcacaagcagtaaggtttcttgtcctcagctcaacctcattataactatatatttgaacaaactaagatatcctctgaactgagtcacctcatcccagggttcaactgacatggggaattaccttattttagtcagaaagccttaattagattaggttggcctttctgaactttatgtgttgctacatacaggagttaaaaaccttgatctacacatatcacacaaatcaggagaaaacgaaagcagaaatgagctcatgtttctatatgcagctgctttgatgaagacatttcaaatagaaaccagaaaaccaaaagcacaaaactgaggagataatagccaatgaaggggagaagtgattaattcagatcaggaaaaaaagctgcagagttcaaagagactatgatgaaattattaggggctgttggagatgtaatccatatctccttgtcacatgtgtcctacgtgatagtgccgtgaatgtcatgggataaaattagtgccttacaaaataaacatgtttaaactttgtgaaaaatacccacacaagagactgatatacatacattcagaggtggacacatttgtctctagagggaaattcatctgctatgtggtgagagcagctgataatcaggaaactcaaagtcacattctagcagaaacttttattaatattgacccataactgtggctctgcaggagtttttaatctcattgtatttatgtagtgtcttttgtaatatgataacacatttcaaaattattattgttgaattgccaacaaaatgcatcctaaacacacactccttaggtaagggaagagaccccatgtatgctgtcctctgctattggaaacaagttaaaaaagagttatccagtaatctttttcttaaaaacagtcacaacatcttgatgatactgattcaattgtaaattattttggaataattcaaactataaaagctctaatcttcaagatgggaggcttgaatgtgggaatgtaagcacagatgtttatctaattttatccaatagtttatactgcacgatgggctcactgagccatatttcctcactttgaagttacctggagttctacctggtcacaggcttgcctgatttatgtgagtgaggaaggaaaaccacttaaatgaagagtgtggctttaaagaatatagtgcattttctctgagtgagcattcgtgacttctgcaggaaggtagatgatattggacaacagattactttgttttgattgaagattgaattaatattacaataccaatgctttgtctgttcgcaggcaacgaataaatgagtgtgtgatactgaaatgaaaaaaataggatatagatggcttatgtaagagccaaatatagcagaagcatacaactatcaaactttattcagacatcaagaaagcatcatatctgagctattcttttcatctccttcctgtttctttgtatacacttctagtagttaaactgattttaatggatgaattttcatttaaaagtaaaaaatgatgttctctgcttcaagcagcaggtgtgtttttaatctttaataggtcaccttcccaagtgcaagcaggcaagctgttattgatcaaagaggttttgttgggtagctctcagattattgagtgacaaactttattgaatttgacttaacagaagtcagaagacagctgaagcataagagcttgcactgccatcagagtcattttacgacagccagggagcaaagctcagagatggatactgagctttttgctggcccttggagattaactgaacagccttcctaccaattcccaagcctgtcagcagaaccaattagattttcaaccagtagacaagaagggtggcacttggggacctttttgctttaggtcgaaggcttttcagactgcgatgagatgacattgatgatgacacgttgagcattggttggttttaagacaagttaaattagcagtcttgaaatgattccaactgtctcctgacttctcactgttgccatattcagtggatcctgtcaggagcaagttgatgacttaatagtctttcttgagtggatttgagcactttggctgtgtgtttatgtgtagttgtcatgcttaaaatattcatatgaaggtttgaaatatttatttgaaggcgccttctgcagagttcagcagtaaggctctcagtgcttctacctactttttattttttattttttgcttctctaagcagttattttgtacaactaccttttattctatttcatgtataattgatgacaatgtttcatgtaattattgataacttcatttatgataaacttaaaaagcctttctgacatcatgcatttctcccagactactgtaaattcagatctactcataaatagtttggaaatcactggggattaggaagggcactattgtttttattctgtgacctttggtccaagaagactgaggcagattttcatggaagggatataaacagaaggatggaaacatagatgtagtactaatacacgtaagattgtcttaaacgatggaaacaggatatctttgagaagcttcatttttgaccttgaaaaagttctacaggatacttatttgaggtattgaaaacaccattactcaagtctgcatttgaacttaaagattactgaatagtcttaacatctactaatatcagaaaattgttatgagtgtacttctgtgttatatagataattgagattttaaattctcaaatttaaagtttttggtatttagtagggttacctggcaaataacttaaatataataatttgtaattcattgcacctactcttgtacatttttataagtgagaataattttagctgattatgtgtgtatatatatatatatatgcatctgcaaacacatatgtgtgtgtatatataaataattcatgttttgtaacaaagttctacattttctacagttacatgctggtgctatcacttggcaattgccgaccctccaaaaggcatgaaaatgaaaatattttacagtataaattctttcaggctactagagagtactttttgctaagctagacttgaaattttatagctagctccttggcaacctacagtggttacgtcctttttgaagagcttgatttataaacagggcattcttggtgtatgcacttaacattggatttagaattctgaccctatggtttcatacctatacaatgctgtggatagcaatgatgatatgtaggaaataaatatttcaacattagactcatgttttcaaagtggattcttctagatgctttttaagatagccacatttggccagaaccccatgtaatcatcacccagtcccagtaagtgacaacccatgcccagtcttgcccgctgaaaatcccattcagtacttcttttatattattttgaagcaaacccaagataatcatataattttttccataaatatttcagtgtctatctctaaaagataaccacaataccattaacacatctaaaaagacttagcaataatttcttaatataattaagatagaattagtattcagatgtcatttattgttattcagaattaccagtgattaagattgtgatagattttttctaaacacacctatttttcttcccaaatctgttatcctattgtcctttgatactttttttttttaaactccttttcgtcttgcccagccaggaccgtactgttggacatttcaaccacactcttatcactacctttaattctttcaccccttgaccctcttttatgcttactcatcctatcattaaccctacataaagctaaaattggttttctctgtgcctgggctgtcaaaagctattgaagaaaaatgcataactgttgatggcaccattacacatttatgattttcagcctcaggtggcccctttgtaccacctggtggtcattttacccattccccattgaaacaggaactatttcaaatccatacctctttaattcctcaacttggcctctagccaatttcatcaggcatcatagatgacttgaacatctattctgtgagaaaggacaatagttgtgagttatttcacacttcttccttactctatatttatttatctttaattcctaccctctgtttcaaaacaaacagattctttcttccaaaaaagttaatgtttaataccatggattctagtgccagattgcctgtttagaattcaggctccaccccttcttagctatgtgtcattgggcaagttattcaactcctttgtgcttcagttttctcatctgtaaaattatagttattacagttcttgtctttaggattgctaagaaaataaagtgacaatacatgtaaaattcttagaacagagcctggagcaggccgggtgcggtggctcacgcctataatcccagcactttgggaggccgaggcgggcggatcacgaggtcaggagacagagaccatcctggctaaaacggtgaaaccccgtctctactaaaaatacaaaaaattagctgggcgtggtgatgggcgcttgtagtcccagctatttgggaggctgaggcaggagaatggcgccaacccggaggcggagcttgcagtgagacgagatcgcaccactgcactccagcctgggcgacagagcgagactccatctcaaaaaaaaaaaaaaaaaaagcataagaaagcacaacccatgtaacagttgttgttacagttatatttccaaaactctactcatgttcctgactcagggtctttccaaggctctacctgtgttcctgattgtgaaaagtaagatacaagaaagggatgggggaggctgctttacattggatggcctggcaggcttctctgaggaagcgacatttgaactgagatctaaaggatgagaatagaccagtcaaggggaaagctgggagaacatattctaggcagaggaaacaaatacaaaggagctgaaagaaggaatgtgtttagtatgtttgaggaaatgaaagaaaactaattatggctgaagtgtagcaggaagggtgagaatggttcaagatgaagttggggaaataagctgggtccagatcatatatggccttgtagggcagagtaacgtgtgtggattatattcttagttcagtggaaagctattgggggttttaaccaaaggaatagcatgatctaattggtatcttgtgaagattattctttttgctccatggagaatagatttttaggacaagagtaaaatggggaaaagttgataaaagactattgcattattctaagttagagatgatagtcatttggattgtggtggtggcaatagtaatggattgaaatacatgaattcaagatgtaatttggaggtaaaaggtgatggattagatgtgagggatgttgaaggaaagataagaatcaagtataacttctaaattattggcttgaacaataaggcagatagtggtttaatttacgtaaatcattctctaggagagtcaacaatctccaggcacccaaaggtagtggtaaggaataatacaaggtcaactacaaagttactcattttggtttcaaaaatggccttggcttctcgttcctcataaattggtaaatcttgaggaaaacttccacttatttatgtctggtgtctttttagcttttaaaaaatcaactccatagaggtaaaatttgcatataatcaatgcacccattttattttttatttactttttcttttaaaaaacatttattttagattctggggagtatatgtgcaggtttgttacaaagacatattgcatgatgctgaggtttgaagtacacttgaacccatcacccagaaagtgagcatagtacctaatacgcagtttttcaacccctgtcatcttccttccctccttcctcttatattccccaatgtctgttcccatctttgaatctgtgtgtacttaatgtttggctcccacttataagtgagaacatgcagtatttggttgtctgttcctgcattaatttgcttaggataatggcctccagccgcatcctaattgctgcaaaggatatgatttattttttatggttgcatagtattccgtggtatatatgtaacatattttctttatccagtccactgttgatgggctggtttgattccatgtctttgccactgtgaatagtgctgtgatgaacatagaagtacatgtgtcttattggtagaatgattatattcctttgagtatatatccagtaatgggattgctgggtcaaatggtagttcaattttcagttcttttcagaaatctccaaacttctgtccatgatggttgaactgatatgcattcccaccaacagtgcataagcattcccttttctctgcagccctcaccaacatctgttatttcttgactttttaacaaaagctgttctgaccagtgtgagatggtatgtcggtgatttgcatttctctgatgatttgtggtgatgagcattttttcatgtgtttattggccatttgtatgtcttcttttgagaagtgtctgttcatgtcctttgcctacttcttaatgggattatttgttttttgcttgttgaattaagctccttatagattctagatattaggcctttgttggtatagtttacagatatttttctccattccgtaggctgtctgtttactctgttgatggtgtttctcttgctgtgcagaagctctttagtttacttaggtcccatttgctgatttttggttttggtgcaattgcttttgaggacttagccataaattatttgccaaggctgatacagaggagggtatttcctagcttttcttctgagatttttataggttgaggtcttctgtttaagtctttaatccatcttgagttaatttttttatatggtgatagctagggggccagtttcattcttcagcatatgattagcctgttaccccagcaccatttattgaatagggagtcttttcctccttgcttgtttttgtcaactttgttgaaaatcagatggttgtagatgtgtggctttatctctgtgttctttattctgttccattagtcttaagtgtgcattttaatgagttttaatgaatgtatataccagtgtaaacaccactccaatcaagttattgtttctgctgtattactctgaaaattcccacatgtcccttttcaggcaatcccctactccaccaccaggaagctacagatccatgtattgtcactatagtttagactgttgtagaattatatataaatggaattatacagtatgtaatattttatggatgccttttttccctcaaatcattattttttgagattcattcatgttgtttgttttctattagtagtttagtctttttgaattttggagtagtattccactgtatgaatttactaccacagatttgttcatccattccacccaactgttgataaaacaaaaattggcaagtgggacctaagtaaactaaagagctaagtaaacaccatcagcagagtaagcagcctacagaatgggagaaaaatgaatactgttgataaaaagttgggttgtttccagctggaagctattgtgaatcaagctgttagggacatttgtgcacaagattttttgtgaatataaattttcattattcttgggtaaatatctaggaatggaatggctgggttttttttcttttttctatttcaaattttatttgtcttttttattattatactttaagttttagggtacatgtgcacaatgtgcaggtttgttacatatgtatacatgtgccatgttggtgtgctgcacctattaactcgtcatttagcattaggtatatctcctaatgctgtccctcccctgtgcccccaccccacaacagtccccagtgtgtgatgttccccttcctgtgtccatgtgttctcattgttcagttcctacctatgagtgagaacatgcggtgtttggttttttgtccttgcagtagtttgctgagaatgatggtttccagcttcatccatgttcctacaaaggacatgaactcatcattttatggctgcatggtattccatggtgtatatgtgccacattttcttaatccagtctatcattgttggacatttgggttggttccaagtctttgctattgtgaatagtgccgcaataaatatacctgtgcatgtgtctttatagcagcatgatttatagtcctttgggtatatacccaataatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttctaatgattgccggaatggctgggttttatggtatgtatggtatatgtttaactttgtaagaaactgccagactgttctctaaagtgattgtaccattttacatcccccagcagtgtatgagagtttcagttgcttcacatccttactaacgcttggtatgattagtctttttaaatttagccattccaatggctatgtaatagtatcttattgtgatttcaatttgcattcccctaatgattgctgatgttgaatttttttcatgtgtttattgaccatttgtatatattttttgggacatgttcaaatcttttgtacagtttttagttgaattggatacctttttattaaattgcaataattctgtatataacctatacaaatacatttaataaatacatatatttaacaaatcagttgttaaatgtaagtattgcagattttttcccagtctttggcttgcctttttattttattaatactgtctttttaagagcagaagattttagtttttataaaatctaagttatcttttttttcttttatggctagtgcattttgtgttctaaaaagttttgctcacacaaacatcatgaagatttttctcctatgttttaatttggatattttaaagctttagcatttatgtttaggaatgtgatatatttgaatattatttttaatacagtgtgaggtaagggtcgaggttcattttttttccgtaccgatatccagttgttctagcattacttggtgaaaagatcatcttttctcccattgaattacttttacatattgttgaaaattaattgatgtaaatgtccagatctcttactggactgtcttttctattcccttaatctgtatgtctaccattatgccaataccatactgttttgattactgtagatttacaagtccttaaatcaggtactgtaagtcatctaattttgttctactttttccacattggttttggatattttaggtcctttgtatttcatataaatgttagaatcaggttggcaatctctaaaaaatcaaaagaagaaggctgttgtgattttaattgggattgcattgaattcatagatgaatttaaagagaagataattcacatcttaataatattgagtcttttgatccataataatgatatctcactccatttatttaggtcttctttaatttctgttagtagtgttttgtagttttcagtgaacagatcttgtacacccactccgatgtgcataattattcctattattttgttttctttttaaatgctattgttaatggtattgtatttttatttcattttccaattgtttagtgctagcatatagaaatacaattgatttttatactgacctttaatgctgtgacattgctaaattcacttattaattctgatagctttttaaaggattttatagaatattttatgtataacagtgatttagtccatttgggctattatgtcaaaataccataaactgggtagcttataaaaaacagaaatttatttctcagttttggaagctgggaagtcctcaaggcaccagcagattaggtgtctgatgagggcccattccttctcgactgtatcctcacacggtagaaggggctagctagctctttggggtcttctttataagtgcactaattccattcatgagagcttcaccctcatgacttaatcacctcctaaaggccatacctcctaaactcatcattttgggggttaggatttcaacatatgaattttggggggacacaacattcagaacattgcacgagaccatgtcctgtatgaataaagacaattttacttcaccctttctagtctgtatgtcttgatttccttttcttgctctagtgcactggctgggagatccagtgcagcactgaatagaagtgtttacagtggatatccttgcctcgtttctgatcttaggatagggatttagtgtttcaccattaattaagaagttaagtatagatttttttggtgaatgtcctttatgagagaatgtccttctatttctagtttgttgagaaattttttcataaatgtatgttaaattttgtgaaattattttcctgcctcttttgagatgattgtatagcttttctcctttactttgttaatgtggtaaattacatgattttctaatgttaattcaaccttacagaatagggattagatactgttttatcataaggtattatcctttatagatattactggatttgatttgctattttgtttaggattatatgattttattaagggtggtgtcatctatgttcatactagttacagtctttttaaataagttttattatagtttctttttgtctggttttggtatcagggtattgctggactcgtaaaatacactggcaaatgttcttccttcttatgttttctgaaaaaatttacagaaaattgctagtaattcttcccttaatgcttgatagaattaatcagtgaatccatctgaacctggagtgtgtttgggaaaaaaagtttcgttcacagattcaattaaatagacataggcctcttcagattttttacttcttcttgtgtcaattttgacaacttatatctttcaaggaatttgtctatttcatgtaattttccaaacttattagcataaacttatttataatggtcccattttatccttttttttttttttttttttttttttttttgagatggagtctcactctgtcacctaggctggagtgcagtggtgcaatctcagactctgcctcccggattcaagcgattctcattcctcagcctcccgagtagctgggactacatatgcgtgccaccacacctggctaatttttgtatttttagtagagacagaatttcaccatgttggccaggctggtctctaactcctgacctcaggtgatccacccaccttctcggcctcccagagtgctgggattataggcatgagccaccatgcctagcccctttttattcttttaatgtctataggaactgtagcaatcaatgttccctatttcagtcccaacagtgcaagtagctgggactacagacacattccaccgtgcatggctaatttttaaatttttttgtagagatggcatctcactatgtcacccaggctagtctcaaactcttgagctcgagcagtcctcccaccttggggtcccaaagtgctgagattacaggcatgagccactgtgcccatcattaatttgtatttcatctctctttttcttcttgagcagtctagcttctagcttaaggtttatcaattttattaatttcttcagagaactggctttttgtttcattgtttttctctattgtttgtctgttttctatatcttttctttctccttttatcttttcagttccttatttctaattacttggggtttaatatagacttttctagcttccaaaagctaattatttggggcttaacgtaaatttttctagcttctgaaagtgaaagcttaggtcattgatttcaaacctttttttctaagttttttttttttttagatacaaggtctcactatgttgtccaggctggtcttgagctcctaggttcaagtgatccacctgcctcagtcaaatcttttttcttatgtaagcattcaaagctgcaaattgaccctgtaagccctactcttccaacaaattttgatatgctatattttaatttggttcaacatatttttaatgtttcttatgatttattctttgacctatacattttttaaacagtatattgtttaattgccaaatatttgagagttttcaagacatcttttttgttattgattttcaacttaattttagtttggtcagagaatagagtctggataatttcaatctttaagttattgaagaattgttatatagcccatcaaatggtttatctgggtaaatgtttcatgtacacttgaaaaaacatatattctgcccttgtttgaggtcctgttttgtaaatatcagttaaaacaagttggttaatagtgttattgtcatattctacatccttactcattttatgtctacttgctctgccaattactgagagaagagtagtgaaatctcctatataatatatacgtatgtgtctatatttctgtttatttctatcagcttctgcttcatgtattttgaagctcatatttgttgcgtacatatttatgattgttatgttgtctttttgatgatttgactcctacgtctttatgaaatgtctttctttatcctcagtaatatttgttctttgaagtccgctgtgtctgatatcaatacagctacactaacctcatgattagtgtgcacatggcatatctcttactgttcatttatgttttacctacctatctcactgtgtatgcatttctttctttctttcttttttttttttttttttttgagacagggtctcactctgtcacccagattgtagtgcagtggcctaatcttggctcactgcaatctccacctccacaatggctcaagcaatcctcccaccttgacctcccaggtagcggggactacaggtgcacaccaccatgcctggctaattaacagagagccaaatcatgagtgaactcccattcacaattgcttcaaagagaataaaatacctaggaatccaccttacaatggacatgaaggacctcttcaaggagaactacaaaccactgctcaatgaaataaaagaggacacaaacaaatggaagaacattctatgctcacgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacattgccaagtcaatcctaagccaaaagaacaaagccagaggcatcacactacctgacttcaaactatactacaaggctacagtaaccaaaacagcatggtactggtaccaaaacagagatatagatcaatggaacagaacagagccctcagaaataacaccacatatctacaactatctgatctttgacaaacctgagaaaaataagcaatgcggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacacaggcacggggaaggacttcatgtctaaaacaccaaaagcaatggcaacaaaagccaaaattgacaaatgggatctcattaaactaaagagcttctgcacagcaaaagaaactaccatcagagtgaacaggcaacccacaaaatgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcaccatcactggctatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccatttgggaagtcagtgtggcgattcctcagggatctagaactagaaatactatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcatgtatacaccatggaatactatgcagccataaaaaatgatgagttcatgtcctttgtaggaacatggataaagttggaaatcatcattctcagtaaactatcgcaagaacaaaaaaccaaacaccatatattctcactcataggtgggaactgaacagtgagaccacatggacacaggaaggggaacatcacactctggggactgttgttgggtgggggtaagggggagggatagcattgagagatatacctaatgctagatgacgagttagtgggtgcagcgcaccagcaagtcacatgtatacatatgtaactaacctgcacgttgtgcacatgtaccctaaaacttaaagtataataataataatagtaataataataaaaaagaaaggaaatacaaatcaaagagtttaaataagaaaaaaaaacaattttttattttttttgtacagatgatgtctcactttattgcccatgttggtcttgatctcctggactcaagcaatccttctgcctcagcctcccaaagtgtgattagtagcatgagccactgctcccagctgtgtatgcatttcttgcggacagttgtatagttgggtcttggattttgagcccatctgacaagtttttctttttaattgtactgtttaattgaactgaatttaattattgatatggttatgtttaagtttactatcttgctatttgttttctgtttgtcttttttgttcattattctttttacctctttcctgtcttcttttgtattattttttattatttcagttttctctactcttggtttagtggctatacctctttgtttagaatttaggtgttccctaaggtttaaactatataactttaatttatattcaccttcacataatattatactatttcacatataatgttagaagctttaagaatatacttccacttccccaccctctcctttatgctgttatcgtacattttacttctacagatgtcataaacctcacaatacactggcattattttttctttaaatggttaattttccttgaaagcaacttaaaaaaagaaaaatgtttgtatttacccatgtacttaccattttcagcactcttcactgatttttatatatacctgagtttctatgtagtattaataccattttcctttcacttgaagaccttctttaattatttctcactgtgcaagtctgctagtaatatcatcttttgtttgtcaggaaaatttttattttttcctttatcattgtagtaacttttcaatgaacatagaatactgagttgatgtcattttttaaacacttttctctggataaattattttttattttttgaggcgttagtttatttttcaaaataaatttcatcgtatgtatttgaggtttacaacatgatgttatagatacacatagatagtaaagttgtgacaacagtgaaacagattaacatgtctataatttcacatagtcactttttttgtgtgacaagagcaactaaaatcctacatatctaacaaaaatccctaatacagtacagtgatggttaatacggagtatcaacttggttggattgaaagatgcaaagtattgatcctgggtgcatctgtaagggtgttgccaaaggagattaccatttgagtcagtgggctgggaaaggcagactccctttaatctgggccggcaccatctaatcagctcccagtgtggctagaatataaggcaggcagaaaaacatacaaagactagactggcctagcctcccagcctacatctttctcctatgctgaatgcttcctgccctcgaacatcagactccaagttctttagttttgggtctcaggctggctctccttgctcctcatcttgcagatggcctattgtggaaccttgtgatcatgtgagttaatacttaataaactcccctttctatatatatatctatcctattagttctttccctctagagaaccctgactaacacaagtacaattttattaactgcgtaaagaatttactttgatttttttctttaatacttgaaaattttcattccattgtcccctggcttctattatttctgacgagaagtcaaaagtacacccatttttgttattttgaatgtactgtctttggggagtggtgattataaaaaagagaactttatcactggtttttagtaatttgattatgatgtgccttaatgttattttctttgtgtttactctgctttgggtttgctggccttatgtatctttggttttatgattttcatcaagttttgggcttattcctttgaatatatttctgtgccatttctttccccattcctgtggggcatcaattatgtatatgttaggcagatgttattcaatatgtcactgaggctctgttgtttttcgttttttacccctttctctttctctttcagtttggttagtttctatcactcttaccaatgtttacatctgcactgactaatctgatgttaagcctatccgacaaaattttaatttcaggtattatatattttttactctaagagttcatttgttttctttctttttggtttctatttctcttttcattatgtttctattttcctttaatctttgaatatgtttgtattatccttttatatacttgttgttttgctaaatccatcatctttgtcacttctgagtccacttctatggttaaattttcttgagtttcttttatcatactttttttcttctttaaacatctagtaagtttttgaggatgcaggatactgtgaacattacattgttgagggtctgaatttattttttgttttggtagtcagttaagctacttgtggatcagtttgattctttcaacacttatttttggttttggtttttggggtttttttaagcttttggaggacatgtctagtgtgacctttactttatgctagtttaaccctactattaaagccttaccttttggtgttttcactgaatgcctctgttatttaataatatctctctactatggctagaagtaactggaacatcttacagactattgtttttttgcctagcctgatggagtctcacactgcaacacacagcttagtgctcaggcaaagattcaaggaagactctgcatcggtttctgaaactctacttatgcatagctccctcttctctggtattgtgccctgaaaattccagccacctcagcctcccctaatttcatctctacctcctcaacttaatgagtcatccactttctgcttgtagtgatcttaagtctcacttcacttgtttcccttttctcagagatcgcagtcctttgctgcctgttgtccaatagctgaaaacaatggttcgatatattttgtccagttttccaattgtttataattggaggtcaactctagtaccagctttcagtcatcactagaagcagaagcattttaatgccttttaaatataatagtatattgtttagaaatttacttatacatcataccacagtgatttattgagtacctacgatgtgctaggtaccatgccaggatttggggatacaaaggaataactctttctatcttcaaggaagctcacagtctgttagagaggacaaacatgtaatataaatagttagaaaggtgtttgggagctcaaatgaggtcataagtaactatatggtgtggggtagaagtatttatgaagcaactagtctggttttataggtattctccaggttgagggctagccaaaaaaaaaaaagcattctagtcagacagagcaataaatggaaaggtagagagttataaaatagcacagtgtgtttataaagctagtttcattaattaatcattcatttaataaatgtgtctgtagggctgggtgcagtggctcatgcctgtaatcgcagtgctttgggaggccaaggtggaggatcgcttgagcctgggagtttgaggttacaatgaactatacttgcaccattgcattccagtttggatgacagagtgggacactgtttcaaaaacaataaataaaagaagaaatattagatgctatgcaaggtgttaagtgttgagcatccaaagggtgagtatgatgttcatgacttctgccttcatagagcatacagtctactgtttagtgtgaatggagcataaggtgtctagataaggatagtatttatggacaaggtagcaggaatggccaatagaaggcagattgtaagctaccttaattggtaccctaaggggctagttattgttatgaaagctactggcctccaaagttttctgactatatatccagcctataaaaatttcacatatttaccccaacatatgtatacatttattaataaactctataatgtatattattgtactgatatatacactgtaaaatacaccaaaaaatataaatgagataatttaaatataaatagacaagctagtattctcttcctgcattccatgctccatcttgcatatcttgggttcacgcaccttactttgtaaactagcaggaaatgggaagcattcaagcctcttttgcagcaaaaagatttgatcagaattctgattcataaagattctgaatatgacttttattttagttgtgctgaataatgtttttaaaagcataggagaagctgggctcatatgattccttccagttccagggttttgtagctgggggtgctccttagaagaggttagcaatctaacctagtgttgttgattagttgtgttattaagatacaatacacaagactaacgaagtgacttaaaatagactatccaatatggagttggtattccctgcagtgaaactgactttgttacttgcaagtcaccactttataaataaatgagtcacagcaaacaatccaactggtttcctatatagatatttcagtgggctacgtgtcagttttcatacataggccatgcttttttatattagaaaaacacaaaaccaaagaagttgatttgtataaggcagtgcttcttaaatggaagtaataaatctgacaggaatatttttttcctaaataaactttggcaaattactttttgattcatccatattatacctggaagtggagaaataaaggtggggcacactatccaaaaagctggactaagggagcagaactgggcagttttagaggtcccagaaatcagtggtacaggatagcagagacataaggcagatgagatgccaggttgtttagaaggctagtaactgggaagacagaattaggatgagttattccaaatcaggaagacacaattaccagagttaggacccagatgtgcaagagtttggagaatgcatgtaaagaaccagtcccgaggaaaacctcaatgactgaagaggcggcttgcttcagctcagcaggtctctgtgcaaacactaaggcggttaccagtgtaacttaggtgcagctgagaacctgactggaatgggacacaaaaaggctgaaagaaagatggtttgcaagaagtcagtgtgccccaaattcatcttcctaatgaaacatttatattacttatttctgaacttccaacggttcttttatggttttaaaaatattctctcatagaataaagggaagtgttcttcctaaattatatgagaatgtattagctgtgtctttatgtatacatttcctatgcagtttaagagcaacaatacataaactcattttaccaattggaaaactatgacaagaaaacttaggtaggagacggttcggtttgtttttgtcggtttccccccaactttgattttgttccctgtctaaatactgtaattgctttgtagcaaatgcacctttctcttgccccactttacctcacctctctcaaacaactgaggtaacatcacatcacaagccaagaacattctcattctgagttcacttggcagtagatagaacagtactccaacttgacaagcattatagcaggtaagaggggaaaaaaaatgggttactgatttgacatactgctgttgaaaactgtcctaaggctagtgggtgttcgctaaaaccaaaatgggccatggctagaggcacctgtagaatagttaatgacagtcatttagctttcattcatttttcagttcaaattattttagaatactttgttagttcagaacatgtttgcttaagtcatttcagtagtaatgcttttctacaggaggcaattaggtattcttcattttacagctcttgaataatagctaagaaaactgcaattgcacaagcaaagtgcagataaacaccagattatcatattaaagttcttattagtctgtcagaagaattttttgcactgaatgctttttagtttttttattatccattttttaaagtcagacttttccccaatgttagtttagttttaaataaattaatcagtctacatttttactaggaaactaatctttacttcacgtccctgccaccattaacttcagcctaaaatagcaaatttcccttcaaaattttaaaaatatgtataattttaattttttttttctgggctacccaatggcttctctactacaagctgtattagaaaaggtgaacctctccctatgtcaggtgtgattgctttgttaagaagcctattagtaatcctaaacccagtatgacagtggtcttttaaaataatagtaagtttcccatgtgtttgcagagtttcctaggtatttgaaaagccaccagccaggcacggtggctcacgcctgtaatcccaacactttgggaggttgaggcgggcagatcacaaggtcaaatgattgagaccatcctggccaacatggtgaaaccccatctccactacaaatacaaaaattagctgggcatggtggcacgtgcctgtagtcccggctacttgggaggctgaggcaggagaatcgcttgaactcgggaggcagaggttgcagtgagccgagatcatgccagcctgggcgaccgagcgagactccatctcaaaccaaaaaaaaaaaaagagaaaaagaaaaagaaaaaagaaaagccaccaaattaaagtgttcttaaatttacatgaatatttatgttttgcctatgaaactatatatactttcttttcaactatggtttcatcttctggaagggagaaactgtatctttggcaactatttctcttgtttctttcaacattcaggggagtgttaagaaagttagactatcagttaatatttctcagtttctatttgaaatagggtgtttttttcccaagatctgaagagaatacacagagattccccctcgtaaaatctaaaagcaaccttccctttactgcaggcattattgcaggttaaaaacaaaaggaaagaaactgaagttaccttagagtgtcataaaaaattaccaagaagtctaaaatcctgccatctgctttacgtgaaaactcttctagtgagaacccaaggcaaaaactgtgtgtttcttctgtaatacttcctcagagtatctattgtctttcaaatggggccaaggcttctcaagggaaaggaaatactctaaaataaaattgtagggtgcaacataatttgtgatttgttttcttttatgagtaaaattacatggtattttggccacctgtttataactgtgtaggtcctcccatgaggaatattgttgggtccagaagaaaaatagacaagtaggaggcatgcaccgttctttcagataccatctgattaattgcctctgacattccctgacctttgtctgctccagcacgtgttgtcagtgacagaggccttggactgccagttttgctatctttgctggcagaggggcagaaccgacacttttgtagccactggcaagactaagccttcaagtggggaaaaagattatttctgggttgtctgaactgccaagttagctccccaaatggtttgtgccacagcaggtttgatcttttcattgcatcctgagttacatcgatttcctttggctttttgacatggagaaaacaagacataagaaaatgaaccaagaccagttctttagtatttaagaactattccagtcaaaacgaaatagtctgggtatattgacaaagctagcttggaatattaacaaagttaattcaggtcaggatatctgacagaaataactagtcagtgggcaaggaattaatttattgtgttcatctgaacttccaatgagcttatatcaaggtaatgaatatgaccagattatggtttgcctgttgcacaaacagcaaatgccatctttcagatttcctggggggttatattcagttcttatggacagcttagcatagcagttaagagcacagatgctggagtcagactgcatgggattcaatcgcaactctgccactttctagtaaatttgggcaaattaatctatgcgcttcagtttccttatctttaaaatggggataattatggtacctacttcataaggttgtaatgagttataatcagtgacttgctaggtatgaaagcactttagcttagtgcctgatattgggaaagcactatacaagtgtagcagtagcagtgggtggtttatatatgacatacatgtcattggaacaactttcagcaccagctcctatcttttgtggttggatgctggatattttgaggacatttggggagtatgtcaaggctggtttcttttattctgttcaacctatttttcagggtgccttatttaataaaagttgatttgttgctttggaaatacaagctaattttatgaattatataaggacatcagggtaacttaaaagcacataatgcatttgtaaatatttgggattggtttatgttttggattgtcagaacagctacccttgaccccatcttggttgacccagtgaatgcatgtgaatttatagcagtcttgggtttttgcctggcaggaagcatctatcaagtacccagcaaatacccatttccctcctgcttgaaaactgagcttttcttgtggaacacttatccttgcacttaatatctggtttctgaatattcacattaaacaacagataatttgagttattttactattgatgtgtcatcaaataggaagatgactatcaataatatgacttttggtaaaatggaatagaaggagtactttaaatagaggcatcattagaaaaatgaacactggttcttaatacttaaaaaacactggttttaacaatacaatacaaagaaatatcacctatgattttgttccccttttatgtagagttttattttgaaaggtcgcattttgagtatttgagagactgagctcctctgcctggataatctccaggtgcaaaacataggaatgtctgtgaatacacactgggttgcacataatttaaccgcatgggctttggaattatgctgcctgtcctcatatcctggctttgccactctctggctgtatggtttgtccaagttacctaacctctgtagtcctcagtttcctcatacataacagtgttgtgagaatgaaatgaattaacaatataaatgaagcacaccacacactgcccaattggtagtaaaaattagttgctgctactgctacttactattactattattggtgctttgctattattagtactactaataataatgtcgttattcaaccaagtttctttccctaacaaacaaaatcaccaaaaagtactgtgtggagagcatgccctctgtaatgttgctattgaaaagattagagatattctcaagcttctttaatatctcaatgttaatccaccagccatgaattttcccaaagccttttcgaacatctaagcatgtccagctagtgctgcctcttgaaatcatgagttccatgatcttcctgggctatatagaaactgacatagagtgaccaaggccacttggttccagcgtcatgaagtggtgcctccctcctttttatgttacagacttggtgaacatatcacttttgatctctttcaaacacacagagtgattttttataaatccctgttgccccccttttatctcacacattatcttctaagcctaaagaatctttcaagtaatggtatagatatataaatatcttcttaaatggcagcttttcccccagtaaaatgacattcaagagtaaggcagtggttgtttctctatcatgatttctaatttttctagattctagcatagatgacctacggttgcctattctttttctaatgtacatctttttaagctcctttcaaagaattatagagaaagacggtcttatgcacccatttagtctgcccctgacttgggcaaacatcccttctatgtattaggaacagcagttttcccagctgaggtgataacagtcctagtcttgcaaaaacccaaccccagacctaaggcagtagactcaaacacatgcatgtgacaatcattttttgttgctgttatagagccaagttccattgttcagaatttttatgatattttatatatatatatatataattttgagacagggtctcactctgtcacccaggctggagtgcagtggtataaacttggctcactgtaacctccatctcttggcctcaagcaatcctcccacctcagccttctgagtagctgggactacaggtgcatgtcaccaaaccaaaataacttttgtattttttgtagagatggagttttgccttgttgcccaggctggtcttgaactccaaggctcaagtgatctgcccggcttagcctcccaaagtgctgggattataggcgtgagccaccacacccagctctgatgtatttttatctgatcctcaacatgaaccaggactttagaagagaaatgccatccttgcgccaatattaactatcacatttcccagcatctactgagctgtcttcacccatcttgccacctgacatcctgaaatttgggtgaaagtcttctctggcttactattctgaaaggcttgtattgtttccagacctcttaccttatttgtttgtattttatcatacagacatagtaaaatggtaatgaatatgctattttatattttttctgcctcctatataaaaataattagtggaaactatttgtaaaggaagatacatttacctttgttggctaaaagttatcttgattgccagtctgaatagtgccatggatggtataggcaggcctggggcatagatgggaacaaacctaaaagataagcaaagaatgggtggagagaagataagggtgcagagaaaacagaggctcatctggtagaaagaaataaagtgccctctgaaagtgtctcaagtgcttcctagtggcactggtgccataaggcagctgtgttgagtctaagccaagtatcttcctgatctccactgcttcctgcggctgaacggggcacaggtctttcatacacatttattgtaatttagggagtgaacatggtccaggtatttgaaaagaagactggttgtcaggaagcattccttctgcttctctgcattgtgtgtctgtgattatgtgtgtgactttatgagaagtatctgaccttctctctacacaattcctcctgcttgtgagataaggtgtgccctggctggggtgttggcaagcctggtgaacatgtctaaactactctgggggagagaattgtgagagtggggagggggtgcccttgggtccagccttcccagagcataaaaagaagtgacaccctgggacccagccactctgaggctcagggagggcttggtaaatgacttcatccacggtatgaaatggttaatttttctttgtctgaataaagatagaacatacaattacccatggatgattctcaggtaaaggctcatattgagtgtccgctgtgtttatggcatggttgtaagcctaatggataattaagaacacctaatcctcactctaaaggcaaagacagtaaaataggggaggggtaggcagactgacaggaaacacatacatagaaccctataaatcagtattattttatcagtcagtgacatgtctctttagcattcattatactttttaaaaaactcccaattaaattattgtctatgagtatattgaaagctcttctattttatttgtaaaagtttggctacttaatattccttcagaaacattaatgaaaataagattttccaattagtcaagtaaattcaggagcactgtgtaaggcatggagagggtaagagttgagggaactcaaattaatttattgaaacattaaagaaactgtatggaactactaacaaataacatgaaaagatacataattctttgcaagtataatgaatggactatattgaagttatccaaatgaatggaatattgtgataggttggaaaagtgagagaggtctagatggaggaaaaagagcttgaacagttcttaaaagacaggtaggagctagatcggtaaagatgagatgagttttctagctaaaggaaataactaacctataaaattgtttttaaaattttaatagtaaaagccatactcattcttacttattacttgctgggaaagaataaaatatttccaaaggaatttgggtgtttgaaaaaattgtagaaatattctgtatttttctcagaaaaaaattaaatattgtatttaaaagtgaccattagcctttctggtgtgactcagaaatgtttctgtatttaaatatcattgcaactttagttatatcttttccctgtgagcctggaaagacaagatgctggtatcatacctgagatcaattaacatttttatagtgtgtcgatatgattgatattaatacattataataaaacagactaattagagttagcgacaaactgttgagatggtggtattgatgaaatatctctgtccattgcaggagagttgcagcaatccactcatatagtgattacaccttgtgacaaaagacagtatcttcatatttcttcattttaagtcaaagcgtaaatgtaggcagagatgtttttaactaacatgactatgatcatctatgtgccattatctaattgctcacagaaatcaaattgtacaagtgccgaggaatctgaatccagtcttgagctgtcagtggagaatgtcagtcatttcagtaaattgcccccttagggtcatcctgtataattctttaattttaggcccaaaaaactatgaaaggaattttgtgtaaaatgtaccaaaagaactgtcccatttaaaacattttatgccatgcttggaaatgaaaatggacccttcaagaagtaagtctataagttgttttatcaacttatagatgttactcagatggaatggtaacaacttggcttgtgtgttctctaaaaaattatcacgttttcaagttatgcatttaacctgtattgacatatggaagttttgatgtagtttcctttctcaatcaactccaaagagtcaaaagtgattatcaaagctgaaaaggcttttgtattttcttcaaatgttaaagccatgtatgtgaacaacaaggctgatgaatttgctgttttatttcgttgacatcttaattcaaaatgtaaactgaagtttcttttcatttctttgcactgttaatattattctgtttttggttaggttgggtaaaaactgttcactggtgtcattttttataattagacttttatagcttggggtttttggtaagcaaataaatattttaaatgtaattggtgcaattactgtatgtgcactgaacaactttatattgagcttcatgtcatgtcacatttttatgctagtggtttcttatgatttttttaattgtatgtggtattcttctgaaatatataattaccaactcaccctgagttggagaagcaagagttctgtcgttctctcaaacagacttgtattgaaagatataaaaaagcttgctttattctaacattatttccccatcgataaaagtggttcatgtctatgttatttttacatcttgtacaatcccagcatcacattgttctagtaggagtacaaacagataacccaagcttagtccagatttgatttgggagaaactagaaggctgggaaaggtagatggaaggttgtgatgagtaggaggccaggggtaaaagcagaaggaaacaagaataatgtaaccattagctaaacatgaaattttacccctgctcctgccttcgtggcatcacataacatggagagttttaagatggcatatttgttctagcttcatcttttctcagaatgccaaccagcagcacattcaggccacatacaaaccacagcggagaggctagggcaaggattagtgtgagggtgagcccaaggagaaggggaaagtagtagcacagccctgggctctaggaagttttggagaggttttagaatggcaggatgaaaagtagtatcaaacaaaaccaaaaggtccttattaaaatcaattagcaaaaagaatctagaccgggcacaatggctcacacctataatcccagcactttgggaggccgaggcaggcagatcacttgaggtcaggagttcaaaaccagcctggccaacatggtgaaaccccgtctctactaaaaatacaaaaattagccagtcatggtggcaggtgcctgtaatccaagctactcaggaggctgaggcaggagaatcgcttaaacctgggaggcggaggctgcagtgagctgagattatgccactgcgctccagcctgggcaacagagcaagactccatctcaaaaggaatctaagaggagtcaaaatctaagtctaagataatcattcccaaatactctcttccaaagggtaggaagactgacagtgtcctactgaagggccagaaaaagaaattatctttgctcagtgttgaactattctgttataaagcattgtaaacattatagcaacacttatgaccattataaccctacatgtgttcccattgcatgtttaataatttctctactttaaaaaaattgagaactagatcgagaagacaactgattgtagaacagtcagagagcttcgtgctggtgaacattaatagagctataatagtctgccaaaattatgatgaaatcactggaggcatcaaggcaaaaaaacaaatcaaggggaagctattaacagtttagcatttctagtttgtgtgagaatatggattccagctagcagaagaatacttcaactcagattggctgttaggcattgctagaaatcttgtttgtttttgttttttgttttttttttcaaaaacaatattgaattctatactggttctgaaggtcaccttaataggagggctagtttacctgtctcataacgttacagaaaaatatgagcctaagggaaagagaaagttcaacaaacttcttacaattccatccagtgattctgaagctgaattagtactgactgcaataaaacctagtagattatttcaaatcttcactgcctagatgtgcgaagtcctgtcagaatctcctcaccaaatctgtgcactttatactaaggtgaacatttgcccagcctgttctttaagctagcctagaaaatcttcccacaagaaactttctaccctttttccccaaaaccatgaatctcaataatcttacattgattataatttggaaacactttattcaaattgcttcaaagaaaaccaccaccaggcccccaagtttccttagtgagaagccaaagactttagagacactagattctccaggaaggtatattagtgctttttaaagagctgcatgttgtctctggttagtaaacgatggttcatgtcttagatgaaagaaggatgagagccaatgggtctgtgctcttctccagttggaaggtgaaagtgatatgaaaaggctattagggaaagtatatttttctgcttacttttcttatcaatggtatattttaaaagtattccttggccgggcgcggtggctcacgcctgtaattccagcactttgggaggccgaggcgggcagaacacgaggtcaggagatcaagaccatcctggctaacatggtgaaactatgttactaagttcctctagctacatagctagctagagtctccccagtggcagcaattgtcaacattcctgtggtcaactacaataactccattgacattcaattcaaattttaattctactgttctcacttttagtttctttgttgtaccttcctttttgttggtcagttttcctttttcagttaccccttttcgtaaagtgtcacgttggtttatcactgggagacagggaaaagcaaaactacattctttgctgtctgtgcatggactgaataatgaagtgcagtgaacaatcaccaacagacttaaaagaagtgatgtgattggtcactgatcatgatgcgcatgtgttatttacatagcaatttgtagagaccaagcagtgaagtttgtacttcatgcagttactcatagttaacattctgtggtaactgaaacttgaactgtgttgctcgggggacaactgtgataactgaaatttgtgaatattgaaactatgggccgggcacagtggctcacacctgtaatcctagcacttcgggaggctgaggcgggtggatcacgaggtcaggagatcaagaccatcctggctaacacggtgaaaccccgtctctactaaaaaaatacaaaaaaattagccaggcgtggtagtgggcgcctgtagtcccagctactcaggaggctgaggcaggagaatggtgtgaacccaggaggtggagcttgcagtgagccgagatcccaccactacactccagcctgggcgacagagtgagactccgtctcaaaaaaaaaaaaaaaaaaaaaaaagaaactatgaacagcaatgattgcctgtataaggatgttcactacaccattatctgtattaggaaaaagtggagattaaaaacccgaatgaagaaacagttaagtaaaagttagcacatctacactaggcaattgttaaaaagaatgaggtcaatcttatatgtattgacagggaagggtgtccaatgacatgtcatgaaaaaaaagcttgttgtagaacattatgtatagtataatgccatgtatataaaaaagaaatatttatgtatatttgtttatttttatatttaggtttgatagaaaaagctctggaaggcccacctaattgtcagcaacaattactcctgcagagtagaaattgaggactggagtttggtggtgggcagactttcaaattgtattctcacactttttaataattttttccccaataaatgcatgattatttattaaattttcaaaaaaagtacaaaaatttaaaatctcatatgaggaaccatttaagatattttgcctgtcatggagaacatgatggcattcttcaaacatttgaagggccgtcattggaagaaagattacatttgttctgaaagatattgaacagctgatatgggaccaatggatgcaataaaatcatttcttaaactataagaaatgtaaaatccttttaaagaccatacacagggctttcagtcagaatgcctgagtcttaactccttcaccatcacttactaaccttgggtgtatttcttaacctttctaggtctcagcttttgtatctgtgaaatgagtaatcagactaatgctacctttgagagcagtgatatcttcaaggtgaagttagcgttgcttcataacccttctataatctccaccagctttctcccctagactaccccaaataaatatacaatctaagtaaaaacaaaaacatgagccagctaggtgaacacagcttccagacaagtactatagtcatccacttctaaccaaattactactataaaccctttctttataaaaagtcatctagagctgccactgcctcagaaggtgttgaagggattaaatgagatatttaatataacacttctagcgtgatgcctagcacatagtaaatactaatgaaacaaaaatcacacatacacatatcccactaaatcatgatataagtgagatgacattttaactgggggtatattgaacaggtttttcccttcagtgagggggggaaaatggtttgataattaaaagcctagcacactcttgttgctcttggatcctgtttcctttcagttttcctgcccttgaggttcagtgacttttctcattcttttgttaattcggccaccatttattgagtacctactgagttccaggttcagtcctaggtgctggccgtactaagatgaaaaaacagggactctgtgctcagacggctctagtcagaaagagaaggaagttggataattgcaatatgatgtgatctggattaaaaataaaggtctgtaaatgacattaatggagcaagcagaaaaacatactgaggtcagtctgagggagccagagaaagcatcctaaagggagaaacgtctgaactggagcttgaagggaagacaggcatctgctgggtagaaatcctcttcataggatgtatgcagatgctgcttgatgtgggttgtgaaattttccatgactgttcataaagctgaaatgacagtaaattttggcttctctttttcccaacatttggctgtagtgatggaaaaccgaacaagtaattattcaaatatgttagagatgtgatagaacaaactcacccattcctgctctcctgtccttaccctgtggctttcattcttagtatcaagcgggtcactgtacctttagccaaggccttctccctgtgaagctttgtaattttatcaggaaggaaagtctttcccctaaatcttccacttatgtctcattagacagaatggtgtcacgcagccaccataagttgtgagggaggctgaaaattaatctagcaaactacagtgcctgccagagcaagaaatacaacttctccataattcctatctggtttggtcttatttttatagttgtagccatttgttttagttctctggggtttctttaacaaagtaccacacactaagttacctaaaacaacaaaattattctttcacagttctggaggctagaagtccaaagtcaaggtgtagagccatgctccatctgaaacccctaggggagtccgtcactgcctccttgtagcttctgctgtcaatctttggcgtccctgggcttgcagctgcatcactccagtctccacctttgtcgtcacctggtgctctccctgggtgtctctctgtcttcacgtggccggtcatattggacgaggggcccactgtactccagtgtcacctcatcttaacctaactaacaatatctgcagtgaccctgtttccaaataaggtcatattttgaggtattgtgggttaggtggagggaaggagatcaatccataatatcattgctttgtgcttagtatataaataagaaatgctctatttccaagtgacgtttctttatacctaggattagtaatgaacttttaaaagccttatttttattcctagtttgagaaacaattactttaactacaaaattgtggcaatatgaaagattacttgataaaccattttcaaataactggttacaaatttagaagaaagtttaaaaatccagactatactgtatgccaaaaaaatgtacacatgtgttaaagagttaaatattttatagaattgcaggaactggtcttttgaatatttgtgtggttataagaatcagtaaagattataaaagattcataagtcctaactgtataaagttgtaaaacttattgcacaagaaaaaaaaaaaacagtgggaaatgacagactggaaacattacaacgaataattcagacaatagacatgaacaattcatacaactattaagaccccaatagctagctggtcaaaggatgtggccaatctaaaaacaccaggtttgttaagcaagcatatgggaaaatgttcagtaatagtttaaaagtgcagtttaaagtgaagtgtgactgataaattactctattgctgatggtgatataaattgatataatccttctgaagagcatttggcaaatacatccagagctataaaatgttcattcaattgatgtttctgggaacttaccctaactaaataggctaaagaagaaaaaagctgtgtttatgaagctgttaattgcagaaccatttgtaataaagtgaaaacttgggagcaatctagttacctgaaagtagaatagtcaactgacttacgcatcctttttttggaatatgcagacatcaaaagttcttgtaatgacctgtggcaacatgaagaaatacctgtgttttaaagttgcatgttttttagccagacgccgtggcatatgcctgtaatcccagcactttgctaggccgaggcgggtggatcacctgaggtcaggagtttaagaccagcctggccaacgtggtgaaaccctgtctctactaaagatacaaaaaaaggcactctagcctgggtgacagagtaaaactttgtcttaaataaataagtaaagttgcatgtttttagaaagtggcatctatgattgcagttatggtaaatttaaaagtatgcatgtggaaaaagtcagcaacagtgagatagtgaagtgtgtagaaggtattagggagcctggagttgtgttaaggtgaatgattacgaatccttttcccaactttcgtataatttaaaaaatatttaaatgtattcaacttacaatgagtttaaaatcctcctgtactttttgcatgttaatgaaaccattagaaggaaagaagaatttaatgagctttctgggaaaaaaaataattttgctcacagtagtattgtaaatcacaccagatgtttttctgtcatagaaaagtctgtactatagtgggattattctaatgtgaaaaagtgacatttgaagaaagctttttaatacagtatatgtgcattatatgattaatggtgatgtttttgactggtgaagtaattattttaatcctgtctcatcattcactgtagttttgttttgtggctgagattttaaagctatgtttataaataaaataactctacccacaggctggagagaaatagttttactttcaccatgacaaatgatctcttctgactttctagttatgacttaatagtgtggatttaatggcaggtgatcaatgtagttgatactattttagcaatcccttttacttgtgttcttataaagaggacttgcccctcgcttctcagagtcagagtttatgagaactgtaaaaacatgatcattagccctgttccttgttcctggtggggcacccctagcatgtttcctaggcttgctgaactgctcagcgtccgcaagggaacacaggtgctgactctctttgggggtgtgagaagtaaccagggatgacaacccctctggggtctccacaggtaaagcttgattatgcctctatggttgactaggctttgaattcactggtctgaatttactacctgaatattaaggttgggtggtagtgcatctcaccaccactgcctccccctctccaaagtaacaagcgcatgcacacacgtgcgtacagacacacactcttggacactggtttaacgtgaaacaatcaacatatcctttaagagaaaaggcggggtctagtgggaggagtgtgggagtgggagtgatgatggaaaggagttaatccgtatctccgaaataaagactagacaatgaggagccctgcaaagcagtgctggacaattgacatccactgactccctagtgaaatgcagcctgccctcagttattcagagaccgagcatctaaagtgtggattatccaggccatatgcttctcctcctttgccatctggctggttgcctgcttcccttcttattcacatggaaaatagtcaaaatacctcagtccatttctgccaaaccttttctattacctctatcaaccctccctttaagcttattctgtgcacatcctggtcaaatctggtcacttggcatattctgattcctcccaggacacattggctagtttctaacgtacagtcttgtgcttgttgatcctggcttcataagagtctttttttattatttctcacttcactagctcgtgagctcctttaaagcaagggacatctcctctgcttttaatatcctcttcaactggcccagagagctcctcttcacaaggcaggtgtgggacaagtgttgttggctaagtactattcattgtcatttcaaccagataagtaataagaaagtcacaacacagaggagaagtaagctgaagtgccatttgctgtaaaaatcaaccaaaagagaatcgcagacttttagaattggaaggaacattagatatagttttatctcattgatagagaaacatgggcccttaggagtgaagtaacttgtccttggtcacccagagcatttgtagcagagctaggactagacttcacctctttagagcccatttctcttatactccagtcatccaaggattataaaggaatggagttatgcagaaggtatgcagagaaggagtggcttaggttaggttcccaggaggaggagtctacattagtgacaggtgaccaaccaagattaatgaaaaattttatcccccttttaagtaaattaatcttttgggattgtagatataatagcaataatttggagttatttttattcattttaatgactgatctaaaacaagaattgaaaagatctcatcgagtgcctagaacaaaactgacacatagtagacatcaattaatatttgttgagtgaaagaatgaaaccaaaactgtcacattttagcctaaagactaggagtatttttcagttccagtataatcaaacccatttatgaaaattgttagagtctttctttgaattaaaattttcttagtttgccgtgtattttaattgactctggacaaataattcagccatgagttacaatgaacttataaatacctgtttttggatgctgtaaattaccagagaaagctagtgccctgtcacttaccaatgaaatgtccattgaacattttatgatcttagcctaaacatttcaaataggattcctgtaaatttccaaggtaaatctcaaacatcagataacatttccaaatccagttgtgggggaatgtaattctatgtaatttacatagaatttaggtttagaattatataattcatgaacctttacatgaaggcaaaattgaattctattgttttctttaagttttttacattactcaaataatacatattcatggtagagaaaaattagaaaatataggtaatcatgaagaagaaaaaaactactcttaatcctagaagccaaagattaactgttaacaattagttgtatgccctttagacctttttacacatattcatggggtcatatgctacaaaccatttttcgtttttgtttttttgtgaaacagagtctcactgtgtcacccaggctggagtacaatggcatgatcttggctcactgcaacctccacctcctgggttcaagcagttcttgtgtcttggcctcccgagtagctgggactacagacgtgtgtcaccatgcctggcgaattttttgtattttttggtagagacagggtttcgccatgttggccagattggtctcaaactcccggcctcgagtgatccacctgcttcggcctcccaaagtgctgggattacaggcgtgagccactgcgcccggcctacacgccattttaaaacaacttttttcatgtcttaggaatatttctcagtgtcaataaatatttctaggaaccattcttaatggttgcagagtatcctgttatgtacatgtaccataatttgtctaactaaccccttgcatttggatatttaggttattttccatttttttgccattataaatgatgctgtgatgaactttcttatttatatatcttgactcacgtgttcagtgatattcttagaatgcattctgaagagtacaattgctgaatttaaaatatatccagttttaagagtggaaaataggaatttttaggtgtcagagatcactttcatgtagactttgaaatgctggcttttagagacttagtacttaattttggctcttcatggcaataataaacacatttttattatgtattaatacaattgtatttgataaatgataagctcccaaatgcattgttttagatggttttcaaacatttaaatgctttaaatgctggtattcttctagtaataataatgatacattatgcctatcagtttcctcattcttttcaaagcctggatgctttatttggctagttgacatgaggcagtttcttgctggaggcaaaatgtcattggaccatgaactaatctcccttccccctccccattttacccacttctaggctgattatataaacaataatgtgttgtctttttaattaagtgaaagtgactcattacaggtgcttttcaaccatctgaacttatctcctaaataggccttgcattatctatacgcaaatgagaatatgattatccaggcaaggccactctagaaaagcatttaaagcaaggagcagagagtcttctccagttttgcacgcgataggatgtaagagcagagctatccaattagaaaaggagacaggggaggcggggaatgaggccatgcttaccgagcttgttcaacttgatgacattatggttttcatgataaagtctgcaataacctttatctttttgcattcaatttaatggccttggaatctggagaagccagtaggacctcatttaccatgtagcaaacatcagcctcttctggtacaatattttgtgctaactaaaagagacatgaaattaaaaataggtcagaaggctttccgttccagttttgttgatttaagtggggcagtggggagggtaggcaaaacattagtttcttttaagtgatattatggagaaaataatctattaatgagtgaaaagagattatagcactatgagaaaagtaaagattatgttttgtgaaaagagctctttctgaagcatcagagaagcataattcccaaaatgatttcaagttatctacaagtagttttggcttgaagaaagtaagggaatgttatttattggaaatattttaattgtctttatgtaaggctgtgatggaagaggtgaatgtgtgttttaccaaatcatttcttcattcataagacagtacatttaaatcctgtgagaaacttttctcaaaaggaatttttttcttttttttttaaaaaaatgaacaaaaataatgctgcttctgaaagtatgtttagaaggccctggcttctcaataagagtggataaggaatgtaaactcaggtacattacagcttttctcaaaaagaatttaattataagagtgtggataataaatgtaaattctgggccatggctacatgactgtaatgaaacacattatagaaatacaaatagctgttgacattctaggtgagttatttctcccttctccattccactatgacagtcgctctgtttcactgagcacgctgaaacccattgtgccctctaattatgatgctaaaggcctctggaaaaggtcccccccaccccaccttttttttattggtcactaacaaatccctcattattattcccaaattaagaaaaaaaccttatggcaagagtcaaagtgggcagagatgaccttctgacagaaaaaaagttcctattttaaatgaggtagcacacttaaacttatattcgaacaatgtgatccctctcaaatacactggataaatatttttctgacactgcaagcaggaagataagcatctccttatacaccagggccacaagtgctctcaagaagcacctactatcagaaagaaccacaaaactaaaatgattgatttttgacagggacattctgaatccagactgggtcacattaatgtgtttaacaggttgtttcagatatccttcagatatctgaggatacaggcagttgctaatttgttctaatgtgctggtcagagtgcagccccacctgaaatccagtttgtatgagagccatatgaaggccatcccgtggagaggtcaggacctctcagagttgaattttagaagattcagataacttcttcaatttgaggttcctggtacattaaagaactaaagaaatgccagaagagtgttgcacaagttaattgattttcagtggttacatataacatatcaatgtctaacctgactcatttggagagggctttaaaagtcttagcattgaggatccccatgaatattgtgaacctgaagttcagaatgactcttccaccctccctatgaaaggattggcagatcagaaatttggttacatgtgccatcaagatatttctggccaaggtcatgccttccatgctttatggtatgtaagtttggaattaaactaagtcttcaagttcatgaatagatggacatagaacttttttcggaacaattcatgtccctgactacaagtgttcctggggccacgtctgaaagcagcttatcacttcactaatacagcaaaagcaaggcattctgttgttcaaaatacatctttgccaggtacatgcttactactttgtagatttttaggaccaaaaaaagcttattttggtaaccgaataactgacaatgatggattctcaaacatttctgctaaccaaagaaggaaaatgagattgtacccctttagagctggagtccaaaatagtatggcatacttaacgtttatctaacatcttaggtgttcatttcaaaattcatataaatgtctcattttcctccatactctgtttttatataaaataatggtatctctctcctcaaattatttttcacacagatttactctcctgaattttccagaaatgtagatacttttaaatcaaaggaaggctgtattttgttttgttcagaacttttctattccagaaaatcatgtcaattgacagcaaagccacttgtggtcattgagcctcctgtgtaaagcaccgacgtcattctgtagttgtcatcactgtattcagggtgattctacacgtaggagtgagcatttgacagcttccatgtcttctagtgcggctgagaatttacatattaagatacacattatttattatcaattactttcctgtttcaatgtccatttagagcactaaaaatatctttgtaggtagttgatattacttatgaattttatttcaggagagcaaaggaaaatacaagatagttgtatgaaaagggggcaccgggtgtgctagagtggctcaccaccgccctacacagtgggctaattggctggagagtagagctgactctgcacagttgcatgctgaccctctgaagaatttttttacaaaagcgtgacgtcgcgtgaagaccttgacagaattagcaaagcggttgagatgcatactttggagtcagacagactccagttcacatcttggcttttatacttacagctgtataaccgtagacaatctatctaccctctggccgactccatttcctcaattataagataggataacttgtgaaatgctttccacaagattactattgcatttattctcctcaccactcttaatgaagagagtcttgtaacagataactctaattgtcttcagagttcaggtccccaagaaagattatgccttctaaaagctagtctgtttccttccagtgggagccatttcattcatgctgctctactctttacttggactgctagcaaacatggagctaagtactcatgcttaatttctgtggctttcctcaaatagggtttcaatactatagtttgccctcactccattccctcctccaattcccccttactgctaaattttggtctttcatcccatgttgttagctgttggtcctagtgatcctgtggtttttattataaaaccacttttgtgtgtgtgtgtagtttttttttttttttttttttttggtaaaatgattatcttaaatcatttagaaaaagtaggtgaggctaggcacagtggctcacacctgtaaccccaacagtttcaaggccaaggcaggaggatttcttgagcccaggagttcaagatcagcttaggcaacatagtgagaccttatctctacaaaataaaaaataaaaaaattagccaggtttggtggctacatgcctgtaggcccagctacttgggaggctgaagtggaaggacagcttgagcccaggaggttgaggctgcagtgagctgtgattataacactgcactccagcttgggcaacagaacaagacccagtttcaagaaagaaaaagtggcggagggcggagttcagtgggtcatgcctataatcccagccctttgggaggctgaggtgggaggatcctctgagctcaggagttctagaccagcctgggcaacatagggaaaccccatctctacaaaaaaaaaaaaaagaaaaattagatggaaattaaataagtaaaataagaacgaaataataaagttccattctctttatggtactttatagtatttatttctgtaggtggcaaagttacttttttcccttaatttatactgtctattcatggtagtattagatctttactgtatcacttacttggggaaatatgacaataacactaagatgatattttacctaaaatactcatctatagagttatttcagcataaactatttatttctattttcttagcaaaaatctgaagaatagcacacattgctgtctctcatcatattattatagaacagtaattctcaagatttttggtccctggacacctctttgcacttttaaaaattattgaagacccaaagaacttttgtttatatgagttatatctatcaatatttattgtattagaaattaaaactgagaaattttaaaaatatttacaaactcattcaaaataacattaaactcattatgtcttaacataaataacatatttttatgaaaagtaattatattttccaaaacaacaataatgggtaaaacattcttatagaagagtgtcattatttttacaaacctctttaatgtctgtcttagtggaagacagctggactgtcttatctgcttctgcatttagtcttttgccataacgtatgttatgtggcctcatgtgagaatgagagtgaaaagggcaaatatgtatcattactattattatcgttaaaatagcttggaccttatagatctcctggaagtgtcaaggggatgctccagggtctggactacactttgagaactgctgctgtatagaagataggcaatgcatattgcaacataagaaatggaaataatattttgctcacattttaatttttagtggtttcaaagagccactaagttttaaaaaatatgcctcttaatccttcctccaaagtctacagaaacattaagggtcaaactatggttgacaagaaagtttagattttttccttgaagatctggccaatatatttttttgtttgtttgttttgagacagggtctcacgctgatgcctaggctggagtacagtggcacaatcatggctcactgcagcctcagctcaggtgatcctctcacctcagcttcctgagtagctgggactatgggcacacactaccatgcctggcaaatgttttgtgtattttgtagagacagggtctcactatgttgcccaggctggtcttgaactcctgggttcaagtgatcctcccatcttggcctcccacacctggccaccacacctggccaggccagtgtattttgaaaggtactagcaatatatggcatcaatgttatgtttttgggaatagtttttttttaaatatatgtattgaacagggatgatccttttacttgtggtatataagaaaacttagcttttttacccttccaatctatagtggtaaagttgctttattaaaccattatttttatttgtgtgtgttgcttgttgtatcatctttataccattcaataatgagagtagaacaaatcgatttctcttattcctgctgtgagatggttcataatgaaaggtagatggcttgcctaatttacagagtggcattaggttcagaatgagttagtacagaagaataacacattttattttgctctattttatttttctttatttaggtaataacaacaatggttgtgagcagcctttttttttttttttttttttttgagacggagtctcgctcagctgcccaggctggagtgcagtggcatgatctcagctcagtgctaccactgtttcctgggttcaagcgattctcccatctcagcctccttagcagctgggattacaggcactcgtcattatgcccagctaatttctgtgtttttagtagagaaagggtttcaccatgttggccaggctggtcttgaactcctgacctcaggtgagcagactttaagccttggtattgctataagactaaggatggcagctgcactttcagtgtgatagaatctccgttacagtgtgattttgctagtttcattaattacttgtgttttgtttctctttccatgaaagaacaatcttaaactatcaagcacttccccaggagaaaatggatcacttgcccaacagtggcattagagttaggtttaggatattttgaagtggcagaggtattaagtagtcttagtagacacaacccaactaaatttctttgggtttcagacaggtggtggtaaaatagacaaggtcaagaagtgtcaactactatctctagtgactacatgagtccttgctgggccctgtgaatctcctttatatcacatcagacttttcatggaagattagattatgccttcacctaaaaaatagcttgcccatatgagtctatatctatcactgtatgcaaccctcatgatttgggacagctgtaattattgggaaaggttttttcccaacttaatcagagactaacagatactgttgtccacactatagtacctcaagtgtttgaagacagttcccatgttttactcttggatctgcatgagccttctcatctccagcctcagctctgttctttatatgaaaatgttgccagtccctttcctacccttgttctctctcctgttgtcctgttccagttttcattgtccgtcttaaaagtatgatgcctagaatgacaatcagtgcttctgatattgaacgactataagaggagagtggggccaactgctttcttactgccattgtctgctaatgaagctgaagatctggcttctttggcagttgtatcacaggaacttgtactgtgtttactgtcaatggaaattgtgtcttagtcacatcaaactattaagctatattttcctcatcctgcatttgggcaattgtacgtgcacattcaaaactgaatccattgaagtttcacaagaaagtgttcttttttgttttctgtttttgtcagtggaaataacattttatttaatttttttagatatgggggtctcactttgtcacccaagatggagtgcagtggtgccatcatatctcactgctcaggtaatcctctcacctcagcatcctgagtagcatatgcatcaccatgccaggttaaattttaatttttttgtagagatgggattttgccatattgcccaggctggtcttgaactcctgggctcaagcgactttcctacctcagcctcccaaagtgctgggattagagatgtgtgctattgttcctggcctaactttttattttgctgtaattttaaatttacaggaaggtttcaagaatagttcaaaagattcctatatgtcatttgctttatcattctctaaatgaataaatatagattagatacacatataaataattacatataagttttttctggacaatttgagagtaaattgcagattatcatgcctctttaaatatttcagtttatttttaccaagaataagaatattttcttaaacagccatggtataattataaaatcaggaaatttaacattggtataataccattatctaatccatgatccacactcaagtctcaccaattatcccactaaggtcctttatagtgtttttggaagtgggagggtttccaggtccagaatccaatctaggatcatgcatttcattcatatacctgctaatttctccacctgagaagagatgttcttatccttcaaaaattggatagtagctgtgtggattacccactcctttgtccatagcttctacatcattgattcgcaaacattccactaccatcttcaagcaaaaccaaaacaaataaatcagtctgttcatctttgagcttccccttctgtgaaatcttgtttagtatcttaactatggacatttcaatgtggacatcagagagtaataacttttaaaaggttcattattctccactcaagtccattttcagaagctttgcattcagtgagcctttcttctccttcctgcagatgtggcatggctgttagattgtccttttgccctgaggctcccatgtcagttatgccccaatgcctattctcatggggttttaattgcctataacattttattgttcaccctcttcagtctcctaaactctatttatttctcaaggtaccatcttgttcgtgaatctttccattcatttatataacaaatggtcaccttctatgtggtaacattgttcttaggtgctgggagtacagcagtgagcaaaccacaaatagtcttgccttttaacacttacattcttgtgggggaagataaataagataaataaaatttatggtaagtgagatggtaataagtctaaggagaaaaaaaaataaaggagataaggagtgatgggggaggtacagtttaagttgggtggccagggaaggttgctaagtcattactgcagcaaagcctctgaactctgctttttctgaattcttcagtctgtaagtagttaatctcaattaaacagttgggttatagttgtttcatgataatctgtttattaaaagcagcagagtggaaagcacttggtttctgaaattagacataagtttgaatatacatttagttgccaagtaaacttggataaaatatgtagcctctctaagactatacttttatgatctataaaatgaggctaatgatgccttataggtttgttaagaggactaaatgaaatagcaaagatgtagcatctaacattgcttggaacaaacgttagaaatttaacaaatgttaaatttaacaaatgttagaaatcctattgtctcctctatgtggaatcctattgtctcctcttggtgtcacccacaggagctaagctcagtgctgggtatagaatagatgtgtaatagacatgttcggtaatcagtgtcctattattggctcagcttttatttcattaatttagtcacatgacatttactagcactttctgtatataaggtgctatgaatattaatacaaccctaaggtgtttataatttaagaggaaataaaacaaatacataaattaagctagaatgtaaagataaaagtaaagacaaatacaataagagaggcaggcacaaattgatattggtattcacatgagattgcctcctcagtggagagaaagttttaagaagaggtgacattggaactgtgtcctaaatttctgaaagggttttaaaggagatttcaaaaaaaaagcagacagaaaatgagcagaaactagtggatggaaaatagccttcagaatgcaagaaactggcaggtggttcagtgtgggtcacagtgattctcagctctggctgtagagtagatactggaagggccctataaaagatactgctattcattgctaccccccaggaattctgatatagttggtctagtatgggacttaaacattgtcaattttaaaaaaagaagaagttctcaaagaggtttttttgtttgtttgttttttgtttttgagactgagtcttgctttgttgcccaggctggagtgcagtggtgcgatctcggctcactgcaacctctgcctcccgggttcaagcaattctcctgcctcagcctcctgagtagctgggattacaggcacccgccatcatgcccggctaatttttgtatttttggtagagacggggtttcaccatgttggccatgttggtcttgaacccctgacctcaggtgatcctcccgcctctgcctcccaaagtgctgggattacaggtgtgagccaccgtgcccggcctcagagaggttttaacgtgcagccatgggctgagacctcaggccagagtatactataggggaaaggtttaagatcaaccaagaaccttatattgaggccatattgtagaggccttgtttcagattaaggagtttgattttaatttaggaaatcattgcccttgaaccaggcaatgatagctggaccacttctgaacttcctggatggttgatcagatttttaaggcatttgtccctcaatgctcctgtcttcattgtattactgtgatttgggtacatttcttatatgccctataagcataccaaaggtgaaaagggggttgtactcatctttccgtcttcttcagtacctaatattgtcttacatttatattccctgtaagtgtttgttgaatgagtgaatgaattagtcaaggatcagagctgcaattcgatttggggtccatacatcaaatcagtagactgctgcaatatgagcacctgggtaagaacactggcagcagggatggagagaagacacccataatacctgctgcagaagaagtggttctattttgtcctttaaaggtggccaaatcactcacccgtcaaactgactcagagttaaagcggactaggaaaaacacggagataatgaaagaaataggcaagccatgtgaatttaggagaagatagattttaaatcgtttgcattgaaacttcagagatacatccagattgagctgtttctcaggcagatggaaatgtaggtttgatctttggaaagaggttaagagatttacatttataacttaagcatagataaggaaaaaatgaaatgtgagggaaaaaattgttcgacctgaataggcagatggaaagtagtggttctgagcaaaatttcagacagtttcatcaagtcattgattttctaaaaaatacatactgttataatttggggctttctgttctttacctgaaacataactaaattctgctttttctttatcaacattttcccactgcactatctattcacagcttgatgaaaaagtccaggacccccccgagccctttggcccccagaatgcgataagcagcctaagcccagcctggtgtccttaacttctcctcctgcaaatagggtgaacagacagacaccaagatctaagttcaggaaggagaagccaccacgttctccagtccaactttattagtaataaaactgaacttgtattttgatctccttttggctcctggaatctttttttttttttttttgagacagagtctggctctgtcacccaagctggaatgcagtggcacagtctcggctcactgagcctccgcctcctgggttcaagggattctcctgcctcagcctccaagtagctgggagtacaggcgcgagccgccatgcccggctaatttttgtatttttagtaaagatgggatttctccacgttggccaggatggtcttgatctcctgacctcgtgatctgcccgcctcggcctcccaaagtgctgggattacaggtgtgagctaccacgcccagctatgttcttaatttgttaagaatccatacaggaggagaagtaaccaatttgcctacccccaaaccttctgcacttataaaccttaaatctttgtacagcagtctggtcatatattgaatctaaagatatagccatactcatctagggatttgataaaatgttctgaaatggacattttagctgcagggaggcaaaacccgagagacctttgtatcagcttgtgttcttggaaagagagcctccaattcagaccacccatcgctgggagctttaggatccaacagttccctgagggccttagcttctagctaaagtctcctgactaaatggattgatttcctatcttcccataagggactatgttgactcattccatccaccccgtgtttacctctatcaccagcagatgatatccccatccggctctcccctgaggaccctgcttcccttgctgccctctcagcagctgaagaggtttctttcatccttcctactgtggctccaccttgccaccttcacacatttctcctgtctcaagaactgtagaccctttaaagcacaagttgctattatccgctaatgtttaagacactccctcttatttgctgaagattttagaacttggctcactatcttcctctttgtcattattctcaaagtcttcaacatccacatagatagatcatctatctgtagtttgttattcctccccgttatctccatagttctttccctgcacaccctcttagctacctacccccgcagtcataccccagaccttgtcatcaccaataaccacaccacctctgaaatctccaggtcaagcatcccattctctgatccccaacttctttttctacagctcaggtactgtgatagctccactccaacagtgtttcattttggacctccactccaacaccgtttacgtttttcattgctcatcactccctcctccctgcctgcctcaggttctcatttatcttcttccctatttaggttccatgcccatgactaggtatttcatcctcgacactcagcctctatgccccttcctctctcacttcaacagtccagctctaattaaactctgagcctgtccctgagcagctgactgtggcaatcaaccatgctgagtggctttggtttgaataatgaccacagatctcaaatcagcatttgagaaatcctgctacatttccctggtaaatttgttcttcaaacccctccaatatctcctctcctattattctcagctgatgacctggctgatcttgcattgaggaaacagaagcaactacaccagaactacttcatttcccatcactagagccacctgtccacctgtgtctgtgtcgtgtctcctccttttcctttggtaacagtgaatgaatggaccacccttgctcctcactaaggctaggcattcttcttatgcttcagaccccagctctcctcgccagcttaagtattttgctcctaaaattattccgtttccttcattaccacattcctctctctgctgatcgactcctatcaccataaaatcatgtggcagtatcactcgtcttcagaaaaggaaagacaagacccctcttgactccacagtgccctctagctatcttgtttctctgctctttttcatagcaaagtaccttgagttgtctatagtgttctattgcctcacctccagttcacccttatttttctttactttttttgaaatacacatacaagacagcatatataattcgtagaatattaccaatgtttttaacactttgtgcatcctttcccaatagtgtgcccttacctccactgcttaagtaaccactctctcaaatttttgccatcatttacttgcttttcttttttcttttttcttttttttttgagacagagtctcactctgatgcccaggctggagtacagtggtgcagtcttggctcactacaacctctgcctcccaggttgaagcaattcttatgcctcagcctcccaagtagctgggactacaggtgcctgccacaacgcctggctaatttttttgtattttagtagaggcagggtttcaccatgttggccaggctggtcttgaactccagagctcaggcaatccacccacttcagcctcccacagtgctagaattacaggcgtgagccactgcacctgacccccacttgttttttgtttgtttttgtttttaataattttacaatatacatatgtatccctaaataatacatttttgttttgcatgttttggacttatgtatatggaatcttattatatattcttctgtgaattgcttatgttgctcacctttagatttttaaaaaattcatatggtgtataattcatttttactgcaatataatattctactgtatgatattagtttatttttccagtgtattgttgatggacacttgggtcacttcaggattttttgccattacagacaaagctactatggacatcctcgtacttggctcctagcacatgtgtgcaaaaatttctgtagggcatatactgaggagtggaattagtgggttgcctttacttgatgttacctaattatcctctgaagtgttgtatcaatttatactaatataagcactggatgaaagttcccattccaccatatgtttgtcaaaacttggtgctatctgacttttaaaaattttgctagtctgttcgttaagtaatggcatctcattatggttttttttttctttctttttcttcagacagggtctcgctctgtcacctaggctggagtgcagtggcacaatcccggctcactgcagcctcagcctcctgggcttaggtgatcctcccacctcagccttccaagtagctgggactacaggtgtgtgccaccacatctggctaatttttgtattttttgtagagacgaagtttcaccatgttgcccaggctggtctcgaactcctgggctcaagtgatctgctcacctcagcctcccaaagtgccaggattacaggtgtgagtccctgtgcctggctcattatggttttaatctgtatttccctatttactaatcagctacttttcaatgattataggctttcatgttttctctcttgtgaaatgcctatttgtatttttggcccatttttctactgggttaattgtctttcccttattgatttgtaagaatgtcttatatattctgaatactaatccttgatcagttatgtgttacaattatcttctcccagtttttagcttgtctgtttactgttgttatggtgccttaatgaacagaaatttcttgaactataagaaattgcttatatgtgatgattttcacttacacaaactattccatgtggttcctggagagctcattaaaacacagactgggctgggtgtggtggctccacctataatctcaatacttttggaggctgaggcaggaggatcacttgacaccaggagttcaagaccagcctggtcaacatagggagaccccatctctaaaaaaatcactggagtgcagtgattgcaccactgcactccagactgggcagcagagcgagatcttctctctaaaaataacaataaaaattagttgggcatgctggtgcatacctatggtcctagccactcaggaggctgaggtgggaggatcagttgagccccagtgttaaaggctgcagagagctatgatcatgctacgataatgccactgcactgcagcctgggtgtcagtgagaccctgtctctaaaaaataaataaataaataataaaaatttaaaaacacagattgctggaccccacctccagagtttctgattcggtaggtctgggatggagccttaaaatttgcatttctagaaagtccctaggttatgctgctgatccaggaaccacactttaagaaacgctgcctcagccaggtctgtcttctgaacatctttcgccaatcctctctccatggttccttagagattacactctattgcctaaaatataatccacctcttctgctcttgacctatcaatttttgggccctgggtcaccttaattgactttttaccaggccttctcaatcctgggtacagatagctagttgcctaaggaatgcttgcaatattaataaatgctgcctttttgttcaaagttaacaggtagcttttagaatggcctagtattattgattagctgactttgtagtctcctttaggagtataagtgtgctgaagttattctgatacaacgttaagtcatgaatcaaactcattgtccttccatgctccagtacctagtctccttccccaaaatcctacccccttttttccttcaaaattgcacttcagatctgcatcctttcctgtcatcagttagtcccctaaatccccagtcctatttgtgatacccatgtatttttctgggacatgaataacaacctcaaacatcttaataataaagcctcagatgggtaacaggaatacactgcaaaaattaaattacaatatttaagccttccttgtaatttatttagagccaggtttcccagcagtgacactgttggccttctgggcagatgactgtttgttgtctgggcctgcccggtgcactgagggtgttcaacagcagcagtggcctccactcaccatgccagtggctctccaccctcaccccgtgtggccaccccaaatgtcctttgagggcaaaaacctcctctggttgagaaccactgatttagagacatctcatgccttatttgaattttcagggatttttttggtgtgaagtattgtcagctggtttgggccttttaaaatttcaactccccaagcccttttaatcttctccatttcttttttatcatatatttctctttgtttctggctaaaagagggcattgtattttcatgattttttgaaaaccgattctcaaccacatttctccaagacaaagggcagttcccaccaaacacacagaagcagaccctaggacacacttcagattcttttcctgcccttcctgcaagtattactctcaccataggatggtggtagttactgtgattaatatacttttaactgtaatgcgattatagaaaatcatgccaaaattgctagagctaaaacttgacctgccccgacaggatgatgaaaactcaataccattctccctgaccctccccatccgcctcactccccaaatagtcttgcttcttaatgagtaagagtagtttaagctgcaattatttcctcttacactgactgtccttttcaccctgattactctttggatgtataatggggagatagccgcatgcagactagcaaggaggtctggtgaatggcagcaatacatacttactcgggaagagtgcattccactctcagaacaacctgcccaaactgaatgcggctcacaagtggagtgggcagagctttttacaatttcaatttgaaatgccacttttctagttttcgtggctaaaatagtaaataattttgtgggtttttttttcagctgctcttcatttgacatttgctgagcccctcttgaatttacttttgcagaacaagaccatttgtaccccaactatttgtaccattaggccactgctcctttttagttgcatttagggaccttctccaattcagtctctttctacatgagcagagcacctattcattcaaagggaacaccatgacacagccagagactatgccccgggagtataaagagctttgtgtctgcttcccagtttcagaaactcatagttgcttatttaccagatatcaaccaagctctgggtaccaggcacttttgtacatttctagttttgtcttagctgagataaataccaactaccctgaagtactgtaagatgtacaagtaccttattaatcatccaaaaaaaaagcctaagcaataacagtgttttatattagtttgagggttagatgaattctatttttagctatatttttctaggtagcagttctaataaacagacatttcataactactaatcaaaataagtcaatgccttggttatctgtaattttctcttacaacaactttagacactggaatagcactgaaatagggagtaatgatcttaattgtgtatttcttggtaaatgacagaattcctccatatatatgattttgtttgatttttttaattggcactacgggcaaaggaagaaactttggggcaatgagtggttttaaaaacataggctgggcgacgtggctcatgcctgtaatcccagcattttgggaggctgagatgggaggattgctggaggccaggagtttgcaatcaccctggtcaatacaaggagaccccatctctacaaaaatttcaaaaagtcagcagggtatggtggcatgtacctgtgggtccagctacttgggaggctgaggtgggaggatcatttgagcttcagaggtcaaggctgcagtaagccatgattgcacgccactgcactccagcctgggggacagaatgagaccctgtttaaaaaaaaaaaaaaagagagagagaaagagaaagaaagagagagaggaaggaaggaaggaaggaaggaaggaaggaaggaaggaaggaaggaaggagggaaggaagaaatctatacacccaaaaacctaaacatcatccctgatgagtgtgaccagcttgcttatcaaaaggcaaagaggggttctcatttggtggcggtagctatctaaaccaaggcacttgctgcaaaacctagaaacatgggaaaatgacaaataaaggagccaagcaaaataagcgttaaggaaagggggaagaagaaaatatgaagactgcaggacaaagaagggagatgactggaaagagaagtgaagatttcaacactgatgtgagaaagtgacagcataagttacaaagaatttgggaaagattaaatacttcttcagggtgggaacaaacagccgagcataatggaacagtcttttaggacacccagccctcagagctccagacacctcacttcataccagtttagcccagtaactgctcttcatagcaaatctccttcttgctgaagaaaagtttgaatcatgtttgctattttcatgcaccaaaaccttcaaaattacctaaagaaaaaaagaagtttgcttaatttcccctgtaatgaaagtctgtgtggaatcacttattgtctgacaggtctcactaaatttgacgttcctgtcctggatttatcaggatacctcattacttcatcatgctatatgtaagagtcaactagaatatagtcaactcattattgtttgaatgatgtaagaaggaaaggttgataatccaaaagggtatgcaaacccctgtgatttatacttggttatttgcatttgtattttgatattataaacttgcccctttgtattgtaacaatctgttaacccatctgtctcctccactagactatcagcatcttgactgcagggaccatcttagtatccaaaagctagagcacagtctctggcacatagctggggttcgaaaaatgttaaataaatgaagaaaaacatgtatctgatctgagaaatcactgcaaacaaagtaatgcctccacacaatgaaaacactcagtaacacctggaaagcttaactgcttgtctctcagactgctgcgaagcccccaacctcaaccaaagtgccctactgtaaatcttttcccagaataacggaagtggttaagtgttcaggtgtcaaaatgctaccctgctgggctgcaggccacatacaaagttatattacattgagtttgaaatgctaacaaagcaagtaattaagctgagtaagtgctaacttgcttgcaagcaagatttgaagctgataaaccaaaatgctgataattaagagttgattatacagctttgttgtttctctaccctgctaatagcctcacattcttggcatgtaatgatttcttccccacaaggaaaaaaaaaacacacaaactatcaatcttctcctcctgtctcccaccctgaaaaaggtgtgactccctcctttcttaagctaaatcctctccctgtggtcttgatccttctctctattgcatcttttacctctcactctccacgaatttcttcttttctgtttgcaaacatgctcgggatttaccaaccttaagggggggaaaaaaaaaaaggcaagccagcaaatgatagtaggagaatcttcccttactctacattcccttaattctctcccatctttctcctctgtatcccctaacctcttggaaaaggaatctgtgttccttgcctcctcaacttgatggctgattgctttttattcccttaaacacttctcctggtttcagcactctaatgaggctctttcaaaagctataaataattcttaattgtcagattccggaatctttattttcttcatctctgcaatctttcacatggttgacctgcccctttggtagaactattaaaggggcttttatgacttccatgacattcttaccttctggttttcttcttccttctcttattactctcctcaccctccctgttctccttctttcttttccttcttcctttctggtaagagaggaaaagaaactaatatttattgacatacaagacaaattatttgtcagatgttgtgccaagttttcaaacgtcttttattgtcacatcaaccctaggatatagatattcttatctccattttaaaaattatttatttttaattgtggtaaaatacacataatgtaaaatttaccatttgcatcattttaagtgtacagttcagtggtattaattatattcacatcattgtgcaaacattaccaccatcaatttccagagctcttttcattttcccaaactgaaactctgtcaccattaaacaatagctctccattctcccctcccccagcccttggcaaccatcattctactttctttctttgtgaatttgaccactctgggtaccgcaaataagtaaaattgtacagtatttttctttttgtggctagcttgttttacttagcatgatgtcccccaaggttcatccatgttgtaacatgtgccagaatttctttcgtttttaaggccaaataatattccattgcatatacataccatattttgtttatccacccaactttcaatcatccgcatataaatggtgaaactgtggctcagactagtgcagtaaactcattgaggttgcacagcttttccctctggggaagcattcttctaaattctatccttagtcttatttcctctttccctctctcgctctctctctcttccctctctttgctgatctactcccatatttttaattttaatctccatccatgtgggtgtttcttaaatgtatatcccaaatttatccttggtactgaatctagttccatatttccagtagatccaaccagaatattcccatattgctttcaattcactatgtataaaacccaaatgcgttatcatctgatcctcaaaacaggcttgactttctcacactcctattgttgttaatggcaccacaaatttcccagtcatctggaccctaaacctctgagtcatccttaagcctctttctccacatctcccaaattccgtaaatcctaaagtcagtcttgtcagttgggtctccctaatcatcttcatgcccattccagccttgctgtgcctgcagaaggggtcctacagtctggtgggtctaagagcttgggttgggcttaagtcccagcccagccactcactggcatggagaggacggaaggtgtttggctagtcacctgacctcactgagcctcagcttcctcatctgagagagagaacctaatgagcaaggtatgttgatccttaaatgaaatagtatttatgaatagttcagcacaatgcccagcatttagtagatgctaagtaaatggttattttttcttcttttttaaaaaattctgtcttcctgcttctaattcactagccttcttccctcataaggattttttttctctctctcagaattctctgcaggaaacaaaccactgtattttagcattatgttttattttacagtgcccttgattctttatacctgtctgaggacagtgactgtgctgaccctttacatttgtgtttcaacaatcctgaaggggattttcatctcctgaactgctttatcaatattgttttataaacaattgtgacctacaaaatttattgagcccaacctcattttttaaaggactgctataaagtcagtggaatagcattttcatgattaagagcagtcggagggattaatggagaggcagcatgagcttattcctaactttgagtgtgccaggagttttaacagggataagaggagtcaccaaacatctcttccctgtcccttgtattattttgcaagaacataggcaaacttgtgcatatttcagcagaagggatatctgggtagaagattgcattcagtttgtggagtaagggcatgcaagcaattaaatcccaacttcctcatcagcagtctgtactcaggagagctgtccagagtagccaggccacatccagccacattggagataggaattccatgtatatggcaaaaccctatctctactaaaaatacaaaaattagctgggcatggtggcgggcacctgtaatcccagctactcaggaggctgaggcaggagaatcacttgaaccagggaggtggatgttgcagtgagccgagatggcaccactgcactccagactgggcaacagaattgagactccgtctaaaaaaaaaaaaagcgtatttacttttagaaggttgtgttattttttacaattctcttataacaatgcacctccttattgcccgcacctggtgtactccattccaatctccttgctcttggggtgtgtgtgtgtgtgtaaaatgtctggcataaaacacaagtgtgtgtgagagtcaatgtgtatgtgtatttcacagctggactcatgcataacacccagttaatggtgtcactaaggagtacaattagaggatgtataaagaagagagaactgacaaacttttctgtactatgaaaattttacaatgggaaataactctttacaatacagttttttcaataagaaaaaaaaaaggaattccatgtatgaatcctaaactaactgtgttccttacctagctgggttgctgcgtttccgaaaacccattagcaacaaaaacaccaacaaaaccccaaacaatctttatgagtagcttggaaaaaaattttttaaatgcgtgaaaaaagtagacttgtgatggtgcacttcagattaattctttccattaacattttgaaatgttaagtaaataggtagtgaaatggggatggtgctagttcttcatcttgtgttagacatccaggtctagccatgtctgtacttctctaaatgtgactgtgtattcactgagattgctgctgagcctacctgagatcatgaggctgcttactcatcagtgaacagcatgaccacccttggtacacactccagcttcaagctaatggttcaggcatatctaaaatggccaatctctccaaacacttgggctgaattcattactcctgcctcattcctgaagtgcataatcaaattctaaagaccaattgcttgatattcatattttttttcctacagcaggttttactcagcaaaaaacggacaatactactcaatggataacttagtagttcagaagccatgttatgttttgtgcttgtatttttatctcatgagtaagactgtaattgtgaatgtttgtatattgtcttctgagtgttcttttctcctgatagccttccttctcatcttttctcagtctgtctcttatgagtcctgaaagtgggagcccctggtattccatgtacctgttttgtgaaaatggcagactctgctactcacttttctttattcataattatctatcttggcccaaatcctatttttctcccattctaattgagaaatttggttctcttctctctacattgagttgaaaatccccaggaacccaatagcagactggttgttaagttgatttggtcccaaaagaaccttaacaaaatcctctttctactcttatgaatcgaattcccaaaactcttttgaataaaccatcctggtttcctctaagctgatggttagagttgggtcatggagttcagggtggaagtattaactcagaaagtcaaactccagtgttttggggcctgtgggtgaatcaatgcttgaggaatattgtgaccatttatttgcctattctcttttgtccctgcccaaaacctcaatatagtgatattaaattttataaatgtggctcaaaacttgacaactattatatttgatattggactgcagccatcctctcagggatctctgccctcatttttttccactctgattacttgcctccgagtgaagggttcaagaataaatgcattaccaaaatgaagggaaacagtctttgaacttctgagtggagaactgtaaagtgaccaagaatttgattactagtcaggcttctagatggtttattaatgaagcagtgcattctccacgaggggaaagaaatgccattaatgttatacccttggcacggaagttcctatttaaggaaaagtaaatgcatagcctgcgccatgtcagaaaactaattttaacgttaacaatgagttgagtattcttatagttatgagaaaatattccagccttcattgccttccacaaataagttgctggaagtaaacgaggtgtgctatttcagtaccaatttagcaatacctctgctctattatcagcaacatgcacagttggttcatggcagaatgcaagccactcttgtctgtgaataagcatcaggctgactgtgcaggatgataattgctctgcctgcacttcctttggcacctactgatctccgctaagtggttagtaaaacatatttttgaaggaatgtcaagcacttctaaaaatttgaaggacttcatctttgattgttctttttcttatgtttaagtttgaagaaagttcacaccaagccattccacggctgccattactcctagcaaatgtctgaaatagcagggtgccagtgtgtctgtgcttggcatcttttaatcagcggtgttttctttttcatgatactgtgacactggctggatgtgttgggatatcaagtgacggacttcaaatagatggcaaattcactaaagtgaaaatgattgtggtagttccctcatttcctcctgcagtgtatgcaaaactgacttttaaagtgtttagtggataatagatcatgtaaggtcagtgctagccatggcagccatggctattattttcccttttcatgggagtgtgctcagcaaaatgagattgtcacactctttttttgagaggacagcgacagacagttaaaagcctcttcatgtaaggatgttatttcataaggacaccagcactggattatccccttcactttaaacttctgccagcttgtacaaagagataaaacaaaatagccctggtcccaggggtggggaagtgccggccagctcagcctgggtccacaggctttcattttgattcgtcacatgtgaggaaaattcacttaggctgagaggtaaatttaataccagttatgcccatgctgttcatatcacaaccattttcacatgatgccacttaattccctaagaagcagaaaggtaaatcggtggctggccagcaaaggtgtcacaatgcattaagaccaggactcgctgcaggggataatggttctgattgctgttgactcatgtctccaccaactgcctcatgtaaaataagtgacatttaaaagacatcaagatgtgagaagaggtaagggagagagaaagaaagagagaggagggtaaaaagtatgcgccactaaacttgccacccgaatgtgcagtttcttttccaccctaagtggtaggaaatgataactcgacatgccatgggtgacctgcgctaagcctttaacttcttgtcttgtgtttttagagaaaaatctgtaaaattgcttctgggaactgctccaacatgttatcatttatttccaatttaattttttttaaactcttattcttttgccctcacatatcagtctattcatctctttaaaagctttaggctgaatcaagttaggcagtggtagacaacaagaggcaggctactttctgaaggcccatttatgtctatttttataaagagaatcaaattccagtttacagtaagcatatgcttcagttgacatctgtttctaagacttggacgctttgtttgcataacagtcaccaataaatggccttgttttaagtctgctcactgagttgtatgtgggttgttcagctggggattttagtcgcagctgatcccctaccgctcatagctgataggaagggggaaaagccgagaagcccagtcctatttattaatgcagattttaacattctcaatgaaccacttatccagtgtgattcggcaaccaaatccttatttgctcaggcagaggagggggtgttcttaaagtgctgaattaaagctcttaccagctttttttttttttttggagggggaggggaatggggaagaagaagcaagagcaaggtcctttctttagccagtctctgataatttggagtacaatgagatcgaatctttaaacaggacatcataaaccaagcttatgtttaatgtatttgttgtaaactaagatgatcagatgtttgcagagccctaaatgttggccctttgtgcaaagtcttgatgattttatttaataccacttaaatatcagtttagagtttgatagaacagggttatgtttccttcattcatctggtttttgtttcattttaaagcatatctgattctgcatacgtgggaaacggacacaatattaaaatatttcaagatatacatgtgactgtctttagaatcgttactgctaattaaagaagttactacttgtgttaagcagcttcaaatacaaagctaatcctcggtctcgataagtctgcccttttttctctgcccctgaaaggcatgccagcagttaaaaatattaaaagtccaaagatggggtcgatgtgccttagagtgtaaacctgattaatagagggcttccctttaattcccttttttacatagaagagatctaactgtaatgtatttgaaaatatgtgttcactgacaaatacactgaactttttcccctgaattattgtataatattcagtaatcgtttatgaaatgtgtaacatttttcaaggggatttacatatcaacttttcctagtggaatcaacaacagtagcatgaaatgtatctactccatttactcttatccagtgctcctactttctttttccctttaatttttatatatggtaaaaatttcattgaagagagattttagatgacaggactgtaattttaaacccaatagaagaggtgtaagcaatttgagcttagctgaagcataatcttaggttgtcaagaagaaacccattctccctatgctaatcaatcagtgtatcaaccaaccaatcatctcttcagcttagcatatatcctaaggtttgatatatctattaactgcccatcatgcagctggtctctggatgatgagattccccctatcttggcatttggcggcagacgaccgagctatcacagcctcagataaataccaaagtggagatttcaatcctgttcctgagtgcagagacaatcgagaaacgttgaaaatattcttagaagagaatacgcagaaaattacatttctcaacactgttgtatgtgaaaattgtatatattacatgattctccctccctagacacaacaatgtaaaataaaattactcttttattatgattggaatgctggtaatcaaaagaattgttggaatctgctacaaactcttaattgcaagacaaattacatgtagacatctgaataagtaagactaatgaccgtgtagatgataaatttcctgaaaacaaacagaagcccaattatataaagcaaggcacacaatcattataattctggagaagggggtcactatttctaaagattttatattgcttcctggcctctattcagagattctgatattaggtaagctgcagctgaatgtatctgtagcctcttccaccagccagtgtattggagcatggaaaggaggcagggtttctataaaactgtttattgagaaatagaaaccaaaaaaaaaatgatttaattgctaagcatctgtgaatatgttgaaattgggatgagtatgattcatttcttcaaacactgatatccacctggaaggtaaaatctctccacaagatgcaaactcaaatcatgtctttcccacactatagttaaagtctcatactctgaaaagagaaccatagtgaggtattaggggactgaggttctagcccaaactcggtcattaactagctagcctctgtgtgctaagcaagcccctggatcctttagaccttacttcataaattgcaatgtctctaaagcacctatgaaaaacagtaacgaggcagggcgcggtggctcacgcctataatcccagcactttgggaggccgaggcgggcggatcgcaaggtcaggagatcaagaccatcctggctaacacagtgaaaccccctctctactaaaaaaatacaaaaaaattaggcgggcgtggtggcggacgcctgtagtcccagctactcgggaggctgaggcaggagaagggcgtgaacccaggaggcagagcttgcagtgagccgagatcgcgccactgcacaccagcctgggcgacagagcgagactctgtctcaaaaaaaaaaaaaaaaaaaaagaaaaagaaaaaagaaaaagaaaagaaaaatagtaatgaattactctcctgataagtaaacacgatttcatattcttccaaaaggttattgtttttcatgtcactaatggtatgaatgtagacttccaccatagtatttgctcagccaaaatctcttcaatgctgttgggcagcataaacaaatgagaaacatattctagcctaaatacaacgttctgggtttgaagccattgtttcaatcatttgttgagggtggggccaaggaggagaaatgatggagttcacaataacatgaactctttactgctggagagagaaggaaatctgttttctgtcctgagaagtccagcatgagttcatagagaccgtgatgacttctccgttctcaacaactcagcctgtgcactttgatctcaacttaagaacactcgtgtgtcctggtgtgaaagggctgataacaatataacagctctagaatttttgtatttttcctaacagaaggataattgtggtgtcaagttcagagcaagagttcggtttaaatagtgtattttgaaaacctttctcgaggagttgtgattctaagagaaaacaattttctatatggcttaaggttacgaattttatcatagcaaagagaaggggacaaaaaaaaaaacctagacagaatcattttctctctctcaagtcacttaaagcgtccattctaggactcattccaggctcctatgattagagacctgcatgtttgtagatatccccagataagccccagatatgagcacccatgacatggtctctgctgaacaaagcaaaaggattgatttagagaaagatggcctattgaatgtggattcttccatgttgctggcctggaaactggtaagcatgcacctttcaggcccagggcagtcctcctccccagaggatctatcctgtctattggtgataattgtcctgccaggtctacagattgtggatatagataagaaagtcagtgaaagtggattgagtgcaattagaaacttacccacacaagaactgacctgtgattgcatttgtaggtagaatcaggtctggagtagagagacagcatttaaagctcagcaaatagatcttgcaaaagaagagggattcattttttattgctgagttctaggtttagaacaattcgttgctattctccatgaatacagcataacttcatgtgcatcgtgtaaacatgcccccgagaagaaaacaatgaggtccctgtcctcaagcagtttatgttcaaagacaacataaagaaagagatcaaattattttaatgaaaccttgaaggtgggatcagcaaattttctttatcaaagtatgattgatttttgctttttaaaagaaaggtttgctcttatgttatgaattctctcaaatagaaaaagtgggcactaaaacagacgtgaggatgaaagtgaaaagaaggagagagaatgagatggacagagggaaaactgagggaatcaagggagggagaaagcaatgggcaaagtgaagggagggagttctttcagcttagaatacactggggctggagagtgagtatgcacccaaacatcaggcaccaaggtttgaccaccagttatagctagagagaatctccccaaaggtgtcctttccaacttgctcttggagagaccaccattaaccagtacaaagcttatgaatctctgcaggattctagaagcattatgctcagccattaaaacagtgcagcagacaagggaagaaagcaggcacagagaggagagggaacatagtgaatcctttataaacactctaaatggggggaaataatgacctctgacttctttgtggttctcaactcatgctgccacaagattggttataaggtccatatcacactgtgatatgaaagtattaattgaataggagcaatcagcatttctatgtgaataatgacttagaaataatattctgcccatttcaacaatggaacaggaaaccaaggcttcacctggctacacagttcttttgatgaggtcagatttttttttttaactctgaggtatatatattttgtgtcctcttttaacacttcaatctgatacgcatttctttggagtaacttaagaagatggaataaaattaagggaaggcaatatatgatagatgatagtattgtcctttaagttcaaattatgactttctgacagacaccttcatcagctctcatctgaatagtgactcttctattaaaagcaaagccttggccaggcccagtggctcacgcctgtaatcccagcactttgggaggctgaggtgggcggatcatgaggtcaggagatcgagaccatcctggctaacacgatgaaacaccgtatctactaaaaatacaaaaaattagccgggcatggtggcgggcgcctgtagtcccagctactcgggaggctgagtcaggagaatggcgtgaacctgggaggcaaagcttgcagtgagctgagatcatgccactgcactccagcctgggcaacagagcgagactctgcctcaaaaaaaaaaaaaaacaaaacaaaaaacaaacaaacaaaaaaacaaaccctcgtttagttcatagtaatgaaccaatgtcagtttcttaatttcgagaagtataagatgttaacaatgggagaaactgagcgaatgctaggaactctctactatctttgcaacttttctgtaaacctaaaattattccagaataaaaagcttatttaaagaaaaaaaatgcaaccatgtatatgggctttgccatgaacacgtttgaataagaaagccctcagtgctacatttatgggagcattttcttaatctttctggaaatgaacgctcattggagtttgatatcctgagaagctgatgactaaccctatgctcatgtataccaccagacaggtcactagctgatcaggctgaaatgctcacttatccagtgttgagtcagaaagagaggagaatttaaaattagctgacttcttggactggcacctagcactaaaataaaataatcccttagcatgtttactagccaaaacatactgtatcacattgtaagttgctttaaagtttgtattttctattaagcttgctgcatggtgatcatgtaaaagtgtctaatggttactgtaaaattagaggctgtccaaacgaaacttaaaatcctgaaactttctctccaatgtatgataattcttggctacactagtaaacagtttgacatgtgtttaaacataattcaatttttttatcagatcgtcttttcttaaaggtatgtctaatgaagtgtgtgactgtataatagaggagacagtatttgatttttaatttttatgttaaatggtttccactgttgtatgcccatttgagtttttacaataaaagacaaatataaaaatgtgtatctatatcactgtgcttaccatattgttttactgatgtttttgtgttcatcttttcccttaatgagtgaactccttgagaggaggggctgtggtcttagtatctcgcccagtgcaacatatagtaaggattcagtaaatatttgtttggatgaataaatgaatgaaatcacattcaaatgcattatttctcctttgaagggaaccaaatagctgccagtcaatttgctcccttcactgcccttgttttagggtggcctcacagtttggactggtttttatcattgctatcattcagccacatatactaacctttcaaatctgcaaaaagtatttaaaagaaagagaaattgttcatgtttcaaaacctattataatgcatcttcaaatatgtcagacacatctttgttaaaattaaaccagggattggttttgagcgaatagccctatatccttacagatgctgtggatggatgcatctaagctgcttattatattgatgggttttgctgctctgcagcaaatgaaagcaggcagctgcttcctccatcaaagcaaaaagcagcctgagtttttattaaccgagtgttcatttcttctattgccaaaattcttacacaaaacaaaagagcagttttagcacattattgcttaactagacatgaacaactgacagcaagtgataagcctgtctgcttttcacaactggtaatcatttttggaatagatgttttaatatagttgaatataaattttgtaatttacatctacaatggtacgtaaatttatagatccagtttgttgcaggagaatgaaggctataatcacaaaaggcttttcccagtgttgtttaatttttaatgactatttgaaaactggggaaggaaaatgaaatcaaattcatttccttaacaaaaaaaaaaggtgttaaagacaatcatacaagttggttggagacatttgtagatggccccaacagagcaagaccgctgtgtttacagccaggacgtgcttagcactacatttccacattagttgcagtgagctgcccaagttagtgcagcagcagaaatttttggagagcagactgtcacatttccttcatatcaatgaataatgatgagtggagatacaggaaggacagagtcctggccattttgcacagctgagattgtcagccagctctcatacatatatatgtgtatatatacacatacatatatatacatatatatatattttagcaatctgaatgtcatatatttaatttcagatggcatggcaaagtgaggtttgtttaaagtaggtttagactaaaccccaatgagatgttgccctacttaccatgtaaatttgctgagtagtgttttaccttttggaacttgctaatggcaattcctgctgttagaaggggaggcagttctcctccttcccccttccccacacagaaatgattctttcctcaagacctaagagaggaaacttggaataaatgcagtgtgatatgctgggacgtgcacctaaacaacattgctaaaataagttatgctgcctaacagcctgataccaggactgtttaatgaatgtgttctgttcttgcatctggaacatgcacctcctaaatactatttactctccaggaaaccttgcataaatgtgtagagcatgcattccacatggaacacatggctttcaatttgtttggaatttagccatagtgtttacctgcaaatgagataaagctggactccgaggcaggaaaatgctttagaaatcaaattcatgaatcacaggtaactccagggaagaagctcacttttgctattttggtatgccctgtaacaagtatgtgtctgtgttcgggatgtggctgaacacctaagacagggaacaataacaattattcctaatactttatttcctccactccattggcacattgctgctcttacgtgccttttcaagacatgacccagcactattttttatttatttatttatttatttatttatttatttatttatttattttgagacagggagagtctcgctctgttgcccaggctggagtgcagtggcatgatcttggctcactgcaacctccgcctccccggttcaagtgattctcctgcctcagcctccctgtaacacggcacagttttaaaagggaaaagggtgatctcatcagaatgatggcctgttcatcccaccctgaggacactcaagcacagcagggccttgggggaaggcattacttcccccacgtaaaggaataaaactgacaatgaaagtgttcctttttcttcttctcttttttgtttttccactgtgggaaggacatgtggtgtttctggggaaatccatgtcatgttttccctcctgctaggaactctgtggtctgattttctgggtccacctgtcctagacatgcttcttctcactttctgacatcctctctgaccaatggagatggagcattttctcacataggcccagatagctcacatcaggagatgttcttctacctgtgctttgagacctcaggagaatctcttctgcccttaggtagttttgttacactgaggagaaggaaattcttctgaggaaaaaaatacagcagagagctgtgctcaatattggagagggaaaatcatacttgaagatgttttctgttattaatatgcttgattaactaaataagcattcacatctagtttatataggtgtagggcagttattttctgaagctctgagatttaattaacaaaggtagttctaattccattgaaatagacatgtaatgaagatttaacttctaggaccatttcgaaacccatctaaaatatttcttggtagaggtttaaatttgagattatagtgaaaataaaatattttaaccaatctaatttctttaaaatgtcacaggctagagcccactggtaattttatagttttcatttggaagtgtacacatataatgatctctagtcattggatttagagttggaggaggcctcagaaatcaattcaactcttccatttttattcttgaagtgagagcccaaatatgatttgtccaaagtccccaaattagttattgacagagctatgagaactagcaactagttctcttgattctaggaccagccatcagggttggggcacagaatgcagtgatgagagactgggctctagagttagagtatgtgggcctaaaccctggctgtgccgcttcagcttactattctgtttatgctgtatttcactgtgccttttagctggtcataaggataatgcatatcttataggggttgttttaaggattaaatgtgatcatccatgtaaagtacacagcccagtgtttgccaggtagtaagtgttcaacaagtgatgctgccactgccaataataatagctgggtgtggtggctcacgcctgtaataccagcactttgggaggctgaggtgggtggattacctgaggtcaggagttcgagaccagactgactaacatggcgaaaccccgtctctactaaaaatataaaaatcagctgggtgtggtggtgtgtgcctgtaatcccagctgttcaggaggctggggcacgagaatcacttgaacccagaaggcagaggttgcagcgagccgagatcgccccactgcactccagcctgggcaacaaagtgagactccatctcaaaaaaaaaataacaacaataataataatactagcaaacactaactgagcacttactagctcctattctgattaatccccagtctatagtatggagtaggtagtattattactttcagataaggaatcggggaaggagaagttaaatgacttgctgaggtcacaaagatattaagtgtgagaggtgccttccaagttcatgtcttcacgctctaagccactgcggtgatggctatgaccgccgtgcatttctttttctcagcagtgcttccgtatcctctggtcctgtctccatttctcatctgtcactcagctgctttctcagcatctgctggaaaactgactatcagccctacgaccagggcctcggggaacgttgcctgaaggctgtcttcccctccctgcttcagtgtcaggacatggctgggaccttgtccatcttttctttacctcctaatcgtcacgttaatagtctgagttaaaatggacattttaaattttaatgcatttttaatcaaatcacacccataataaacaggccatcctatagtcctagaagaatttattgttgaaatacttgagtaattttttatgccccttcatttctcctgcttccacatgctccttatctgcccttctctcagctcaggtcagttggcaatcagattggacccttgtttttgtaatctagtgagaggcagcagatcccagaggttaagaataacaggtctataatcagattgcctgggctcaaattccagctctgtgacccagtatctgcatgactggggagaaggtttccaaacctccctgtgccttgatttcctcctctgcctcatagtccctgggcagcatcaacgttccataaattatagagtgtcacagggcaggcctccacctgcccacctgcccaccattctggaatattcagacattctctcctactcagatgttctttgtgacctggctccacaaatatagggaggcctgcacttaatcatatattgtacagagtgagtctgctaatgggtcaaagcgggaggacaagtatagaacatgtattgtccatatacatgtaatgattgttttggatccattttcaaagctcccgtaacaagggcacatttatccaaagttcagtttgttttgattttgtgggttatcaatgaggaataataatatccctgaaagtaccataaaaatgtaattcaggttgataaaattccctgaatagaaacttgtcacaacagtaatagcagcagcatcatttctgtttttaatagtaaaaaaaaaaaattactctatgttaggcacacttctgaatgtcttacatgcattatctcatttaatccccacagcaccccatgagaaggtacttttattgcttgtacttaacaaatgagagaagtgaggcattacccaacaatctggccaaagtagccacctgtcccactcccataattattctctatttcgttaacatgttttatttccttcacagcactattcactgtctgaaatgatcttacttgtgtctattttccctatgaaagttatttaggcaaaggccttgttttaatcactgctgtatcctcagcttctagaacaggcctggctgccttgataattgtatgttgcatgaataaatgaggcttaaaaagtttaaataccttgcccaagatcacagaaccataagagccagtattcaagctgcactgtaactcaggaagatgagagctggctttctgctgtagctttttatagttgaagaccccccagacataatctaacccaaggctatcattttgcagatgaggttactgaagctcagaaaggataaattactttctaatatcttacagtttgttagtggcagagccagaatcagaccccagatccctaggtagtgtttttttgcaccatgaattcagcctcctcatttcatataaaattgaaggaaaatcctatatgcgtctgctgtacatcatccgcccacttattcatgccataaacctaagtcatacttgacacttccctctccgttaccacccccttcatctaattaactagtaagtcttgtcagtgtaccttctaaatatatctcaaatctttccacttttcttcatctctgctaaccatcacccaagccaccaccagctctcatctggatattagtagtagcctcctgcctagtttctccctgcctcctcttgccccgtttcatctaatttcttagagtagccagaattatcttctaaacagtattataaatctggtcataccacgatgctgcctaaaacgtatcatttattctcaggtgtgacttaaaattcttaacatggcctctgggcctgaggggtctggcccctcaccacccctcctccagtcttatcttgtattactctcttcctttctcatttattctagagttccactgaccttatttccattcctacaacattaagccctcttgttaagactttgtttcatggagctccccttctgtggaccacttcttccactttgtcctcctcttccttctttattgtgttcttccccctctgggtctcaaactagactgaagccccagtgaccatgctatctccatccctgttgatccacaggacccgaaacattgtagatgcccaataaatatttgaggagcattctgtagtcctcttgtggatttctgcactgggttgacacatcagtgacaaagcagaaatgtgagttggattaaaagaaaaggagacagagtacaaagactgaaatgagcccaggaagcttccatactcattccaacatgagcagcttttctttttagtaacatctacccgtgcatttattcttccagaaggtttgatggcttagctaagtgtgtgttggcctctccacttgagtctcagatttgagagaggcctttttttactgactcctgtgtgataggcttgatcacttcccttgagggagctagagaaaggtgctgcttcgatggacatcagctgatcacagaaaagctgtatgtctgctgtgagagctagatgtgttgtcatcatggagcaagtacaagcagttggtggggaggagggagccagcagtgctgcttgttggatgctgtcgatcaaagccttaggactgtcctccaggacgaactatgagaagtgaaaagctcgcaaatggaactgatctagaaggccccaagcttagctggatcctcaggttactgaattttaggatttgctcagtcttcaggttaatcatagttgtgctgtttgtttccagattaactatgaaacttgacatttaaaataattctaggccaggtgcggtggctcatgcctgtaatcccagcactttgggaggctgaggcaggaggatcacttgagcccaggagttcgagaccagcctgagtaacatggtgaaaccctatctctaccaaaaatagaaaaattagctgggtgtggtggtgcacacctgtagtcccacctacttgggagagaatcacctaagcctaggaagtcaaggctgcagtgagccatgacggtgccactgcactccagcctggctgacagagtgagatcctgtctccaaaaataaaataaaataattcgaaactagctacttcactaacaataacaacaacaaagtggttgcttatattaagtagatcacattgccagttttccacctcactcttgctacacagacagctgttttagtgttggctggctataggctttctaaagtctgacaaattcaacaggcccagttctgacagaagcaactgcagggaaccaagcctttgttcaaaagaaatgtgataaaacaaaatgaccatagatatgcaagtatagtgtagtactcttccttttccagacagaactcttgtttagccaatgcttttatggaggcccaaaggatgaaggaggcctttcctcctatgaaataaactcatttgatttatacagaaagcactaaagaataggaaatgatatgcttcttaataacgtttataacgtgtttagagaatactttacctagaataaactattaatttaaagtttggggatgcttttttagattaacactttagctactataaatgccactttgggcattctgcagcacttcattgagtgacgtcaataatgtagcagaagtgctataattttcagataagcattataatctatttttttaaacttttattttaagttcagaggtacatgtgcaggtttgttttacagataaattgcatgtcacggaggtctggtgtacagattatttcatcacccagttaataaccatagtactataatattattaagggaacataagaaccttgggatctcatcattagtgttcttgtcttgtacgtccttctcctaaaaattattctcaccacctttccaatgaatttctctctagtctatgaagtccccctactcactattcttccagaatgagtgaatgaaaccccaccattctgagcttaaagcattgatgctaaaatgtactctggaagagataagaatatgtcttggattccagaactgtcctacaaaactatattcaaaagaccatgcatttctaggtttcaggtaaacttggagactgaacaatgcactcctttaagaaacctcactaaacctctacatagggatgttttttaaggcataaacccacgtgaatgacacattggccattttaaggggcagcatgcaatagcaataaaattttggaagctggaaggcaaatgcattgacttagcagatatgagaaagccagcagttggcaaagctgagaatcaacccaatttaaacttctggagccttgaaggctcggaaatcggtggcatcagatgtagctggttctccgtatccatggattctgcatctgaggattcagccaacctctgatccaaaatattcaaaaaaaaaaaaagactaaaaataacacaaaaatttttattttattttattttttgagacagggtctcactctgtcacccaggctggagtggagtggcgtgatctcggctcactgcaacctccaactcccaggttcaggcgattttcctgcctcagcctcccgaataactggaattataggcgtacaccaccatgcctggctaatttttgtatttttagtagaaacggggtttcactatgttggccagggttgtcttgaactcctgaccttaagtgatctgcccgcctcagcctcccaaagtgctgggattacaggcgtgagccactgtgcccggccaaaaatgtttaaaaacattatagcaaatatttacatagcacttatattggatatgcatgcaaatactacatcatgttatataagggactttaatatctgcaaattttggtatggagtggaggagtcctagaactaatcccccacaaatattgaggggcagttgtacttctaaaagaaggagttgaaggggatgaaactaaggagaattgattgaaagttgtttaagaagtagttatatccccatttcaggtgactgggcaactcttctccctctactccaacaaaaaactggaggtttattctttggagagggttaaactggggattttgggcttgggagacaccaggtacagttgaaagcagagaatacgaaaagccaggtggagtgactaagtgaacatatgcagactgaatgatgagccccacaccctcaccccactcacctacactcagccttctttacttccagaattaccagatacctgagggaagcttttaatgtgacagataacaaaaccaagaaacagaaaaaaacaacttgaaaaaaacagactttataaagatgagaaaacttaaaagaaactataattaatactttcaaataattaagacattgcattcatgaaacaggaataggatgcttataaaagaaacattcagagaatgaccatcaataacaatagcatatattaaaagaacaataaaaaggttagaagataaagttgaggacatttccaagaaagtagaaaacaataagagatgcaaagcaagaaagaaaagattttttaaaataaaaggatgagttcaggagattcaacatccaaataataacagttgcagaagaagagaacagagaaatatggagtaaggaaataatcgatgatactttgtaagaaactttccaagaactgaagaacatggagtttctggattgaaattacccactgaatcatgcaagttcttaaacatttacctctcctaccccctttttcaagaaactactggaggacgtgttacactaaaatgagggaataaaccaagaaagaggaagacaatgggtagaggaaacaagagatggaacccaggagaaaggcaaaaggagcctgggatgatagtgaagattaggctgtcagctgtgtaccaagcatagagggcattcagtccagactaaggcaggttagaagataccaggagagatttcctcataaggttgatagaacacccattgtgaatgaatgtattgagaggagaaattgacaactgaagtttgaggttgcctaaaaatcttagcaaatgaggggggaaaagacctttataaactccagagaaaacaaaaatgtgtgcatgaaagaaaaaacaatcatagtttactacatagctgttttatttcctagtcataataaaatcaactggggagtgatcttaccaaaattttaacattataactattattgtaatattaaaatataatattaagcagatggcgtggggtggataaggggcacacatatgtgatgtgggaagaggaatagagataaaagcaaaaaatgctaattttgcacagtgaggggtcagtagattttgcttgaaactgaaaaatcaagaagcaacaatacaaacttattatgtagaaatataaacacaattaccagaagagttagctaaaagagttgaaagtaatagtttctggggaagcagaaatactggggaaaggggcttggtgctactgtttgtcttagccattctaatagatcccaatggctctttaaactatgtgtctctataactaatttgaaaagaaaatctttttgaaaggcaattttattcccacaaataagaatgagaaaactttaaaaagtagcagctttattgagatataattcacataccatacaattcatccagtggtagttagtgtattcacacacttgtgcaactgtcaccacaattttagaatattttgtcacctccaaaagaaaccttatactcattggcagtcatgctccatttacacctaaccattgttgccctgggcagttaccatgccacactccatctttatgaatatacctattctggatatttcatataaataaaaacatacaacatgtggtcctttgtaactggtttctttcactcagtacaggcataccttggagatattgagggtttggttccagaccactgcaattaagtgaatatcacaataaagtaagtcacacaaattctttgctttcctggtgcatataaaagtttgcactatactgtagcttaagtgtgcaatagcattatgtctaaaaagatgcacataccttactaaaaatactttattgctaaaaaatactaatgattatctgagctttctgtgagttgtcatctttttgctggcagagggtcttgccttgatgatggctgctaactgatggttagcagggtgatggttgctgaaagttagggtggctgtggcaatttcttaaaataagacaatgcagtttgccacattggttgactcttcctttcaggaaagatttcgctgtagcatgcgatgctatttgacagcattttacccacagtagaacttctttcgaaattggagtcaatcctctcaaaccctgccactgctttatcaactcagtttatgtaatattctaaatcctttgttgtaatttcgacagtgttcacagcatcttcaccaggaattgattccatcttaagaaactaccttctttacccgtgcgtaagaaggaactcctcatcctttcaggtttgatcatgagattgcagcaattcagtcacgtcttcaggctccatttctcattctagttctcttgctatttccacctctcaaaatcatccacgaatgttgaaatcaattcttccaactcctgttaacactgatattttgacctcctcccatgactcacaaatgttcttaatggcatctagaatagtgagtcctttccagaagattttcaactgactttgctcagatgcatcagaagaatcactgtatttggcagctatatccttatgaaatgtatttctgaaataataagatttgaaagtcaaaatgactccttgatccatggactacagaatggatgctgtgttagcaggcatggaaacaacattaatctccttgcatatctccatcagtgccctttggtgaccaggtgcattgtcaatgagcagtatataatattttgaagggaagtgcttttttcggagcagtaggtcttagcagtgagcttaaaatattcagtaaaccatgctataaacagatgtactatcatccaggctttactgttccatttatagagcataagcagagtagattttgcataattccttttctcttattttttttttaagagacagggtttcactatgttgtccagggtggagtgcagtggctattcacatattcaatcctagcccactacagcctccagctcctgggcttactcaagcaatcctccttcctcgccctcctgagtagcccgataggcacctgccactgagccaggctagacttagcataattcttaaaggcgctatgatttttagaatggtgcagagcattggcatcaacttagtcaccagccgcactagcccctaacaagagactcagcctgtcctttggatctttgaagccaggcagtgaattctctctagctaccaaagtcctagatggcatctgcttccaatggaaggcttccaatgtttgtctgcattgaaaatctgttggttagtgtagtcatcttcatcagtgatcttagctacatcttctggataacttgctacagcttctacatcagcacttactgctttgccttgcacttttgtgttacagaaatggcttctttatttaaacatcttgaactaacctccactagcttcaaacttttcttctgcagattcctcaccttcagccttcatagaattgaagagttagggccttgctctggattgggctttggcttaagagaacgttgtggctggtttgatctatccagaccactaaaactttctccatatcagcaataaggctgttttgtcttcttatcattcgtgtgttcactggagtaacacttttaagttccttcaagaacttttcttttacattcacaacttgtctgtttagtgcaagaggcctagctttcagcctatctcagctttcaacatgccttctccataagtggaatcatttctagcttttgatttaaagtgagagacatgcaactattcctttcacttgaacacttagagaccatttgttaagtttattaattagcctaataatagggaggcctggggagagggagagagatgggggaatgccgactggtggagaagtcagaacacacacaagatttattgattaagtttgctagctatcttatatggacgcaattcatgccgccccaaaacaattaccatagtaacatcaaaggtcattgatcacagatcaccatatcagatataataataatgaaaaattttgaaatattgtgagaatgaccaaaatctgtcacagagacactagttgagcacatgctgttggaaaaatggcaccaatggacttgctcggtgcagggttgccacaaaccttcaatttgtaaaactgtagatatgcagcatctacaaagcacaataaagaaagctgcaataaaatggagtattgcctgtataacgttttcaagtcccatctatgttgtagcatgtatcagttcttcttttattgtcaaataataatccattgtatggacgtaccacattttatttatccgttagtcagttgatggacattggggttgtttccacttttgggctactaagaacaatgctgctatgagcattcgtgtacaagtttttgttggacatattttgatttatcttgggtagcagtggaattgctgggtcatattataatctacatttaaccttttaaggaactgctacacaattttccaaagtggctacatgattttacattcccaccagcagtgcatcagggttccaatttctccacatcctcaccagcccaacattcgttataacctgactatttgattgtagccatcctagtgggtgtgaagtggtatctcatttaggttttgattttcactgagataacttttaaaaacttagattagcaaaaattagttatgttgaaaaaatcctatctgggcaaggctttgaggaaacaaacactctgattaggagtgtaacttggtgcacattttatggaggtcagtttgatatatttaaatgcaaaatatatgtaacctctgaccagatatcccatttcctagtatttgacctaaggagaaaaccataggttgggaaaagatgggttgtcatattgtactactgttgatgttaatggcaaaaaccacaattacttttgcatcaacacaataatctcatcatatcaacaactttgaaactaacttaaatgtctgtcaagaggaaactggttaaatgaattctgattcacacatagaatgtctaagcaatcattataaataatgatgcaggtaaagtacatttttattttctagtaaagctatctaccacatattgaatgagggaaaatcaggttattgaatatcttcatgaaaagatcccattggtgtaaaatatctgtttgcctagaaagatcttttgagatgacgtccaaaatgttaacagtgattatatcctagtggtcacattttacgtgatttttttttttactttgttctttgtatgtaattttgttaaaaatcagcctctataattttttgagacaattataaaactattacaaagtactgcattttagaagtcgcatttttgtacttaatcaaggcttaaattttagttagatactctttgtctatcatttttttaaaacctcaagctaaaggcataaagaaattcattatagtggtgattatgttcacttggtgtagagcattgtcttatgctcttccttcagagacttttatttatactttggtcttaatagagttatttttatgtggagatatgaccggtattaggatttgcagtaacaggtcaaaatggttttccatttttctggttattgggatacgaattttggattcacatattctctcttccactcttccatccctctttgctggagaataacattaacaatgctttctttttctttgatcttattatgtgttaggaaccattctaaacataggcatgtattttactcatctctcaggccagtcctgtgaggttgacaatactgcaatgatattttacaaatgaggagcatgagggataggcaggttaagtaacctgtccaaggtcactccacaggggaatggcagagctggcactggagcccaataagtctggttccaaaatatctgtgatcttaactgccacattccactgcctctcttactttcctcctaaatatgactccaaacacttcttgctggttttccttgtttctccctcaagctgtcattcctaccagaaatgccagagaggctgaggtagtgtgtacacctgactgggcttccctgcaacaaatgctctatggagacacctctttgctgtttatatatttaccccctgaatctcttaggagtttacttaacatttctttaacaccctcttctctgaaatgtttggatttcttagtcctcaaagttggaggttcatctaggggaaaaaaattaagccttttgtagatgtttcaaccttgcattaagaccatcagcagagtgcttggtgttgagtcagagaacatttgccacccgttcccaggactgcatggtgctctcagccttaggaagtgcaagatgcctggtgctctgactgatctttgagtttgattaattgggggaaaacataatttttataaggttatagtttattctaattataagggtagtatatgcttattgtaaaaattttggaaaatacaaaaaagcataaagaaaaaaattaaaaacacttataatcctaccatcctgtgataacaactagaaactacaatttccaagcatgtttgtcttctctttaagcaattcatatccattcatgaagactaagtatttgaaatcagtgatttatggatgacaattttagaaaatgtccatccatgcaatttagcaggtagaattattgttaaatttaaagatgtaccaaagttggtgaaattaaaatttcttaatcttacacagcagtttgattttatttaactgaagaaagacataattgtggccaggcacagtagctcacacttgtaatcccagcactttgggaggccgaggcaggcagatcacgaggtcaggagttcgagaccagcttgaccaacatggtgaaacccagtctctactgaaaatacaaaaattagctgggcgtggtggtgtgcacctgtaatctcagctactcaggaggctgaggcaggagaatcacttgaatccaggaggcagactttacagtgagctgagatctcgccactgcactccagcctggcgacagagcaagactctaaaaaaaaaaaaaaaaaaaaaaagacagaattgtgcatgtttaaaaatattagcatggaatcaaacaaaaaagtgtagtgacgtcagtggttttgtttgctcctgtgtgtgatcgtcccatttatttttgcctaatatgggctgcatatataagcaagtcttcaactgatactaattaattttatgtgcacaagatgaagatctatgtgaagtaccatcaaaatttaacttgatatttgtgattttggttgttactgttttggctatcttgtgatcaaaatttagtataatttatttaggatatttttctattatccttgggaaagagttataaatctcaccactataaaaataacaacaataaaagacacccgtgacatgacatattataagtaataacaatgttgtttgattgaagttgaaatagcttgtactgaacattatttttaaaagccgtttcttaaaagaatgacttctataatcaaaaggtttatcctcttgtgttttctaggcatctggccatctgaagaggttttggcttactactgcctcaagcacaataatatattcaggtacagagctgcacttaagatattttttagcccatcacggatattgaatcaacatattaaaaattgccatgattatattcttcaaattaaattgttagaaaaaaatataagaaaagaaaaacaggaagaaaaggaaaacagaaagaggggaaaaagttcacagtgaacacatgttgcttctcaagtgaaatctgaattgccttgggtactaatattgcacagcaaggtttttgctatatgtcaaaggcttttgatttccactcaaggcattttatttcactttgatttgggggaaacaaaagtgaagctccaatcaatccttactgattgtgaaggtcaaaaaaaaaaaaaaaaaaaccaataaagacattctttaaacttctgctggggaagtcactacagaatgtctgatagataaatacctcacagctattatttaatgatgccatcccacccctggttttaaaggtagttttatatatctaacaatatgtatttgtgaactataaattaccattacggattcatgctacggaaataagtgttttcaactgttagtgtgcattacagatcgaacccatggatggaatttaggaaaaaaaaaaaaaactttatttgaaaattctaaagatgtttggtagacccagaaaatataggtttttcattttaattctcattttataaaagtcattcaatatatacttcctgaatagctcattatgatagcagataagccgctagtgatcatagcgtgtgttttaaccgtatgtacttacaagattgggtcaataatatgtatttttttaagctctatgggtccatatttaccaaccagtctacaattgctttaaacaaccaaacactcattaagtgtgttttgaaatattaatgtccttgcttggcttcttctcctccctttccccctcttcccacctctccctctcttttaattttgctttttttctcctcttgaggtaataaacttcccaaactgggaagaggaaacaatcctaagagtctaagcatataaataagaacagggcaattttgaatgtgggctgcagagctgccctggaagtctggcatttgttcatctcgctgtgcttaagcttgactggagctccaatcagcgagcagtgggccagggcgagaatgtcacacgttaagggctgatatttaggcacaaaggggaaggtaagtgcagagtgccaccctagactgtcagctttaactctgagccgctttacttttgagctgtgaagtcagagcccagtcattactttagcctgggtttgctggcttaaccatattatgtccctgcattgtttattcactgtgttgtgttggggtcaattgtgatttaagtgttaattgctaaatgctctttgtgtaattgttctttatggggactgttcagctttccaaaatgtttcagtttgtttaagaatttttttttaaaattcaggattgcatctatttattttgtgtgtgttgtttgtatgtaactataatataggtatatacacactcatatatattcttcatttacttgtctaactgtttttgaaggaatgaatgtggattaacagtgttatcctttcctaacacttctctttcgctactctagctagtttagttctaaaagacagcgccattgacaagggaaaaaaagggaaccttctcagatttttcagctcagcggtggtaatgttgcagtgaacactaatgagggaacccccactgatttgcctgctttgtgacttttctatttcataattatttttaaaacgcaaaacgacatgaggtagcctagtcatgtctctacaacttcctggtagcgccgttcttactgcagatggcaatttgttcttgtaacatatatctctctctgaccattttcatctaatttgtatgggttctaccatttcttttctctctttcagggcccttgctgtgtgtgagctagggggtggcatgacatgcttggctgggctcatggtaggtcttttctccattccaatcccattcagagggaggaacaaaaggaaaaatgttccagggcctccaactgctgggtcagagaaccgtcaacagcatcagctgcggtcaagctgccgggtcttgagagaccttctagattgacttactttcggatcatattgattttatggttgcctcgatgagcagaaacattttacctcagtgtagtcaatattgcttgttgtgacattccaggcctcgcacagtctttctttgccatagcgaaagcattttttttttttttttcagattatagtcccatttgctaagatacaggaatagcccggcgaatcacagttggagcaccatgatatagctgctaatgttttgcctgcattattacaccaacaaacatgatccagagcgctcagtaattagattcttttgaattagattggccattcaggaacgtcgttccccattctctgggttctgagtcatgtattcaggagatattatgtagcagcacagtgcattagacaagtttttatgtctctacaaataaaagcatattgttacactgattggcatttgacaaacctgtcgctcttatacaatgtgtcgaggttacagcccaatgtgcgagcatgtcaaagctcacaaaaaaattaccctcacaaagccatctgcctgcaatgcaaagttatatgaagggcatcaggcagtcagacagaagcaagctgaaaggcagagtgacagccttgtatgatggctctactagataaacagaagcccacaaatgaaagcctctcagaataccatcatccgctgtcacaatgcaattaccgaacagaatgatagcaagatagaggctcccgcaaatggaatgataaaagtattgactgatttgattgaatgattaaaataatgcagacataaaatgaaaaaagattgaagattgttacagagaaataggtgaggaagcatgatactgaaggcttgtcactcctgtcttcacttccacacagacaagcatatttgctcattgtttgctgtgctcccttttttttttcaggttgctatttctgcagatgtcaaagaagttctgttaactgatgggaatgaaaaggccatcagaagtatccttattcagatagaaaacgggtttgttgtgctcattcctttttcctggctgagtaacaattgatataaagaaagacagcatggggtattaaaagagagtttcccccctacatacatgataagtaattaagaaaaagtagaaatatatgaattccttgcatacaactccgtaggtttttttctttccatagatttttatagacatctctcatgaaaggagcctatttttgtggacctcccgaggcaataagaaaatttgtttcataataattttcaagcattcttgttcttttatttccattggaatttgccagtgtaaaacaaattatttggtatttattgtatttggatattgctggcaaatattaacttccagcttcatgtttgttattacatttatacacttgatattgtatgtactgtataatattgtgcctggtctaattgctgagggtacctatatcccccactggaacagctgtcagttcttcattatttccttttatttaggattttatttaggattatacaagctatctctatttttctgctatgctattgcagttcaaactccattagattatgctttactaatatgtacacagagttcatgaaaattgaactgtactttaactaagaaagcaagcataaatgtagctactttagcagtcgagctgatttgttcaggggcagttaacagctgttagaaactgagaggaaaagtggcagatatgtttgctttggatttttttttttttttttttttttttggtgtgccttacatttacattatgagggagacaatctacttatttgaattttaagctcctaaactgccaaagcagttttgatttctgtggcatcttacatacaatctatttctgattttctttttcgacttctgccatatgattttttcaaaatatgcagcagcttcatcaagctgctcaaacaggagaaaggaggaacgagaagcacagtagctaatattgttcagtaacacttgtatgctctacagagccccacccagctaattgcctgacagacttaaaaaaaattcaggaaggaaaaacagccaatcacaatcttggcctttcacacaagggaaggagatcacaaaaggtgcttcctttttttaaatgcaggattttaatcacgttcttgagactgtctcaagtttttcaaaatattcctgaagatgagcagatgttttttcattcactctgctttattctgagttatttcgtgcatgtatccatgtatcatttcactgtgctcctcctccttatgtcagggaatacagagcaagaggaagctcaggtatgccagctcagccccagagaatttttagagggtggggggagcaggattattggacaagagaagattattttagccacagaaactttcagcttgggcccggtaacctaaggtttttttcaagtcagcaggtgtcttatttaatagcgtcagaaaccaattagaacttttatcaaactatgggaaacatctgtagtcagtatgtaagtctaattgttctaaaattattattgagctaaactacagagcttccaaagaagggaagcaatgctaatgtcattaattaacacacctttgctttaaacaacaaagatgccatgccagcttttgaaatcagagaggaaatctcagattctgtattcattctgccggcctttcaaagaaatgattggtacagccccctcccaagaaaatggatttttaacatttggtcctcagaagctcagccctgagagtgctttattgtgctgggttttacaatgggtttaatatagcggggtgccaaagggcaggaggggaagaactttacaaagtagataaagtaggtcttttcaggatgcagaccaaaactggtagtgtgttttatttcatctcttaggactttcctgatggagttccgtttttaccatgcagttgttctgtgtttgtatgcctttttctgttgtaaccagatctaattttttttaattaagagaaaaagcatgcataaagccttaaaattggcaatgtgtttttcctgcttttaatactaatgttattcttgatttgctaacagagcttacaattggcattcgttgtcatctgttttactgactgaggttaatatgaatgatttttttttctatttgcatgcccactttctgtaagaataactaattcactgaatcacatactattgatgcatatagattgaaacaaacttatttaaaaattactgtttacatctttcctttaaaattttaggaagtctaaattatatagcagttgtaggatattattcaaaaattactttctaagaagtaaaagtggatgtcaacaaaaaaagggggagaaacattgccagaagccagaaaatctgttagtaaagctgctaattattcttaatgggcaagatgagcacattaagaaacaaatgaatacatcagtgaaatgtaattgaaaattggcctggcaatggcatatcgcatctgagtattggcctgtatattattcttatcattttaaaaattattttttttgttcttggcttctgaatttaatgaatccaactgaatcttcttagtctcttaagcttctaagattctgatttttacctttttttaaaaaaaaaaacagcatttcctgatatttccttttaattttatattatttctatttgttttagtatgtgaggcaatgaatggattggttctgaatctttatatcacagaagcatgtcaaccagttttgagtttatttattatctccctaaaatgtatcagatggattgcctatgtcttcttgagttttccaacttgactctgaaaagctagatgttgatctgagatttattaaacagagatgtctggaaagatattaagacttgaggtaaaaatttttaagtcacaaatattttcttagattcatgggtagttttccctaaagtctccttgatccttaaactgcattgctgggtctacgaactcaaagcccccacacctgagagctgctcttccctacagatgccattttatctgtaccccaagagaacaaaggataaattagaaatgggatcatttggtttgtccagttctcaaatttattctaaaatagtgtgaaacatgttccttttcttttttttttggcaatgcccctttagtgtcaagaaagaaatcttcaactgcccacatataataattactccataaggtttgtaacttgtgataacaatgacctaggaataggagagagacatggtatactgagttattattgatgctaagcctcttctaaattataatgaataaaagtagaactcctgaaggtgagcaaccctctctggctacaatcactaatgtgcccagcacaagcaccctgccttagtaaacatctagcagttctatgcagaaaattccaatgtttggtgacccatttctctgtaagcatcttatccccaaagtatgcacagtgtggatcatgatcttgaacttaggattctccaaaaatgggtaaatcccctgtgctttttaaaggagacacccctggtttaacattatttttatttaatacaatccctgacttgagtaactaataagtgaagcttcgtgtgggctgtgcagcctgtaccatagatggttaataacacggaaatcccgggccatcttcctgtgtccaggcttcttcttccaatgccggctgtacttccatctactgatgagtcataagtaaactatatgtgcctcagattgggtagcagcacaacaaatatgtattttttggaattaaattaaaattaattcaaccaatattaatggcatgtcattacaggtgctaaagatacaatagtgaacaagataggtctagtacctatccttgtggggcacagattttgccttggctagaatacatttatatacatgaagggcagaagttctttgataactttggttatttaaattctacagtataaatgttcacataattaattctaactttttttcttctcctttttgtggagaatgaggtcttgctgtgttgcccaggcagtcttgaacttctgggctcaagctatcctcctgcctccacctccctaagtgttgggattacaggcgtgagccactgtgcccggttcaggtaattaattctaagcagcaggaaaagaaaataaagtgtaactgccaaacctcatgttagttactttacccacctcttcaccctaccaaagcttttgcctgaattatacactaagataatgaattgacgtgaattgggcacctactgtgtgccaggcccatcacacgtgatactccattaagcctaacaaataggtatcattacttctgttttagagatggagctcagagagattaatttatcccaggacacgcagcccccaaatattagaaccagcactagaagccaggttcatttgacttcaaagcttatgttttttcgacttaaaccattctgggtcaccaaaaactaaaatgatttggtgaacgtcatcttgcatttccttacatgctctggaaataaaggcctctcatccacgaacataacaattggcattgctaacagagtttatagtacctctatggtatcttctcaattcatatgagtaataagcacatttaagaatattttgcagccttaaattagcaaatattgccacattaagcattaaaaaaaaaacttgagagatcaaaatgaatagggtttatattataatctcatagtttcctaccctcatttttggtattccagcgaaaataaagataacataaaccaagaaagtggtgctttgtgaatcacagtgttattatttttgaaatatcttcttgcttaaacaacatgccaactctcaaaatatatatataactactgataaataattgctaattgcaggaggaggctgatatttttaacaatatgatgcatacatataacatgtatataatttgtttaaattactattatataaaaatattttttaagaataaaaatcaactgaaacaaaattgaaatggagccctacctctgaacggggctttatttgagaagaaaacctagagttagaattccggtttctttttagccacaaacatatatcctgtagctctggaagtccagttgcctagacaaggggattggaggcaattactctgtattcatttaatcagaaatcacattaaggctttctttgcacccagtccctcccactgaagtcctccagaaggtgggtgcggttcagagaacacgatttggcccgttgtgttgaacactatcctggacatatcgactcaatgtgattggatttcctttattacactgaggtgacacagaagaatgataaaatctattattggacaacacagtgccgtccagaagaaccatcaaaatctgacctaaagtaaggggtggggagcaggatgtctgaatttatctcttaaggtaatattttaatatactgttgacattttttcttctcatgctcattttaatatttaaaaaaacctcttaaaccacaaaacttatttcctgtccagttctaaaaataaagcagcctaaatactgctgtcgaatttttttatttaaaaaattgcttctagaatataaatacatatgtttgcttcagcctgaccacctggagtcacaggtttataaattgtataaaagtatatagtgttaagatgtttactaaaaattattaataggttttctgagttatataatttaacttccctgagactattttataaaaagtattacctccactaacaaaataatatgttttgcttgatagattagtcatgtactcatacgactctacaggtgtactgggcacattatggcatgcggttggatgccatggaaactctaaggagggtgtggccagagtgtgggggaacttaatcaaaaacagttgtcagctgactctttactaattttgttcttctcagaataaagatgtcagctgtccttttctgcaagacatttcatttagaagactttcctgaaataatttcttcctgaaatagacagaactgtaggccgatgtgtcattttagttaatcaaaacaagtaggcaaattagtctcttttatttttttaatgaatgtaatttaacggtatttaatttgcatacaggaaagttcacccaggaaaaaaaaagtctgcattatagcacttttgtaaacctcaacaaagcccttcattagcagacctaattgatttttcctacccacccctgggggaagaaagctatcacagtacctgcttattcactcagagaagaaatgggtgtgcctggtggttcaagcagagatttgggttaaaaagtcctgtggctctgtttttgcagggagatcttggtcaatgcttgctttgagcattcaggaaatttgtttttctgagcaataggagaacatcgcttgtctgcttggtgtcctccccatgggcccaatttagttcaacttgcagccttcactggaattattttatttcttgtttatgtaaacctgccttattccaaaagagggattttgaggcttcttaccatgacacatagaatatatcatataaaatgaatgggaaagtgagggcagttggaaattggaaagccaggaaaatatgatgaagccaggaatagaggtcagtagagaaaacatacgcaacagggtcttttgtggttgttagagttaggccacacatttggctctgagttgcacaggtgctggagcaaagaaaaagaggatcaactctaagagttatagtgccaggaagtggaagcaacatcccttgatctgcagaccagcctttcctggtgctgaaacctgactattttttccaacaggcccttgtaaatatggcgctgggtgatgtaatgaaccagctcctgaaaacatgtcttccataaatgtggctcttttgtacaagtccttccatgccaaaggccatagcgtaagtctgtaaagacagttcttcaggggacttttcactcaactgactttcttcagtaattcattttctctcaaagattctccaagattttcttcatctttttcttctcacttcctcccaagtgtcatcctgctgctcctctccacccctccctagcagcatttaggagattggaaatacttcacactggaaagtctcaggagactgacattgctctccctgctgacagagaggcttgcctttggactccttgcccttttaagcaagtaggacatggcacctatgggacagtcatttcccaccagcactcataactctggggcttgccatgatgatccatctcaggtgataaaatgcagcccagggaagtaaaagagcttgcctgtggcaagtcagcatcctgcttcacacctcacatacagctcttctcctttcgctgtgctcatcccatgtatgataaaaagattggccaggcgcagtggctcacacctgtaatcccagtattttgggaaactgagacaggtggattacctgaggtcaggagttcgagaccagcctggccaacatggtgaagcccatctctactaaagatacaaaaattagctgggtgtggtggctcatgcctttagtcccagctactagggaggctgaggtgggaggatcacttgaacccaggaggtagagggtgcagtgagctgagatcacgccactgcactccagcctgggcaacagagcgagaccctgtctcaaaaaaaaaaaaaaaaaaaagataactgtttctggacctttttttttggtcacttcacaatcagtgcagatgttttcttaactgtgtcctgtagatgtgcaagacatcatcacaaggaatcagaaggctggtgtgtttaagacccagaaaatatcaagctggtaagatacctttctgcattaaaaaattcccattgaaattgcttttcttgatactatggatggttattaaaaataataatagctaacatttattgagcacctgctgtgtgtcaggcactgttttaagcactttacaagtattatctcatttaatgctcattggaatactatgaggcagacagacactctcattagctccaattaatagatgagaaaacaagataagtatattaaacactgggttggggatgatttatgattatacagtatgaggttgggagaagccaggcctgggaactccttaaatggctctcttccagtgagtctcagcctaggagcagttttgcccccaaggggacttttggcattccctggagatatttttttttgttgtcatgacttggtaggagagcggggaatgttgctactggcatctagtggtagagaccagggattccactgaacatcctatgttgcttaggacacccccgtacaacaaagaaacatctggcccagaatgtcaatagtgccaacactgagaaaccctgctctgtttcatgattttaaaatagtctaggtgtccattcgcttttagattctgttaattcttatacaaactaggaggaatgcttgctcttagccacaacaatggtgtgttctgtgatgctacattttatttttgccctgttggtaatggatctagagaagtgagtaatcatttcatagttttcacatgaaacagctgtatttgtgcattttttgtcattcatttaaccacagactttattagaataactctctgttaaattaattgttttctttattactgtgaagctgtcatcatttggtattttgaattttccctatggtaaagacactttcccaccccaacttcccagtttgattttttttattagttatataaactactcattaacagacaaagcccacagactgatttctcttggacacacccacgatacagccccggcagccagtgatcttggtgtgctggcttcggacatgaaaatagctacaatgcttaaaaaccaaagtgatgacacatattggtgtgaggctatggaatagcaataatttttttctcttatattaattggtgaatgtaatgaagtgtccatagtgtatttttaaatcctgtttaaaatgttgggagtaagctggtggcacaggggacagcatattctgtgtttctcatataaatgaacaaaccacttctgtttcccagaaaacctggggtaggttgagagaaagagaaagggtctgccgttacctgtggggtcctcattgttaggacagcctttccttcacagtgcagacggccttacccttctggagaggacttcgtttttggacatgattttcaacctggtcttttagttatcaatcaaaagtgcattttctatgttgtcctcatttacatttatttaatgtttaaggtcatttgtgagcatttgagtgtatttcagcatatggaatcagggaataatagatttcagcttcatgctgtgaagagagattgtgtttttacaagacataatgttgtttactgggtgttaataatcactaattaataaacatatctagacatctaaaatgttgcattttgaggaacaaaaatgtcaagtgtttaacttatggagtgcaatggtattttctgtcatctcttcataaaataattaagttacataaacaagcaaaatgtcattattcaacaaaggacatataccaaatgcttaatacatggcctttgtttctatttttctgttctcaaaaatgctatttctagatatattgctctgatatgtacctggacatatagactatatgtcaataatagtcatatagaaacctccaagatgaggatgggctttttttgtcatcttcatctcatactaattgtggtcagtttcttttcttttgacccctgtaagcattttgttcaaagtctactaaagcactttctagtgaacaggtagatgagttagtccttgaaatgccttgatcttatattaaggagtgacctgatcacttaactgtcaagaagctaagagaaatggccagccactgatgtaataatcagtattctccctccatccactgctttcccacccataaccagtacaatgtgatgaaagtattagttccatgagagaagaaataaaaggaagccattcacaaaagagctaagatagagttcaatattcttttttagtgcctcagtgcatatgcagaatttctcctccaaattggagatgtggaataagagtagtgacagataactaagaagtatttaccatagctataaagcccacatgtgagccaaatatttctgctattaaatagcacttcaaagcttgacatgaggtttgtaacagctgaatgtctcttgtgacttcatttgcaaagaagatgtataagctgaaaggaaagtcgtggtatgagaactataagcctaagaaatggtatttaaaaaaaaaaaaaaaaacaagctgcccagaaatttgactggcacccaagctcctattcccactactccgatgatgttctcagtaactatcagcatttctcctgctaccaacctcttcctacctcttacacaggggcagacccaggttgtgtggggcctgaaacttattttgagggcccacttaggaagaatgaattctattataccttactttgataaattttacagaaatatatgaccatgtgaacacattactagggcttgtccaagggccttggaaggggccttgcaagaggctctgacgctgaaccttcattagcttcacagtcaatccacctctgctgtcataagcaccaccatccttgcctaaagtaactcttctcttagctaccaaactttcctgctccctctatccattttaatcatagtctgattgtagctaaatgtgaaagacatgctggtgaaagtctggaagccttagccctagctgaatctaagatccacatatatgaagaattatattcattacatctcagcttaatgcagtcatttggtttatttgttgtccatccatgcagccatccattcacttaacaagtatgtccaaagtactctgcttttgagaatataaatatgcagttatcaaaaataattcttgaacaaaggaaaccatgctactaaatatagctagagattgatgaaagagcaaggatatttacagtatctcaattgttgggtttatctaaagctgtcttcaaaattgtgactgtttaacaaagaaccatttggagcttttgacgtctacgtatttctaggtcttccagaattagtgaatagcgtcattctctggttaatattagttgagagttcttaaaaagtctattaaatttaccctgctgtgatgatgtaagtaagtttcacttaagaatgtatgtatctttgtgtgaaagttgctagtgaattcaggtttatgacctttattattctttgataatccatgaattttagtaaactatggaacttgtgttaagactttttttataacccaaactttacctttatgtgggcccccaagattggttattggtcccattgccctattgctttttaaagatttatgcctcctctgagactcagtttcctttagaggttaaaatggggatgtggaaaatgatttttgaaaggtacgttccaaccaagtagaatccagtggttgattttcctgggccttctgcagtctgcccttatatccacatctcatctagctgctgcctcctcttttggttaccctggacccctcacttgcctccgacagatatgatctctccatctctagtctttgccattcttgtttctctcctcttctccatctaaatccttccttctaggatggctccactgccattttccccttgccttctcagcctaccctaatctttttaatttctgctgcccttagaatagtaccacagttgaacatggcatagtttctttttgttcaaagcatgttggctttgtttgcatgttcactggtttatctacttgttgacaaatattttgaccaccttctgtttgccaagtcctattctagatgctagagatggagtggtaaacaagatggaaaaggccgtgccttcttggagtttatgtcctagggagggaaacagatcatgttcttgaaggcaagaattctgcttaatatgtttttgtactccctgaagcaattagtacactttatccttggtatatgaaagcttttaaaattggtatttagagaacattttgaaagacatgaatccataaggcttatggaaccaaaccatttttagtagaggaaagtcaagctctagagaatcagacatccatttctacatcagatagctgactttcatttcagtgttggcctcttctcaggcatgcgcatgtagtgtctgtagacaaactgacagtgtgagtaggcatttatctgttctttgtcaggttgaagaggaaggttagtagaaggtaactgagataaggaagctgaaggctctctttaagaaattttctgataaaatatacctgttagtgagttttgctagaattatagtaacagaatcctgaagaccgctgagaattctagagatgccacactcctgtttccttctgttgctatcttggctatgacaaaatgaaattatcatgtgtactttctgttactaacataacactgttgatttgcttaacaggtttatagatgggctcatatccctactatttagtgttttgcactgaagacaccaactcccataagaacgttagccggttcagctatttttgatagagttatcctttttgtattaaaatgagccagactttaaaataggaggatgctgtatttttagggaccctcttaaactacagtcaattaaaaattaaggccttttattttagaataacattgtattgattctttggatttgcccacttctactttttaccaaggtcaaaatctcactaccaaaaataggccaggtgctgtattgatagctaggtatgcaagtcagactactgtattctctgtgaaaatgtcttctggttttaagagagaaatccttctcccttcacagaattttatattgcagaagttacatatcaataaaaatatttttattttcaaaggagttcttcacttaaaaatagagccatcttaaaaaacttttttagagaatggccacatgataaatcattgttaaacaatcatttattttttaccttaataatggacattagtttgttttcaatattttgttattataaactgctgcagtgagacacatctttacataaattatacatttgcaagtgtgtctacacaacagattttcagaagtggattgtgtctatttgtacaaccctaccaaactgcataatttttgtcactataactttgtaatatattttcatatttcatatttactaagacttgacattttaaaaactgggagtctttctatgcaagaacaggtattctctttttaagtttttaaaggtgtttcactagcatttttatttctcttaagtttatttttagaaactttttgttggtcttacaaatagggttttttcttcgattatattttctacttccattatgttttactatggggtttgatatagtaagcgtttagtcacctcagtgggttattgttttgaatattttgcaggtttatcctcttgagttttccaaacaaacaatcacatcatctgcagatgatgacaattgtaacttctttctaattctcatacctcctttttctctcttgtataattttattggataaaaatatccaccatgattattaaataataggcatctttgagtctgactttgttgggaatctactaatttttcaccattaagtatgcattagcttttgagttgagataaatatgatattttttatcttcttaaaatttcttaagagatgttatcacaagtaaatatggaactttagcagatatcttttcagcacctatggagatgttcaaattgctttccctattttatttgtaactatgacaaatcatatcaaaaggtttcctaatattgaaacatccctgcatttctagtagttacttattcacagtgtcttaattcttcttttaatatgcttctgtgttctaataacaaattatctgagatttttgaaaattacaactttattgagatataatttacttactatacaagtcacccactgaaagcatatataattaaatggcttttagtgtattcacagagttgtgcaagcatcacaatcattttagagtattttcatcacccccaaaagaaagctcatacttggccagatgtgctggttcacacctataatcccagcactttggggtgccgaggtgggagggttgcttgagcccaggagttcgaaatcagcctgggagtttgaaatcagcctgggcaacatagtgaaaccccatctattgaaaagaaaagaagaggagaggagaggggaggggaggggagggaaggggaggccctcatactcatgccccttcctcactcctccctcctcccttccagggctaggcaaccactgatctatgttctgttgctatgcctttgcttattctggacatttcacataaatggaagtgtataatatgtggtctttcacatctggaatctattgcttaaaatagtgtttttaaggttattcatgtgtagcatatatcagggcatttgtcatttttggtactattccattgtatggatagaccacactttatccactcatcagctgatggacatttgagatgtttcctttttcttttttctttttttttttttttttctattctggataatgctgctatgaacatttgtgtacacatttttgtgacaagtttcatttctcttgggtttatatggtcacatggtaactatatttaacctcttgaggacctgccagactgtttttcaaagtggctgaaccactttaagttttctaccaaaaagtatatgatgttttctgagctgcttgcttagatattcatcagtaaaattggtccagaattttctttattgtgcaatctttgtctgattttaaatagcactgacataatagctatttaaaagaattttgaagtttgtcttatcttttgaaccacctcttagtgggttgccctacactgctaccataattctagatcagaacaatttttaccccattattttgtacgtgatatttggagatatagtggcaagaaagaacaaaattacattaaaaaatgcactgcacttgaaagtatgtaagtttgaaacattaaaaaaaggaagaaaaataaatgaaaacaccaaaaagcaataaataattttgtgatttcatctgagatggtatataattgtactttctagtccattcattctaatattttgttgtcactttgttttgctactatgtaagttaatcagctgtcataggatcagagatacttgaaacggaaaatataattagtaaaataattagtacctttcatttcaaggtcttgaaaccctttctagtcctctttaaccagtgcagaatatactggtccccagcatgaggggggtctgaatgttaggaaaatatccctcttttggactctgaaataagttcatttctgctaaattccaaacaaaaacacagagctgggatcagttttaaagtcagtccagaaaaatgtaagtgataagctggaacaacagttctcaaactttgttctcagaatcatttgtagagcttgttatgacacattctagatccccacaccctgagagactgaggcaggcctggggttttgcattctaacaggtaactctgacgcctggtctggagccctcacgtggggaccaccaaactagagttctcgctgagagcttctcattcaattctgcagtgttccattgctttaaaattgttcaaattttcttgccgggagttgtagctcatgcctgtagtcccagcactttgggaggccagggtgggtggatcacgaagttgggagttcaagacctgcgtggccaacatggtgaaaccccacctctactaaaaacagaaaaattagccaggcgtgtcggcgggcacctgtaatccgagctacttgggaggctgaggcaggagaattgcttgaacctgggaggcagaggttgcagtgagcggagatcacaccactgcactccagcccaggagacagagcaagtccatctcaaaataaataaatacatacataaataaataaataaataaataaataaataaataaataaataaataaaataataaagttgttcagatttccattcattgaagccacttccatccactgtattttcttgcttatttcgtagatgttatgcacttacaagaaaggaaaggacctgacttacagtcagctctcatttgtctggaattcattaatcttacaggtcttctgaggtaaacatttcattgagacctaatttttcttccccctcgcctttctcccagccttattcctagtccagaaatgtaaaataattttgtttcatgataaaatcaatgaagttgatcagataatctgtttcaaggaatttacatatgtgaaatcctgttttggttaatctgtgatgttgcttccttctctgagataagggaagtgttcttaatcaagtctgtccttaggggaactgtcacttctctggaatggcactttctttaaatgcttgggactaaaaagcctaggcctgtggctaaagaatgttctagccaggtgcagtggcgtgtgcctgtagtcccagatactagggacgctgaggcaggaggattgcttgaggccaggagttcaaagctgtagtgtgtcatcatcctgcctgtgaatagccacagtactccagcctgggcaacacggcaagatcccctctcttaaaaattttttaaaaagaatattctaaatgtaaattcatacaggtagagatcttctgaaacgagattttcaaagtggttcatgacccatcatcacctgtagtgctaattttaaaaacaggtttccagacatcacataaaccttgctgaagcaaactccatagagttgaggttcatttgaacaatccgacatttgaacaatctgacagttgaatcaccttctcaggtgattctaatatatctgaagcacagagcatgcttcgagaagcccattttatatccctggattgttgctcagatgagtaaactgaaagcgtgagagtgaatccatggatagcctctgtttgtcattagaagaggcattttttcactctcatgtgagagctttactccccacattggactctgaatttctatggtatcatcttagtgaagatgtgacctcagtggaaaggggaaagttgtatagataagaaagtaattctgattcgtttcttgtctacatcacagcttttagttgttgggattcaacaagaagcacatatcggaggtggacaggcctgaggggatagtccaaccacagctctcaaccagaagtggactgtgtgtccacctctgcactgtttgtaatcatatgggacatttttgttttattgtcacaatagctaagtgctattatggtactgggaagagcagcaactgtaaatattctgcaatgcaagggacagttcaccacaatgaagaattgtcctgttcctcaagactatcccagctgagaaatattagttccagactagatgagaaatggagatccaaaaatattgcctggatctcttttacagcattgtcttgctttctggacgtgtgtgtgtgtgtgtgtgtgtgtgtgtgtgtgtgtgtacctgtatgcatgtgagtgctatatcggtcttacatacattcttctttaaataagggcatggaattgatttttctaatgaataaaagttttttgcctaaaatattttactaagttgctattctagtccaacttttattattcagttcagtgcaatgaaatataatttagtgtctgctatgtgtaaggtactatgatgggctttttatgggttataaagattaaggtgaggtttctgcctttagtaagctcaagatgtccagacaagagatggacatttccccagctaccaagttacaagacagagtctgctctaattgagttaaccatgctatgtgagtataaagagatctgccaattcaaggtggaaggatctgagaaagcttcatgaaggaggtggaccttgagctgtgatctagcaaattaaagataacgaaaggaaagaagttgaagtgggcattcctggtataaaaggcagggaggaaataagaggtagaagtagaaaagatgtgtccagccagatttagctatttgtgataaatagagagaggctagaggcagaaagaccagttaagaaatcatcacactggggtgaaaggggagatgaatgagacagagcacatgaagggacttctaaggttccaagagaagttctatttcttttttttttttcaacttttatttaagatacaaggagtacatgtgcagatttgttagatgggaatattgcatgatgctgggatttggagaacagatcccatcacccaggtagtgagcatagtatctgataggtagttttttaaaactgccccccaccttctaatagtctgctgtgtccattgttcacacatatttatatccatgtgtgctcaatgtttagctcccacttataagtgagaatacgtggtatttggtttcctgtgcctttttggtagaatgatttgttttctttggggtatatacccagtaatgggattgctgggtcgaatggttgctctgttttaagttctttgagaaattttcagacagctttccatggtggttgaactaatttacattcctatcaacagtgtgtaagcgttcccttttctccacagcctcgccagcatctattgtatcttgaccttttaagaatagccattctgactggtgtgaggtgctatctcactgtggtattgatttgcatttctctggtaattagtgatgctggcattttttatatgtttgttggccgcttggtgtatcttcttttgagaagtgtccgttcacgtcctttgccctttttaaatgaggttattgttttttgcttattaagttccctagagattctagatattatgcctttgttggatgcatagtttacaaatatgtgctcccattctgtgtattgtccatttaccctgttggtagtttcttttgatatacagaagctctttcgtgtaatcaggtcacacgtgtctatttttgtttttgttgcagttgctgttggagacttagccaaaaattatttgccaaggccaatgtcaagagagtatttcctaggttgtcttccaggatttttgtagtttgaggtcttacatttaaaaccgtaatccattttgatttaatttttgtatatggcaataggtaggggtccaattttattcttctgcatatggttagccagttatctcagcaccatttattgaacagggtgtcctttcccccttgcttgtttttgtcagctttgttgaagatcagatggttgcaagtgtgcggctttatttctgagctttctattctgttccattggtctatgtgtctatttttataccagtaccaagctgttttggtgactatggctttatagtatagcttgaagtcagtagtgtggtgcctctggctttgttctttttgctcaggattgttttggctatttggactctttttttggttccatatgaattttaaaataacctttttctaattctgcgaagaatgacattggtagtttaataggaatggccttgaacctgtaaattgctttgggcagtatggccatttttacaacattgattcttctcatccatgagcctggaatgtttttccatttatttgtgttgtctttgatttctttcagcagcgttttatagttctccttgcagagatcttctacctccttggttagctgtattcctaggtatttcattttctttgtggctaatttaagtgggattgtgttcctgatttcactctcagcctggacattgtgtaaagaaatgctactgattgttgtacattgattttgtatcctgaaactttactaaagtcatttatcaattctaggagccttttggcagagtctttaggattttctaagtatagaatcatatcaacagcaaagagagatagtttgactttttatttggataccttttatttctttctctttgctaattgttctgcctagaacttctagtactatattgaataggagtggtgagactgggaatccttgtcttgttccagttctcaagggaaatggtttgagcttttgcccattcaggatgatgttggctgtgggtttgtcatagatggctcttattattttgaggtatgttccttctatgcttagtctgttgaggttttttatcatgaagggatgttggagtttatcagaaactttttctgcatctattgagatgatcatatggtttttgcttttgattctgtttatgtggtgaaccacatttattgatttacatatgcttgtttgtttttagagacagggttttactctgtcacccaagctggagtgcagtggtgtgaccatggctcacagcagcctcaacctcccggggtcaagcattcctccttcctcagcctcccaagtagatgggactataggtgtgtgccaccacaccagggtatttttatttttattttttgtagagacagggtctaattttgctgcccagcctggtcttgaactcatggactcaagaaatcctcctgcctcggcctcccaaagtgctgggattacaggcgtgatccagtgcacctggctgttttgtgtatgttgcgccagccttgcatcccaggaataaagcctacttaatcatggggtattaattttttgatctgctgctagattcaatttgctagtattttgttgaggatttctgtgtctgtggtcatgagggatattggtctgaagtttccttttatcattgtgtctttgccagagattggtatcaggctgatgctggcttcatagaatgagttagggaggagcccctcctcctcaattttttggaatagtttcagtaggattggtatcagttcttcttcatatgtctggcagaattcagctgtgaatccatctggtccagggcttttttttgttgtaggttatgactgacttaatttcagaagttgatgttggtctatgcaaggtttccatctcttcctgattcgatcttgggagactgtgtgcttccaggaatgtatccatttcctctagattttctaatttgtatgcatagagttgttcatagtagtctctgaggatctcttatatttctgtggcatcagttgtaatgtcacctttgttgtttctgattgtgcttatttgtatcttttatttctttttctttgttaagatagctagggggtctatccttttttttttttttttttttttgagaaccaactcttggtttcattgatcttttgtatggattttctatttcttaatctgggtggtggttagaagggtgtttgcctgataatagttaaggcatgtatttattccgtgtggtttactgtgtcttatttcacaatacaacatgtcttttgtttttttaaaaaaaaaaagccatttcagtagtaccggagagagaaaaagagggagccccagcctgaatgagagtggaaaatggtgagcaaatacggggtcattccagagaagtgactgtacgtagaatgtaaaatagaggcagagtaagagatagccatttggaaatttacatttgaggtggcagtagaatagatatgtgacagtaactacaagaggttagaaataaaagttcagatctcagaaaaaatattgtgctagaagatttggagatcaaaatcaagtgatcagaacataactacgggaattggaaagtcagaagagaagatgaccaaggacagaatcttagaaaatgtctgtgtgtcaggagtagtaaaaagagccagaaagggatactaagaagggactggagagcaaggttgatggctcagggtggtacggtataataccacttcttaatggaagaagtccaagaaagcatttcaaggagagtgtggttggctgctgcagattactgaaggtaggtcaggcagattgcaaagtagttcagtgactgttggaagaaaggtcatatcatcagggcaggtgaagcaatgggagtgtccactcccataagaatgttggtggcaaagggagagaagttgtgtgtgtgctaaggggaagctgaggtggaagagttgagcatgtgatcaggcaagccgctacagccaagaaagaagaaagaagaaagaagtggagacaagaaagggaaatatttgatgaggcaaagatctagatcagggcttctcaaagtgtggccccctgaccagcaccaccagcatcagttgtatacttgttggaaatgcatattccaaggccccacctcagacctgctgaatcggaaactctggagttgaagctcaggaatgtgtatttcaacagactatctaagaattatgatgtatgccgaagtttgaaaaccactagggaagaggaaggggtggctttatccagcacacagatggagaagttctccttaatgagaagagtgaccctacttccttttagacaagaggaaaggagaaaaagaagaagaggagaaagatggtatcagatagatagcctcaggctttctgtaaggtcacctgctgagaacaaagacttgggatatttggggagcttaaagcgtgagtgtgttcattccagcctccaaaccctggcctcttctttaggctttgtctgatatgtcctcttgcttcttcattccccatccagatcctgtgtgtaagatcacatgcagttccaccttcttcaggataccttccccaacttgtccagtccacagtgattactcctttggtagtaccttacttacatagggccatcggtaattcttttgtttcatttgaatgtcttgtcttccgaatatgactgtatgttccttttgacgattatgattttgctacttgaggaacatgtcctcattgtactgctgctcacagcatccactgaggcttcaataacatttatagacagacgactcccaaattaggaagtcaacggatcaatatcccctttcattctgagttttcaattccagatttagatggtgtccttttctctaagtgtttaaaacactttcttagagaggcttctatgatatggaagtttaaaactctataaaagataaggaaaattggaggagaaagtggcaaataggaaatcatttgaaagaagagaagtgattcactggtttgggtaaacactgtaaatgacttgaacactgtaaacactgtaaatggccctctacaagagtgagctgtgccaacatagactttgagaagtgacataaaagaaactgtgggaaaggatactggaatcctctgtaaagaatgcctataatagccatacaaagaacatggctgccttccctactgctggtaagatagcttgtttttgaagttcattacatttagcaagcatgatcaagaattctatcagtgcactactttcacaaatacacaagaaactacctttttaacagcagagtttaaaaccaagactcagccgggcacagtggcccacacctgtaatcccagcactttgggaggctgaagcgggtggatcacttgaggccagaagtttgagaccagcctggccaacatggcgaaaccccgtctctactataagtacaaaaattagctgggcatggtagcacatgcctgtaatttcagctactagggaggctgaggcaggagaattgcttgaacccagggggcagaggttgcagtgagctgagattgcgccactgcactccaccctgggtgacagagcaagactctgtctcagaaaacaaacaaacaaaaaacaggactcactcccctacagccaggagtctgaaaatataaaggtaaacaaagaagtactaaacatgagaatatgagaaaataaattctttaaacctctatagggagagttatctgtgatcactgcaatgaaatacaaattagggtgaacccatttgacattaggttttattacaaacttgaaacagagactctctgtttgagaaattctttcagtgtgagttttgcatcacaaggtaaaaatcctatcagaaattgacttggttttgtttttcagattgaaaccccaaactcaaagccagaatgaaaggacataagttagtacaagaataagggaagggaaactaatatttcttgagcacctataatgtggtttcatttactccatctctttcaattcttaatgagtcctgtgatgcaactcttactgtctcttttttacagatgagggcaatgatactcagcatctctcatcttcactgccttgcgtttgaactcagagctatccagctacaaagcccatgcattctttctgctatactatacctgttaaacttcataggtttggcatgtccatagctgttatgatttttctttatttttaaaattagagacaggatcgtactttgtcatccaggctggagtacagtggcaagatcatagctcactgtaacctcaaattcctggactcaagtgatcctcctgtctcagactcctgagtagctaggacaacaggtacataccaccacaactggctaattttttattttttttgtagagacaggggtctcactatgttgcttaggctggtctcaaactcttggcctcaagcaatcctcccaccttggcctttcaaagtgctgggattacaggcatgagccatagtgcccagccaagatttttctaaaacatggagaattctataatgattattgattttgtaatgtttctgcttacaaaattgtattttactttgtaatgaattttgaatggaaataagattttaatattgtgatgaaataaaatggagagaatataaattttactttggtgtcagtgtaattacaagcaacatgttgacatgatttgatgtctggtagaaccatcctttacatgtcttcgcacatgaatgttatgctttagatggtaaaacttatataggtaagggtcctacttgtatgcgccttgctctttttcagaaagcattttctgttcagtttgtttaaaaaacagttttgtagctgggactataggcacatgtcaccatgcccagcttggagttctaatttgaatttccctagggactaatgatgttgaatatattttcatgtacttatttgccattcacgtatcttctctggtgaagtgtctgttcaaatgctttgctcattttttaaaaaattgggttgcttgtttttcttatcattgacatactctgggagttctttatatattctggatataagcttatatcagatactatatatgatttgccattttcttccagcctgtagctcgtcttcattctcctcacaggatctttcaaagtgcaaatgtttttaattttaataaagtctgatttaccaatttgttcttttaaggatcaagactcttgtgtgtgtctaagaaatctttacctaactcaaggttacaaagattttctcctgcattttcatctacaagttttatagttttgggttttacatttaggtttatgattcattttgcatcaatatttgcatatggtgtgagatatagattgaagttctgtttttaaaaaatggagactcaattgttaaaacatcatttcatcctttgctcaccaaattgcctccatttacttaggtcttatttaatttctctcatccattgtcagaattatctttaagtgtttcatatttttatgctattataaacagaatggttttttaatgctgttgtaaacagtataaaattggaaattccaacttccaattatttgttgattttatgaagaaatacaactgattcttgtacattgatcttgtatcccacaatcctactaaagtcacttattagttctagaagcttatttttgtatatctctttatacagaaagggactgtaatctccagtgcagtgttgaagaatgaaagaaaacatacttttcttatgcctgacgttaggaagaaagcatcgggtctttcaccattaagtatgatgttaactataggtttttcatagatgacctttttcaggccaaagaatttcctttctatttttaggttgctgaaagtttttagcaggaacagacattaatctttgtcagaagcattttctgcctttattgagatgatcatatgttttttcttttttggcttgctaatatagtagattatattgatcaattttcaaatgttaaaccaaccttcttatattcttaagataagccccacttgatcatgatgcattgccatatgtatgttcatatgtatattatggacaactttggatatgttgtattaatattgcataaatattatcctcttaatatttatggactctgtattgatggcacctctcatattcatgatattggtgatttatatcttctcccttttttcctgataagtcaggctagaggtttatcaattttattgatctcaaagaatcagtgtttggtttcattgatttttctctattatttttctgtttccctttttattcacttctgctctaatctttattacttctttttttttttctggtcaagtttaacttactcttctttttcttgaatatttagctagaaactgagttcactaattgagacctttcctaataatagccatttagtgctattaatttcctctaagtacttcattcgtggcatcccataaattttgatgtgttgtattttcattcaacgcaaaataattgtcagtttatgttttcatttattctttggaccccaggttatttagaagtatattatttattttccaaatatttgagaattttacagagattattgatttctagtttaattccattgtggtcaggaaacattctttttttttttatttttatttttgagacaggttctcgctgtgatgcccaggctggagtgcaatggtgcaatctcagctcactgcaacctctgcctcctgggttcaagctattctcctgctccagcctcctgagtggctgggactacaggcatgcaccaccatgccaggctaatttttgtatttttagtatagatggtgtttcaccatattggccaggctggtctcaacttctgacctcaagtgatccaccccctcagcctcccaaagtgctggattacagggatgagccaccatgcccagccagggaacatattttttgtatgactagaatcattttaaatttattgagacttacactatgacccagaataggtatatattggtaaatggtctatttgaaaagaacatctgttctgctattgttgagtgtattctataaatatcaattaagtcaagttattgatagtgttgtttaagtcatctgtagctttgcttattttctgtctacttgttccatcaattactgagaggggagtattaaaatctctgacaataatttggtttcatctgtgtttttttgtagttgtacttctatccatttcagcttcataaatttgaagctctgttattcagtgcgtgaatatttagaattgttatgtctgcttcttgaccctttaacattgtaaagtgatcttccttattcctagtacattctttgctctgaaatctactatgtctgatatgaatatagacactccagctttcttttgactagtgttgcttggtatagctttgtccatctttttacttttaacctagttgtgtctgtatatttaaaatgcatttattgtaagccacatgtacttcggtctagctgttttgtccagtctgacacactctgccttttaattggagcgttcagaccatttttgtttagtacagttactgatggggttagatttaaatctgtcattttactatttgttttgtgtttcatctattctttgttccccctttcatcttgttctgcttgcttttggattaaatgagtttattttcttattctattttatctcctttgttggcttattagctgtaactctttgttttttattttagtggttgctttagattttatagtatgtatctttaacttatcacagactatcctcaaatgatataccatttcatgtatattattaaaacctgtggctgggcatggtggctcatgcctataatcccagcactttgggaggccaaagtgggcggatcacttaaggccaagagtttgaaaccagcctggccatcatgatgaaaccccatctctactgaaaaaaaaaaacaaaaacaaaaattagccaggcgtggtcgttggtgcctgtaattccagctactcgggaggctgagacaggagaatagcttcaacctgggaggcggaggctgcagtgagctgagatcatgctactgtactcgagcctgctctgtctcaaacaaaacaaaacaaaacaaaacaaaacaaaacaaaacaaaaccttacagtagtatactgccattggtcccctgccagtctttatgctactattgtcctactttttatctatacatatattatcaccccacaatacttgcttgtttaaccaattatatttaaagaggtttaagtaataagaaacagtcatatatatatttacctatatagttagtatttctgattccttcatgtacatttccatctgatataatttttcttctgccttaaggatttcctttaacatttcttgcagcataggtctgctggtgattaattccttcagctttttgtatgtctgaaaacatctgtttcaccttgttttgaaatatattttcactggctatacaattctaggttgacagttgttttttattcctttcagtactttaaagatgctgctccactgtcttctaacttgcatattcctcacaaaaaaaatatgctgtcatccttatctttgtttttatataaaacatctttttcctctgggtgcttttcagattttctctttatcactacttttaggcaattcgattattattatgtgcctgctagttttcttcatgtttcttgtgtttgggcttgttgaaatttcttgctgagttaacagttttcattaaattaggacatttttcagccattatttcttcaaatattttttctgttgtctcccttctcctattttttgagaagtccagtttcacatgtattgaccacttaaaattgtcccacagctcactctttattttattcctttttttctccatatatttcattttggatagtttctatcactatgttttcaagttcactagtcttctcttttgcggtgtctaatctgctgttaatcttatccaatgtattgttcttctcaggcattgtagttttcatctctagaagtttgatttggggctttaaaaggtatctcccatgtctctacctgattcttagaatatattaaagaccattatgataactattgtaatgcccgtgtctgctaattctgacatctctgtcagttttcgattgagttcagttgtttgatttgtcttgtcattatggtttctattttttcaattttttatatgtctggccatcttggattatatactaggtattttgaattttacttcgttgggatctgaatgtttttatatttctgtaaatgtttttgagattttgcgtttgttttagagacagagtctcactcagtcatgcaggctggagtggagtggcacaatcacagcttactacagcttcaacttcccgagctcaagtggtcctcccttctcagccccccaggtagctgggaacacaagcatgcaccaccatgctcatctaatttttgtatttttttgtagagatgggatcttgccatgttgcccatgctgtttttgaacgcctgacctcaagcagtcctcccaccttgaccgcccaaagtgtgtttttgagttttgttctgggatacagttaaattactttgaaatagtttgatatgtttgggtcttgcttttaagatttgttaggcagaaccagagcagcatttagtctagggctaattattccctactattgagacaagacccttctgaggactctacacaatgcttgtaaattatgaggttttctaatctggctggtggaacactcactattcctggccctgtgtgagcactgacctactccccttcaattttttgacatgatctttccccaacttcaagtagttttctcacatacatgcatgatcagtcatccacagaatattctagggggaccatccacagatctccagagttctctctctctctctttctctctctctctctctctttctctctcaagtgctctcctattcagtattttatcctgggaactctgaagtttcttagactctcagttccatcttcttttttttctttttttttttttcttgagatggagtctcgctgttacccaggctggagtgcagtggtgtgatctaggctcactacaacctctgcctcccaggttcaagcgattctcctgcttcagcctcccaagtagctgggattacaggtgcccaccatcgtgcccagctaatttttttatttttagtggagacggggtttcaccatcttggctagcccagtctcaaactcctgacctcatgatccacccgcctcagcctcccaaagtgctgggattacaggcatgagccaccatgcctggccccatcttcttaactcaggcagtccacctgcttctttctcatttcctccatctatgctatggcctggaaactctcaaggcagtaagctggggtaaaggtagggctcatttcatttatttctgtcttcttaaggattactgtcctgtgttgctgatgttcagtgtcttgaaaactattgttttatatgttttgtgtaggttttctgttgttgttttagacaaaaagctaaatgagggccttgttacgccatctttgctggaagcagaaatctttagaaagcattttaagtggacttcatatctagctaatccacacattgtattcaaagaccaatttaacaatagaaacctctatttcttgagggccttctgtgtgccaggcactgtgctaggtacattcacacacaattcatccatatggcatatttattgaacagctattaggtgctagggactattctagacattggaaatacatcactgtacaaaacagattttaaaaatctgtatccctgtggtgcttatattctagtggggaaagagagaagaaacaaaatcaataatttagttatattgcacattaaagggtaatagctgctacagaaaaataaagagcaagataagggggttttagaagtgctggactgaaaataaatgattgcagttttaaagaggatggtcagggaaggcctccctgagaaggtaagacatatacacaaagacctgaaggaggtgacggagtgagctgtagctatagagatatctggaggaagagcattttggctgctcaagcagccagtattaagaccctagaacagaaccatgctagtatattcaggaaagcataaggaggccagtgttactagagcaaagaggccaaggaggagagtaatagtagatgaggacagagtggtaaccaggcccaattgtgtaagggttttcaggtcattgtaaagactttggcttttgctctgagtgaagagagaaaaggctcatgatctgatacatgttttaaaagaatcactctggctgctctcttgagcagagattgttggatgacagatggaagcagggagaccaattagggagctatgaaataattcagatgagagatgatagtagtttagactggggagagcagtagagatagagagaagtggttagattttgatatatttcaaaggtagaatgacctgcacttgtggcatattcaatgtggactgtaaaagaaagagtcaaagatatattcaaggtctttggcctgagcaactggaaagatggaattaccaataacgagatttaaaaaagactgaatgaagtgagttttagggaaaatgattgggaattcaaatttggacatgttaggtttgagatgtctagtagatacccaagtggaaatattaaaataggaagttggatatatgaatctagagttcatgggagaggttcaggctgataggtcaagtaagataaagactaagaactgacctaaatttagcaatgtggagatctttggtgagtttgacagcagcatttttggtggaacggtggggacaaaagcctggctggagtgaattttaagagaatgagaggagaggaattggcaacagagcgtcaaacaattttctcaaagagttttgctgcaaaggaggaatagagaaatggtgcaataactgtcaggagaggatattttacaaagggggaaataactccatgtttgaatactgatggaagtaatccagagagagaaaagaactgatataggaaacagaagggaaattgctagagcacgtcctagaatagatcaaaggggatggatctaggtggcataagagaaggtactggctgtagataggagtatagatagttcatctatggtaatgggcaggaaggcagaatgtgtagatgcagatgctattaggagcataagtgtggtggtaggagtttatggaagttcttaactgattgctgcatttttttttttttttttttttgagaaagggtctcatttttgtcacccaggctggagtgcagtggctagatcatggctcactgcagccttgacttcctgggctcagatgatcctcccaccttagcctccggagtggctgagaccacaggtgtgtgccaccacacccagctaattttttgtatttttagcagcgagggggtatcgccatgttgcccaggctagtctcgagctcctaggcttaagcaatccacccgcttcggtctcccaaagtgctaggattacaggcatgagccaccgtgcccggctggattgctgcaattttgacagtaaagcaagaagcagggtcatcagctgaaagtgaggaggaggggaatagtgtcagaattttgaagggagagtacaaagtgcaaaataatgacctaggatagtgggaaactaaatggacaaaggaaatgtaagtataactgccagatgtcattaagagtccacttgaggttcatagtcatgaatttaaagcaaagccagtgaggatgcttgtgtgctgtctctagccacattcaggtgcacaggtgcagtcatggaccaggcagagagctggatttaacaaatacgaggaagtaagagagggacaaggaagttgagggtgtatgcaagggagtaattacaatgataagtcatgaaatttaagctgagcaagaaagaaagataaatattagggaagtgggatagtgacatggtgataagatcagtgtgggccagtgggactgaagagtaccttctagaaagaatgagctgtgaaagataggaggggttggtcagagattggctagagttgcagtaactggtaaagataggtttggaggagtgccactcaatgagtaggccatggactggtgccagtctgtgaactgtgtgttactgatctgcaaggagataagttcagaaattgaaaataaatgtttagaaacactgctgcgacatccaagcatatgatcagtggacttgtatttggaatgcctttgtgtttttaatctcatttttgtgactatattttacaaaagtattggtctgcaacagattagatacaaacaaagtctggtcctcccccacagtggaagcacatgctctcacgagcatgcatgggagtgtatctccaaaggtggaggacaaggtcactggaggagaggagtgaacagtgaactcaccatcatctctagtcttccaagatagcaggctgcctgactgcacagctccaggaagcaccattctcattgtatgttacatgaacaatacaactccaggtactgtatgaatggtgctcttagaatgttcaaggagatagctagtgttatccccatcttacagatcagaaaacaagctcagaaaggttaaataattgcctaaactcatacagctactaaggggaggagccaagatttgaacctaggtctgtctgctgtgctaaagctgaactctgtccacaataccactctctttctctgtcacatgcatgtagcacagccataagcctcatgagaactggggaaaaataccttttaggaatgtgttatggtccatgtgaccaagccaggcatttcaatttattttagagtcatgactcattacagctgctgtgggaatccatacccagtcgctgcttagacccctatctctccagtttgtctttgttgaaccaaggggctgaagcacctcaggaatacagcatccactatcaccacaggatttcctgcagtctgttcttgtgctttagtaattgcatatgtattaaaagcaaattctaaagagacatttatggaatggtaagattatgagtaattttaatactttaatctttttttttcaaaattcatatgatggatagatacattacttttctgatcagagaatgtctagtatagatgtatactttaaaccatcttgctcatggttcaagtcttagactctaaaactcagggctgtgatgagggctgggaaggccccatctctcactgagcctgagtcccagatacactgggagcctcagcatttccagaaaagttggtgtttgttgcttcctgctctccccaggtgcatggagtttctgagaaatccgtaaacaacgtaagcattgatctcttaggatttcctaatttccttcatttcttgcctatccagtaggcctcagcaagtacagcaacactaaagttaatttgtaaagcttatctgggtgttactggacttgtgaaccctgaggtaacccactgcttctggaaagccctcccatgctccaagtctgtatattcacccaatgcataggatacagcgtaggaattgggggtttctgtgtccatatggcccatcaagctgcccctgtgaaggcatggtctatggcacagcacaggacctgacacacagtgaggagtggctcagtaggaacgagttggacaagtcaatgaacaactgctgcccagcgtgtgtaggtatttttgtggtgatgtctttaatcttttctaccttgagaaatttactggcattaatatatattaatgtattgtatatgaaaagaacttttgggctgactggtataagacttattattacattcagacacatgacttttcacctagggaagatatagaagaaatgaatccaccaaaataagcaaatataactgggcagggtaggacatgttcaatccggttaggtttaaagaatcaaaatagaaaataggaacagaattttactttgaaaaatagtactgtaaatcacagttttggtgctgtggtaagacgaatcattaaaatacttgaatatggtaaaatgctaatcatcacagttattaattgagagtaactaaaaacctctggttggcctcataagcattagtaaagttttcaaatgcatgttactaattattgttattaatgtgaagttttaaacctgatcccctttgggagactaagtgtcagtgtgggtgaatttttcactatgcctaaaaaccaagaactaccaaatgaaatttgactcttcttttcttccatcttaccaaattgctcatttcatcaatatgaaaagcaactgatatgccaggcagtatagatataagctgtctcacatcatttatttttataaatttgtgttccagtcaaatgtggaatactttggtttcaatatgtaccttattgatgttaagggtctagaatcattataatgactacggtaaagataagatatttttctctagtttgtctacaaaaacctataaaaactagcaaaaaggttaactattttatttaagtagagaattcttcttctagatttgaatactaaataaaacacagaagacagttacatcctattttttattataccttttgaaataatttgtatataccttttaaataatttcaagtgccacaaaaaaataatgttaatagctcaaaatcaaaatttaaaaaaaaccctatgtataatttttaaaatctttttctcctcaagcgttttacgatgggataatgagacagatgtctctcaactggaaggacattttgacattgttatgtgtgctgactggtaagtacataaaaatcacaaaactcctgttagaaaaaaatagctttgctggagtaattgggctgtgttgcttagctgacggctaagcaaagtcaacaaatgaagcacaaagccaccttaacctcaacaaattaatattcatctccatgtgacagttataaggtagtcttctatcacacagtaacttctaccacattatttcccaaagattgattttgagaagcatttccattttctggaattgcctctgtttcatgcttgacgtatcagtaaatggacgacttaggcaaattgcaaataattatggctcggagaggaatagtctggagaaaaaggagtttatcaacacaaacagctcaattagcttacttcttaggagagatctgactattgatataagggaaaatatatgtgtgtgtgtacacacacatactctctagcaaataaacatatctgtggaatatctttggggaaatagcttttcttaaaatatatgtttgctatctaatgttttcagtgtattcaattataatagttaattatacctaaaacaaaaattataaaattacattttattcttatgcaaataataacatgacaatctctgtcaggtgcctgccttttaaaaataatttacattcggtattttgccctctattttagcccaatctacttatttgttaatgaaagtctgatcgtaagttacaggataaatatgcatcagaccttaataattatttcaactaatcttatgtatttcttcatgcagtttgaataataattatttcagcttatgggaaacattgacaattcacaagtattttccctgttaagagtaagatcttgtttgaggttttatcatgatgtttattaggacactttagatttgaaaacacattaagttcagattctgaagaagttctgttatattgataaggccaatcataagatccagaactcagggaagactttccctagaggagaattgaatgaaattttcaggaagtgggttttgttattattattattttaataagattttcaatggataacttttctacaaaagtcattggaattaggtttgctttttttcttcagaaaaaaaaacacttctccatgaaaaataaatattttgtctattcttagctgagagtttctagtttttcatagcccttttagtctttttgcacccaatttcagaaaatcttgttccaaaaataggagaaacctggatttctgactaatcaatgataatgtgcctcaatgctgcagccctcatctaatcaaaaataaggagctaaaacctcaccgtatgattcgagcaagtaatttagtaaatgcctttcctcaccaaatatgagaaagaatcctccaggtttcattgcacagatgaagataatgctggcaggattagatcagattaagcatgaaagtcagatcagagagcagcggcaaaagggaaggggcagcatcttcctgaagctttagacaagggtcacacgtggatgggctctgattatatggggaaggcaggtctggccaggagatttagagttaaatttgtcccttacgcaaatatcaaaacagcctggctttgtcataccttgtgttatggacactctcaccatgtcatcctatttgtaccagagggaaaagcagaggaagtaagatttaagctcttttctgattaatgttctcaggttaaaaatagccacacaacatgtttggaaaacattcttttttccctagccgacaacagggtcacgtacactgatatacataatgcatattcaatttaagacttacattacacacacataacataatattatatgtatacacacacacatagatacacatctggtagctgtgtgagaatttatggcttcaaatgaactaaatacaccaagcttcattttataaatggcttttccatgcatgaattgtttttttttttcccctgggtgttgtaaatgccagaatgtcagcctgtttatactttcccatttgtaaatgtgaaacattaagctactctcactgcgatgctgatagtatttccaaaagaaatgctttggtaatggtctctcttcatattcgcggggatgggtaagctgcttagaaacttagaaagtacagtaatatttctaatatgcacgttgtgcatgtagcagtgaagcacaggattccacgagttctttatgtcctgttggtgtggtgtttctctgtaagagttattgcatggatgctgcttctaggggcaggcaggcaggcaggcaaaccgtgctacatatttttaagaatgtcactggggaggaaaagaaagctctctttagacactacctccaagacgaaacctgaaatcctcagtgtcaggaagaggtgccacacataaatagatcacattaagtctcacaccatcctttagtcattgtcagcaatgagatctggattaggccacaggaatatgaagcaagagtcggagttcaaatattaggtacatggattaaaatcttattgaagcgtttccagcaagggtggcattgtctgattccctgaatagctaaccagtggtactgcttgatcccatttacatgaaaacaagctctattcacaaacctattccaaacccacattgtggttcaagtaaaatgcacatgattacaacaaatggtgatatgtttatgttcttaaatcattcatatattcagatatttacattcaaacattcaaaaacctgtaggcagtgggggaaataacttatttcccagaagagacagtctgttagttcacaactaaatttagtagctcaactagattataaaataaagaggcaaactgtgaaagctagtcattatttcaccattcagcatttttgacaatgaaaaatagtttcatggttcagcagttcctaaataacttgtaaaatgtcaactttgaaataaacagaaggaaaaaatgaggtgcagccatacctgcaaaaggatgctattgacaaacatcaaaatattagaatatttaaccacaggtgtagaaaaaaaacctgcctattaagttcctcagttgacttgtttaatgttgagtttaatataaggattcctttctgctggaatgcagtccagcctggtccttgctgagttagaatagtgagtgattgttaattttaagcctgcctttccagactcctgttcaatcacaatataatctaagggtctggaagtaagatgttttttatccaatgaacgctttcattcagtgtttgaacggccctccagtttattgtagctctgcaaaaatagaaatgactctgtgcatttgaattctcaaaaggcttagaaagcatatctgaaatgccacccataccctgaccggcccattgagctgggtatgcaggacaatcagcacatctgtgtgcctgcagcccgagactttggaaagaaataagggaaagtacattggcctgtagcaacccaccccgattgctctctcagcgtttttgcacttgctatatactctaaattgtttcttttttttagtcctttttactttgctctaaatgatgaaaaatgtttgatttttaagctgattttgtgaaaatttttttccctcaaaatggaaatactgtaggctctagaatttgttttctttcagatgctgtgatcatggacagctccaaatcacaactcacggaagtttacacctgaaaatatctttcgcccaaatatagtcagccctttcacctgacacctgagaagactcagtcccagagaaaatacatgaatcacccaagattgctcaactaaaggggtagagccaagtaaaattagaatacagcattattctgagctctcataaaaatcagttggtaaatactgaaagaggtcattcctttgctgaagttaaatctaaaacagtgactttaactcagcacatttcacattgaaaattacataggggtcttcctttctgtggctattgacagagaaaaatgtctccttgttctctgcactaattaacttccctatgagaggaattacagatgctctgcagtctgcatgaaactgattctaagggaggtgatgaaaatggtctggcacctttcctttgttggaaaatctgtgattcagatcaatggaagaaagcaagtgttgatccacaagtgaattatatagaggtctgtgtgtctgtgtgtgtgtgtgtgcatgggtgccctttaatggtcaaactagactgccaatgtattttgatcagtaactgaagtgagagttaaaatggtatctctgtccccatcactgacccactcagccttttttaatagatccacttaagctactgctgttctctcagcccattaagacttatttaaggggtgaattttcaggagattatatatcattccctctaaaacacattgaaattgctcagatgacatactctacaaagtgttataaattctgcatcagagctaagtagcaagtgagcttacttggaataaagatctattagagaactacaaagaattaattttgggaaatttgatttggagagatggagtagacagcattacctttcaaataagtctgtttggaatgtgtgccgtgtgttaagctgtgatgttaacatctttgtaatcctgaccaactttaaggggaaatagcactttataagggcatgtttgaagctcagttcttaaggtgctgttcattttttttttctaacgatcttaccggttttaggatgcacagatataaaccgagtgtggtcctttgcttaaatgccgcatgtcccaaccagccaggtttcccgtaggcctgggtaactgacagagatattttcctacaatcataatcttcttttaaaaatccagaatgcttaattattaaaactcaagatattgggccagacgcggtggctcatgcctgtagtcccagcactttgggaggccgaggcgggcagatcatgaggtcaggagatcgagaccatcctggctaacacggtgaaaccccatctctactaaaaataataaaaaaaaaattagatgggcatggtggtgggcacctgtagtcccagctactcgggagactgaggcaggagaatggcatgaacccgggaggcggagcttgcagtgagccaagatcgctcaagatattattgcctcactaaggaataaaatagagagtcctgaagagcgaatattttaaagacatacttatagtttgattcctttctcgttaattcttaatggttattaattactgtttaatatgacttaatggcaagtttgtgtagcacttaatttacatacattctgtgctccaagatttgagaatgtagttttgggaaagataaagtctttccatgggtaataatcaggtcatcatgagtgatggatggaatgggatgaggttccattctggacgtggtttctagctcatctgaggattcttttcccattgctcaaagtgaccttccatagaagaaccttccatggaacctgtgatgaccaaagacactcaagcaatgactttttggaaacttcttataagctgctctcctcagaggagaaaatcatcagatcggaagagaacctagtctgttgaaatatcctacctgaaagttggttcatccttgacagtatcagtaaaggagtgtgtactacccactttagggacattgaaactaacaccctacataagctcctcaattccaaggactgtgatgatctgccagtctgtccacaagtaactgccagtctgtgtgtacgctgtgctggaactattaatagtaaagcaaaatgaagacagaatggaagctccttgagaatgggaactttgtcttattcatagctcatccccagttcctaaatttgcccttagtatatagtagatgctcaacaaacctttatcaactaacatatcttattaatttgatgtccacatagtcatataggtgggtgtttattgacaaggaaactgaggcttcacatgaagtgacctgcccaaagtcacacagcagcaacatcaaagccagagctctttaaaaccctgaaccaagttcctcccttgtctgaagtacagctccacgcaacagccccctctgagcgaggacagcagccctcccactgacagctgatacccacccttagctaaaaagaatgatgcagggccctagagtaggtggtgcttactcttgctgtgtgaagagacaggaggccaaatcagaagggtctgacctgcagcattagaaatgggagtagggggccttacttaggcccctcatggagatggctgatgcacaaggttgctgagtgttctagcttaaggtaagggactcaccgttagagaagaaattcaagttgtgaatggaacagttttccatattactttccaaacaaacgtatttgaaatgctgttatgggttaagaggtttcaaaagtagttttgctgtcactgctttttttttttctctctctctcaagacaaagtctcactctgtcacccaggccagaatgcaatgtcacgatctcagcccactgcagcctccgcctccgcctccaaggttcaagcgaccctcctgcctcagcctcccaagtagctgggattacaggcacacaccaccacgcctggctaatttttgtatttttagtagagttgagatttcactatgttggtcaggctggccttgaactcctgacctcagatgatccacccaccttggtctcccaaagtgctgggattacaggtttgagccaccgtgccctgtctgctgtccctgctttttaaaaagacatcgttgtcaatttttattaagtagaagacagtccttttatttatttattgctttgcaaaagacacagcctagaactgatggctctaaagctgaagatgtatgtctcatacactcctcaagccatacactatcactatagtgactacctctacagcacggctgttcttccccaggaatcaacgttttcgtctactgtgtcctcagctgttttccaaatgttatgagagaggcaaagaaatgcaaagatgaggccgggcacggtggctcacgcctataatcccaacaatttgggagactgaggtgggcagatcacctgaggtcaggagtttgagaccaacctggccaacatggtgaaaccctgcctctactaaaatacaaaaattagctgggcatgatggcgcatgtctgtaatcccagctacttgggaggctgaggcaggagaatcgcttgaacccaggaggtggaggttgcagtgagtcaagattgtgccactgcactccagcctgggcaacagagtgagactcggtctcaaaaaaaaaagaaatgcagatgctctctgccttcaagaagcatagcagctgaatgagaggacagctgaatgagaggacaacaatgaaatgcagggacctgggagaacctccaaattctctacttcttgtactgagcttggaaaagggagagatcactatggatgcaagtaaacagggatggctttctcgaccaaccccgcctaactctagtcatctgatgacctccgtcttttgcctaaaccagtcagtgctctcttccgtacattatttcatgctcaggagtaattacaattagatgtgagaggcagtaccaagcagtggctcagagcacagactctgaagccaatatggtacagaggtgaatcccagccctgccaattagtagctgtgtgactccaaacctctctgtgcctccatttccttagctgtaaaatgtggacaataataataatgctaacagtaaaaactacctcataggattgatgtgaggattaaatgagctatgaaaacctcttagaaggtacctgttagctagtactcagctcagtgagtattaactgttttgttattaagacgtgtgtgtctctgccatttgtatttaacacgtgtccttgtgcctggcttacctccctgttatactgtaacctccgtaaggacaggcatagtgcccccttcttccttatctctttactgcttgtattagtccatcttgcgctgctacaaaggtacacctgaagctaggtaatttataaagacatgagatttaattggcttatggttctgcaggctgtgcaggaagcatattgctggcatctgcttctggtgaagacctcaggaagttgccttatggcagaaggcacaggggaagcaggcagtcacatggtgagagagaaggagcaatagagagaaacaggaggttctttcaaccaaccagatctcacgtgagctcattaccacggggagttcaccaagacaaggatgaaggatccgcccctatgacccaatacctcccactaggccccacctccaacactggggatcacatttcaacacaagatttggaggggagaaacatccgaacagtatcactgcttttcggtgctgtatatacaatttgggccccatggttttggcatcctggatattccagtactgttcagatttcagagattcagctgtactttctaagctcagttattatgacctcagttcatagttactatgttggtgcaaaagtaattgcggtttttgccattaaaggtatggcatggcaaaaaccgcaattacttttgcaccaacataatatcagatcacgtatcccaatatggggttcagaaaaaaagtccctatcaataggtatcattggcagcctctagcagctttgctttctcttggcagagtgctctagcaatgcccaggagcccttctgcagaggctggacaactctcctggtgtttggcagccagctctgttctgcatgccttcggcacaatatgctttcacctgtccccaccctaaccccacccacagaatcctttccttggttttaataaacttccagctgtcttcgtccattttctgctgctataacagaataccacagattgggtcattgataaagaacagaaatgtaattctcacagttccagaggctggtaaatccaagatcaaggcacgggcaggttggtgtctggtgagcatctggtctcttctgccaagatgacacctagaatgctgcatcctctggagaagaagaacacgtgtcctcacatggcagaaggcaggagggcaaaaaggagccaaactccccacctctcaatactgttgcattggggattaagtctccaacacatgaatttgggggaaacattcagaccatagcatcaggcatggccaagttaagtaacttgccacctactgccaagcaacccaaactcaaaggtctgcgacctgcaagttcagataaggaaactgtctcaagcttccaagataataactggtgaagacagagtcagactgacccaagcaaaggggtgacagagctgcatgaacagaaattctctaaagatcagggatggaaaatgaaaaatcaaaatgaactataaaaacatgaacctgggttgggtacagtggcatgtgcctgtaatcccagcactttgggaggttgaggcaggaagactgcttgagcccagtagttcaagaccagccctggcaacagagtgagaccctgtccctacaaaaaaaaaaaaaaaaaaaaaaaaagaactagctgggcatggtggtgcacaactgtagtcccagctacttgggaggctggggtgggaggattgcttgagccctggcatttgaggctgcagtaactggatgacagtgcaaaatcctgtctcagaaacaaaaaaaaaaaaagaaagaaagaaaacaaagaaaagaaaaaaaacaaaaaatcaatgtagaggcccagagaggaaaatccaaagttgccatggtctctgtgatatattgtctgagattgttctttgtttttgtagctgttcactcctaagtcagacgttgaatctaacctcagtgctgtttctagtcactaaactctattacctcctgagatatatttcatggtttgggtgtcatagggctggtggtttgtggtctgagggcagccacacagcacccttggtgggcagagggcccaggtctaagggagactaggctctaatgacaggaagttgccagagtgcttcatctcaaccagatggctaccccaaacagcagtttggaaattgtccctgtaacattaacacatggcccagtcacgtgtgaatcctggcccattgcatgttgacaacttggctttagttggataacactgaccacaatatcttctcccctcccaccccctccagtgagacacttgaatggtaggaaacaatttctcttttttagcgttgggtaaacatgtgtaattagccttgtacttatctccattagtatcattagacttgaaaacccagtttaatctggattctgctctcttctcaatgtcagcctgtttctggaccagtacagagccagccttgttgatgcaataaagagattactccagcccagggtaagtatgtttctattttctcctgaacactggctacagaataattagtctgtgcacaaagatggagagagtaatggaatggcaggattaatgtcatgtaatactttaatacttattatgtccaacttcaattgggtcttctgatctattagattctttcctaatcataactaggaaacttcttacccttggccttctgataagaaacacagtgggtagtgaaataaatgcagccgcttcaaagatagtgtgaggttatttttatcaaagaatttcttgagtcttttcccttgataacaatatcttcatattaaagttgaagtatgatattgaaagttttctgttgacttctgtcattttcaattccttcaatggcaacctttctcattggttatttatttattgcaaaataatacttttttctttttatttctgtttatattaaagaaaaaggacttcagatgaatctgtatattaatagttctttgctttaaaaggaagtcattatttacatattataaacattaggtcacaatgaagccaagcatggcataaaatattgtgcacatttttacatttatatatccatttatgccggtgagtaaattacagagtttgtatccactcttattttgttggactgttaaactaagctaggaggtcctgcagcctaaacggagagttaatatacatctatttaaagtaagaaaatgagtttaaagctcatgcattaaaaaaaaaaaaaccttataactatgtaagactcttgctgtgccataggagtttaaaataggttaacagtattaatacagtcgaagataggaacgcatatttatctgagaacactgaagtgtgtgtgtgtttctaaagtatttttttaaaaaggtccactctagtcttctgactcagtgagacttacagaccaatacctttcaacctttcttttatatcttttttataaccttcagtggttcccagagcaatctgataatcatcctttgccatacactgttgctttttattttgctatctctatgtagctcagaaacttaaaacaggtgtcttggaggagtagccatagcttcgtaagtggtagtcagtccaattcaattggcctcctcagttcccctgtgaaatgggcaccagatcttgaggcaaggaaggggcatgttccaagctattgacggccactgcatggttgaataggccacccaagttgaggacagaagaaggaattttgggtttcagcatccccccacccctgtcggccttgggtgattcttgtgggcatttgcaagactaggattttcaggggcggctcaagattcttgaatatgaaggcctctatgaaaatgtatcatacataaatataatgctttcaaggactcctgaatctcacactgtacaaatagtacttcactcatcaccaataccccttcaaagcccatttgtggcaaatactccattttgcagcagatttgcatgatttacctaggatctattgtaaatcattcgcatgatttacaatagaaaagtgcccaagctatgaatagacctaaacgcagattagactggaatccagcagctcttctgtaccctctaataaaccctgaacacactccctccatctgaatcgtggccacacgcagcagccccctctgagcaaggacagtagtcctcctgctaacagctgatactcacccttagcctagagaagggtgaggcagggccctaggggaggtggcacttactcctgctatgagaggaacagggaggccaagtcagaggggctcacactaacctgtagcattagaatggcagtgggggggcctcacttaggcccctcttggaatggctgatactcaaggctgccaggtattctagcctaaagtgtaaggagcccaccatcagaggggaaatcccagttgtggatggcacatggacttactgaaattaccacccaggaacctcatccccatcaacaggtctggggtagtgggcagttgtcctccctgagcctccacccaaatggaccacagaaggaccatgtgggcttgccagtgaagagcccagtcccacatcctgtgttgatgggctaggaggctgtccagagcatgggagcaaccagtagaaaactggacttttcttcttagctctcagggctggctgtttggcttctggaggacctccccctctgagtatacagtccaagactaagaaaatggtcaaggttttatttcattacaattagagctggttttagtgtcctcttgagcccagacaacaactccatggttttgtggcccagaggctgaaggtgtcacaagaagcccacaaagatggccgggcacagtggctcacacttgtaatcccagcactttgggaggccgaggcgggcggatcacaaggtcaggagatcgagaccatcctggctaatatggtgaaaccccgtctctactgaaaatacaaaaaaattagccaggcgtggtggcgggcgcctgtagtcccagctactcgggaggctgaggcaggagaatggcgtgaaccctggaggcggagcttgcagtgagccgagatcacgtcactgcattctggcctgggcgacagagcaagactctgtctcaaaaaaaaaaaaaaagaaaaagaaaaagaagcccacaaagaaacaacacaggggctacatggtggatcctgagttcttgatgattcagtgcaagatacagcaagttctccgtgcacttccagcaaatgcaaacactgcacttccagcaaatgcttcaagttcatagtgtggccccagtttctgaaggtctagtgtagtgggtggaaagagtcagaaaaatctgcatacaaaccccaagtctacattaactaccttgtctctctgagcctgcatttcctcacgtgtcaaaaggcaaggctagtgcccaccttgtggattggtgtgaaatatttacatatgtataaatccttgatctgtgcctggcttacaggaggtgctccttaaggggagctgcttctcttttattgctgtagaacttatcaaggttaatccacatgagatgtttatccagggggatgctggcttggctgatgggatgcctgagttccaggcctagtgtggccctaacaggctctggaaccgcctcttgctccattatccccaaagagggaaaatgagggagttcacctgtgctctcatagagttctatcagctctgaaatcctgcattctcctcgcagagagaaggtatacatgggctgtggaggcagaaagcttaggcccaaatctggtctctgccactgactgaattaatgtctggaagcctcagtttctcatctgtaaaatggggagtgaaaaagctgatgcactgtaatgcacatgattggctctgagtatctattcaaggctagctctggttactttggtaaatacagactatgggggctttttttttttttttgagatggagtctcgctctgtcacccaggctggagtgcagtggtgcaatctcagcttattgcaacttccgcctcccaggttcaagcaattctcctgcctgggcctcctgagtagctgggattacagacacgcaccaccatgctagctaatttttctatttttggtagagatggggtttcacctatgttgatcaggctggtctcgaactcctgacctcgtgatccacccctgccccgaccccttggcctaccaaagtgctgggattacaggcatgagccaccacgctcggccttatgggggcctttttccaagcattttcctggagaaatgctggtgggaggggaagacatgattttcttgacctggactttgagaatttctgcacataattggcacactgcatctcccctgcacatgtatcctgaacacctgtagcaggccctgtactggttctgggaggattgcctacctggatgaagatgacactttactatagacggtccccacggagtgggggagagtactctacattggcaagacagaagtaactgcaaaatgaaggttcaagtgtcaagctgtgggaacaaatgaattctgccatctaggggagtatggttgatttctaccttgagcaaatcagttgtctggagtcagagggtccagaagcaaagaaagtagatggagagggggagtttccctgcctttcattttctatactggagctatgaatgaagagaggtccccagagagaccttagccaccagggtgggctccttgcttggcccaggggtgatgtcagatcccaggctgagcttagattctcaaccaaacaggcacctgtgcctgaaaagtctttacaggaggccccaaattttagcagggaatatttgttaccacctgaaatgcaggctttcctcaacctgctagtctaaagaaactgtaaagatagttaactcctgtcataacactacaagggactctccagcaaacttaatagatgaaaacaatagaataggcatgaaaaaggaatgaaatcagcacattttacgcattccaagaagcaatgtccccctcaaccccccactcacttttccctctggtgagtggcttgttgttgctgatgattgatagggtgactcactgtcattgtattccttaaaagtccatgacaacagcagtgtccagtatcagaggacccaaacgtaatttaaaatataggcgcagcagcctgcaagttgaactttcgtccagaaatgacaaccaacaaatggtatctactaatattcctctgaaatgactttgggtacagggaggggagccaagccaaccagacagcatgagtttactcaggaccagaggatagaatattgacagtaatccagcttgttaccactgctaaccaactgtcaagaattcagaaatatcactgtggaattcacttaaccttcttcagaaattggccctacccgatcaccagattcccagagtcctgcctatctccaaggtgtgctataaatgtaaatcataaactctcatattataaaagcaattttttgggggggaggacagggtctcacttggtcaccaggctagagtacagtggcaccatcactgctcactgaagccacaaactcctggactcaggtgatcctcctgcctcagcctctcaaatagctaggactacaggcatgcaccaccatgcctggctaatttttgtatttttagagatgggcttttgccatgttgcccaggctggtcttgaactcctgggctcaagcaatcctcctccttggcctcccaaagtgctgggatgacaggcatgagccactatgcccagccaagttctttttgctcagatactttctcatctttttttttaaaaaaagtctaacatctctgcccacttctgtacaaacctttttgtttgcttgtttcagggaaattgccttgtgtatgtgggatcagtaccgtgaactgaaatggtgctgagacacttgggttcttatctgcttactgagtcagagacccagcgactcctcaccagtgcttggtgagaagttagctcctacagttgtaggattccccttgacacaagggttgtagcttatagagagtcctcagatggttttaagaccctcagtgcaggggcccagccctgagaagtccttttctaatatctacccagatgctgttcagcacatacagtaatgtgtgcttagcagagaataccaagacatgaggtagaatctctgcccccaaagacgttgcagtctggttgtggagatataacatacacacaggtagaactatagcagacaatgtaaaatacagcccagtgctatttttatttgttttgtgaatctttcgaatttacgccttagtattggactctgtcctgattcaacaaacatttgttgagcaactgctatctgcttggcactgacgccattcctatgcgctgaggaatgtgggctaggagaatgaatatgcactaggagcactgtgggaatctcatagtttagcaggacagatgaacacatgaactcccaggaattacagtgcaatatggtgggtgccaggaaagaggtaccaggagaaagcaccaagagtgactgcctgaggaaggtttccctagaggcagtggtgtctgactttggtcttaaatagtaagaagggcactttgagtgtgtggagtaagaaaaatcatggtgtgttttgggatcaacaagaagtttgctctggctggagtgtgagagtgtctgtggttttgaggttagggttggggaagggcaggaagatgaagttaaagagttatgaatggccatcgagaccatcctggctaacacagtgaaaccccgtctctactaaaaaatacaaaaaattagccgggcattatggcgggtgcctgtagtctcagctactcaggaggctgaggcaggagaatggtgtgaacccgggaggtggagcttgcagtgagcggagattgcaccactgcactccagactgggcaacagagcgagattccatctcaaaaaaaaaaaaaaaaaaagagttaggaatggccaagaacattgtgatgaagagaccaggctctactgtatgggtaacggagagccattgaaagtttttgagcagtggtgtggtcaggtgtaccttctagaaagatcactctgcccatagcataaagggtagattggagtaagggagagcttgaaagcaatgaagctcctcagaggtccagtgtggaccaatatccacctggaatcatccatttaggagctagtgaagacctgaaaatggagaagaggacaatgaatggatattcactgagcgttccactcagcaaacatttattgagtgcctctcagatgccagtcactgtgccaggccccggggatagagttagatatgacctaactctacactggaggggcttacagtctagagacaagcaagggacgatcacctggtggtgtgtgattggcacagcagaggtgtgggcaacccttgggggcagggagtggaggtggccaactggggaggaggcacagtagggaggccagagaagtcagcaaaggcgtcacaagggcagggagtctaacctgggtgctgagggatgagtaagagtaaccaggcagacagagaactggaggtgagagaggcattccactcaaggggagcatgtgcatgtttgaacacacaggatacataaaagaacagatgggggatgtgatgaggttggcctgactagagcccaagatgtgtatgagggagtggcaggagaccaggctgcgataaaggcatggggccggtcacgtggggctttgcctgccataccaagaaggtgggacctaagtcaaggttttcaaaccctgtttaaatggcagaatgttttggtcaaaattttttagccagcaccccaattacaaaacagataaaaatgatgcagctttagttaaactaaatgtgagactggtacttcctctgtcttggtcttcctcttatccctccaggccacccctgaagcaattcagaacacagtttgagaaccacctgcagtaagtgacagtgatgcaggtagggggatgtggcactgagaggtcttgaagggcaatgccatgtttcccaagtttccagctttatttcgaaagtgacagatacggaagtgcttggtacctaagaggtactcagcttgcatatctgagtgtatgcgtgtgtgtgtgctgcatttgatggatccttccctgggaagggtaggggttagcagtcaagaatattgagttttattttggacaaaatggattaaaggtattttcagaatacccacatgcagagatgtagtaggcacttgaaaatgtaggtgtgagccctgggcaatggtgaaagctatagttatagacttgggagttattggtctataagtgatagctgaagccatggacatcagtacaattgccaagaattagatggaacgtgatgaaaaagtaggcagagccctgaggaccactgacaattaaaagacaggtcagagaagagaagctacaaaaggagacagagagactgagagagatgccaggagaggaagcaagtgaaagctgcatttcagaaaccaggtaaagaaaataggctggacacagtggctcacatctgtaatcccaacactttgggagaccaaggtgggagaatcgcttgaggccaagagttcaagagcagcctgggcagcataacaagacctcgtctttataaatgacaacaaagaaatagaaaatcagcataagcttaaacatagaattggtatttaatagtttggttgctaggaagtgaaaaaggaacaaactaaatgtgagactagtgcttcctctgtcttggtcttcctcccctaatgcattttattggcatagcatattccttttaaaataaatctgaagctggggggagtggggagggatagcattaggagatatacctaatgttaaatgacaagttaatgggtgcagcacaccaacatggcacatgtatacatatgtaacaaacctgcacgttgtgccacatgtactctaaaacttaaagtataataaaaaataaaataaaaataaatctgaagcataccaattttttccagaagtacactccctttaatgtgtaagtatagattagtctagcaaaataacaacaactgagctcacaaggtaagcagtatctctgtggtttagtggaacttctccctctcctctccaggaataaatgaattctcttaaatttctgctcatcagtcaaagtgttacattcaattgagtattcattctgcgtttaaaataattctgcaacggaatgcttagaaagttgtgctttggcaaattgaaaataatttttctaaagtgatgggctaatttgaaatccatattccttttctggttttgatttgtgcagctgaaatcgtaaagcatatccctctgatggtactgttccccctgtgacgtgttctctcccctggggatactggggtctaaacccattcattatggggagggggagatgctggcactcagtagggctcagtgaatgaatggatgatgggctcttttccatcctaactattaatccacctctcaaaggtgtctgtattcaatgaactgaaaaagaaaacaaaactcctaagtagttagagattaaaactactgcccagtctttctctttctcgtgggtacagtgttgtgcacagaatgctgctctctaaaaccccatcatagcagctgactctgtaaaagcttctcgggaaaatcttttcaaaggaataagcaatagaacgtggcttttgaattcccaaagactcaaattctttagattactcaacttctggatttagtttattgtctcatcaaatattgactgagtgcttactatgtgctaggcactgagaaaacgtagtgaataaaacattagaagatcctgttgtcacggagtatgcattccagccagagaagacagggcaataacaaacaaggatacaatgtgtgtccctggtggtaagtgctaagaacaaaaataagcccggcgagggactggagagtgatggggcaggggctgcgttctgaacagggtggctagggaaggacaggtaaactgagagctgaaggaggaaagggatgtttaggcagagagtgctgtcacatgcttagctgctgtcacttacagcttaccccaaccagggcatgtggagatgcattgctttgtcaatgcaaggatcagcccaacctagaaacctgtagccttgtgaacatgatgatatgcagcttagataatagctgttaaaaaccgactcttcaagtgttactgtgagacaattttttgcaggtgacttttaaataaaacagcttccattattcaaaaatccagaatggcaaccagctcttagaaatgactaaaatgacctaccagcattccctgttgtttttttttttctaatggagacttttgctgtcctgccgagaccatgtattatatctagtttcacataaaaatgaatttttgctgctaagtttgaaaactgcctgaaaatagcaattaatattgaaaaagctgacagaaccttaagtgtagtggcatgattggtgctgctataattatgtgcctgagtgtgtacaggctgatgtaaacacagtatgaaaacacacttgatgctcaggacagtgtagccacgtattttcttacgggtaagtgagggcgaaggggagagggagagagaattgatagcatttttagagcactgttaggtggtgtagatctttctaatcttacatcagtataatctttctaattattttcacattctgtatttgatcctcacaatttgtcggggggaaaaaggcagggcaggctttgttcttcccatttaatggatgagaaaactcagtggatcagcgaggatgggttaaggttcttatcgacaaaatggagagattggactacattatttccaagcttccctctaactcaaaagttctatgattattttctgattgtcctgaggtgacaccgctgtttaatggtggagactccccttaagtccagtcctttctgccacagttcctccttatattcttcaaatccttcactgtatgtttaatcatctgtaaaatgcaatgtctactgtacaggttgttgagaagatcgctgaggggattaaaggaggatttgtgaagcacctagcacagtggtagctatcattatcattgtcatcactgttactaataaggagacatgtagtgtagtggagagagcatcagtgctggggcttctgatcattcactgacagagttgataatacctacaacatagggtggtttaaagactaaaggagggttgggcacggtggctcatgcctgtaatcccagcactttgggaggccaaggtgggaggaccacctgaggtcaggagtttgagaccaacctggtcaacatggcgaaaccccatctcgactaaaaatacaaaaaaaaaattagccaggcgtggtggactgtgcctgtaattccagctactcaggaggctgaggcaagagaattgcttgaacccaggaggcagaggttccagtgaaccgagattgcaccactgcactccagcctgggtgacagagtgggactctgtctcaaaaaaaaaatgtctaaaggagatgatgtttatatgaatgcctagcccagtgtctgactacactatacctacaacatagagtggcttaaagactaaaggagaggatattcatatgaatgcctagcacagtgtctgactaccaggtgctcaagaaatggctggctggtgtgaatgataaaccactcttcataagaaactcagatatattttcatgattccctcaaaacctaaagaggcatttcacagaggtgaagtgtaaccttgagagtaacagaagcatatagccatctttatttttttttttaaaaaaaaaaaaggagattctgaagtttggccattctgtacacatctgagagggaggaaaaatccgcatgcatccaatagttagcaaatggtcattgtgaagtttcatgtcagatggtcttctgaaatccagtacatactttattcagttcctcccattctccccactgcaacaatcacataagattgtgtggattatttagaaaaggctgtttaccctcattataccactttctttgaaaagcaatcatgtgaatactatgaggaactgcttggctatagtgatgaccatcatgagggattcaataaagttggaaaccaagatcctggagcctgtatctgacagcgtggtcacagaaaaggctagggcaggactgaaatatgaaaactctccaagaggaattgtggttacttgtctctatgaaggatttcttggtactgaattttcagggtgcaaaaaactaacagatgtaagcatctgttgtcacatgccccaggactgtgttggggaagcgttggcaggtgctaaggagtcacaaggtgaatggcactgccctggaccagttactctaaaatctagtcaatggcttaacccactggacctgagacaatgcatattgttcggaacaccggctttcaaccacattttgttttttataagtattatttgaaaaagataaaacacagcaactggccatttggatgtgaaatcgattcttatatgatatacatctctcctggaaattattctcactgtgaatgtccatcctgcatagacatctcaagaacaattgagtttttctacttgagagcagtacattaaatgctttgaccaatgtctgttatgtttggttaccttccagttttaaaatatgtgaatttcctttttactgttctaggggaaagcgatggtatttgccccacgccgagggaatactttaaaccagttttgcaatctagctgaaaaagctggtttctgtatccaaagacatgaaaattatgatgaacacatttcaaacttccactccaaggttagttttctgcttgtgttagataacactttaatccgcattgcattttgaagagatcatggtctttttggcaggtaacctaaatatttgattaaagtactccttagatgtgttgcttctgaacagctatttgtatctgattattttgtgtggtaaagccatcttttatctttgcatgtctagaaggattttacagaaaccattcctgtttactcttttctctgaaacaaactaatcttttcattcataatagactaatttgtaggatgtaaggggaggtggcatagaatgaataacatgcatttatattttaatgaaaaaccttcagcttttaagtaggttaaatgcttagccgcactgaaataaatagaaggtgaatgtctaattgtatcatgttggactgtaaatctttatctctgcttgctttatagctgggtcagttggcagtttgagactgttaaatctcatacagaatttcacagttgtggggttatatgtcagatggaggcactacaagatttaggtcaaaagcacttatctgagagtgatttctaagcctgcttacataaagcaatgttatcagcctttttattatttataggtatagaccaatataggacactgagaggcgagtgtttcactgaaaactttttaggattctcacgtttgctagtagtacatgtcacagtgactagtataacatgtattatttcagtaattttgtgccttacggaaatctcccttcactgagctagtctgaccttggcaagagactttaacttgtcatgatttcacaagttgtaactgcagaaaaataaaggcccgagcttaattttctcctgggacaatgtgaacagcatcctttattacccaggactgtaatataatgtagaagtgtgttggcttttggaaaaatatatgaaaaattaatctgatcttccaagcaagagaaagaaattctcactttctgaaaatgaatttatttatttgaatctttaaggttccatttagcctctgggggaaaaatggtgctttgtgaactgaaagagttacattacatcctctcactggtggagtcaggcccattgctcatgatcagaaaataaaaacaggatggtatgtgattcagatcttaccagcctctctagaatgatgttttccccttttcaatccctccccctaaaaaaaagcgggtctttacctggtaggaaaagggtccctcctggctccctggactcctccacccaaaggaataatgtggctttctctccagggtcgggctggaactacaaggatcagctgacagctgcttcaatgtcgtgccattcactttccccctagaacaacaaatgcttttagtttcccagtgacagctcaggagagcaaaggcttgggtttctccaccagcaaagacgttcagcattgtgcctgataccctccgtctcctccctgaaagacctgaggagcgttgggacatgccaggcacgcccacctctcctctgtctggaactttagagtgttagcgcctggtggccagcacacctcctctttttatttccaacgttgtacactaccctgctaagtgaagcacataaataagtggctttattttttctctggtcataattgctgaaaagtcaaattcacagtttgctgacattggtacattggactaagaaatagttgtcttcgtggttgggggtggggagagtgtagaaccctaggagaatattctgcagagttggcacatcctggataaaaggtataaacgggcgcccatgatatatatatatatatatattttttttttttttttaataatgagagctatttcagctggtgtggggttctgcttctagcaaaagaatgcctctggtccctcctgtacctgccccagcagcggggatactgtgtgctgaccgggctggcacgtgcagttgtgctcctttgcaggagaaggagctcgcccagaggccggagcagtgagccgggggccacgctggagggagcgggcagcgccgctgctcctcgcccatccccatgccctgcagcagggcgcgaaggcggaggcccaaggcagcacccctgcccctccagccctgcccgcccgcccggggctccgggacgcggccgccgggagcctccaccctggcggcttttgttggccgcgtgctaatagccagggcttaaaagttttccatcttgagcggcaatcagctttcttcctctccatctctggccaaagccccctcgtccctgggacgcgctgctccccaatggaggagcggcgttttccttcaggctgcgtgttatcctcttagccctactgtgttggaatagagcgtaaccagctggaggactgtaagacgcctgataatgccgctcttttccgctgtcccgtcttaatcttgttacacaaatggtcgtgaagagattcatgaattttaattttgccctctgcattagtgcctcgcgtcactcatacacagctgccttcgaagccgagtttttcacccctcctcttacaacaggggaaaaaattagttacttggcagtagtgcaaggtaaaaaaaaaaaaaaaatctacagatttaggcaaccacccatgaagctgattaacagtcagtgatcaggaggaacagctttgcctcttaaacttttcacctctcattgttaactgtgaaattttatttccgttaaaaagcaagcctgtaatcaaaacggtgccattccgcacttttctgccagtgcttttgttaaactgtgcccacaccatgcagccagtgtgctcaggaaccaggcagccaaaggtgtagcatgttttaaaaatattgcttttcagtccatccttgcaaggggagaaaaataaaacacttccctctcctccccagccttttggtctcctcaaggctgagaatcaaattcattgccctcatagtgtggttcaaaacctttcggatagtaagatagcaaatcgttttgtaaggtagagatgtgacttcgagattacagctggcttgatgctagttggtaaaaatactctcattcatgcaaatgttctttgaaatataattttacatgccgtgggttttttttttataaactttcgcaaaaccaccctgaagtgtttatttttctgtatttttgtacatagctctgaaaataggcttgggctgggctgtgaagtcagtacattgtgttaaaaacacggccatattgcacttctgcttatctattcaaaatgccacattacaagtggctggtgcttataatctgtgtggtgtgctgttgataattgtggatactgtaaagggtaaacagtctgaactccactcctgctgctgctgttcacgccgtagtaaggctgagcgtgttacatccaattatgaagtaaagcataatgctactaatagcagctatataatttagtttagtcctcaaagaccctgttttaacctctgaaattggaaaattattttattcatgatttgctttttcttcattttctttcaaggtgccttttgatatttgtcaaaattgtaattattaattgggcaaggaagtacagcctgggtaaatggaattattcttaaaactcataacattcccccatcgaagcaagtattggctaagagctttgtgtgtgttcaagtaccctcacataacagacttgcttgattcagaaatgatccagggctgggttatagtgttgcctttgagggttgtcagctcttccccattgtggaaaggtctcacaggcaagacggggctggcccctggcccctttcagcaacgaagcctccactttggcctccagaggtcagcatagaatccaagttaaaagtgatttctaacccatatttacagaagaattatttatcccacatattacctcagggactttataaagagctcatttgagtctctgtatattagtgcattgtgagtgagtaggtcagctgactgccactgagtaatcaactttcccttatccccaatccccaaggaaagaattgagctagcttggtcctctcttccctctgtaaaatacttcagtgagctccctctatcactagggcaactggcaacaaaagtatttacagtggtaagtcccggtcagtgggtatggactgggaagttggtgaagccattttctcagcattttctaaaattagactaaatagtaaggttggaggacctgtgtttaggcttaacactctcgctactttggtagcagcaaaaatccacaaggatcttcctaaatagacaacaaatcatctgtacacagaacaaactctgtctaagaaaacagaatgaagtcacctcagtgactgtaccaccatcagttcttgggaaagtagattggaaagtggattagaaattaaaggctgaattagctttatgttccccagcggaaaaggggaagtgggctcatgactcctgtccttaatagtgacagcatgtccatgtcatggtttgggaatatgatttagaaggaacatgcacttcgaaaagattcaagttaacatgccccagagggaccaacctgggagagtgtgatgttgaggccattcattttgctttagggtgggtggagtgggtggtgtttgactaatttaaacaataaaggaattgactccctgtataatttaaagaaatatttatttttttattcttataatctaaaaagaaattaacaattggctcataaattccaacttcaaaaatattaattttgtctttataaatagcaaatttttatttgctagaataaatataaatataactttaaaactattccagctgaatgaagaaaaagtgtacttcatatgtgagaaacctaactggattttaaaatcttatcacagaaatatcctcagaacttccctgcacagtatgaacaggaatgttgctagtctaattgttggagtatgttctcctcctcagagaaaagaatttttgagtgacttattattaatgttaaaacccctaagaagcacctggagagcctttgcagtgtcttgggccccacaagcctttccctgtgcccagatgttgccacggactccaagcagtgatctgaaatgcccgcctgcctgaatagtgtggcattggtcagaggcagagggtacagagagcagaaacttctatgtcaaatgcccagtcaggtgatgatgaatgagccccagctctgccttctgtcaagtgcctcacagtttatagaggtcaaagtgcagtttgggtatttatgaaaaaaaccctacccacccccaccaaaaacaatccccatgttaatgtatagaattgtcacattagtgccactgagaactactttgagttgcttttctgtgatttatttttccagaactatatattttggtgtaaaagtcatcatgatactcaacattaatattgactggtaaagatccctaattggagtccccttacctttttctttctattattgttttcagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaat

SEQ ID NO: 2479 - DNA, 45367 bp, Homo sapiens
caagaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggaagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtacatgcccagagatcatttagggtgggtgccaggatgagattggtttatggttcttttgttcttcagaaccaaattatgcctgggttgttcagtaagcacattccattatgactggtcatgccaagttgctccttgtttatgatattcttagaaaatcactcagcagaacccagcagttattttactagctgaagggctatttgctgaaggcctttgagccaaacgagttgtttaatttattgcccactaagtacatacagttgttcagtcatcaattctaacttcttagagcagccttccttctaaaatctatgtcctgtttctggggactttatagttgaatatgtcagggtggcagttgggaattgctttcccagtatacgaagcagctagtttggctgtgtggctgggagtgtattagtgaataaagcataaataatatttttttaaaaatcaagtgatatctgtaaaaagtataggctgagtcttaaagtttaaattctaaaaaaggaagggaagtagaaaaggggtagcagtatgcattcgtcattacttgaattaaggattgtttaaaaccatgtccgtattagtataaaacaagtaaagaattaaccaggggtagtggcgcatgactgtagttgcagctacttgggaggctgaggtgggaggatcgcttgagcccaggagctctcagccagccagcttaggcaacatagggagaccccgtctccaaaaagaaaaaaaaaaaagtgaaaaattattttttaaaagctaagttaatttcttggtgggttatgtgtaaaacatccttacaatatattgctcaaaccagaacatacttcagagtaaaattatgccagatggcaggcatacactgggaacttctgagcaaattggttggtatggtcactctacttcaaggcaacaataggaaacaaataaggaaactaacaaactaatgttttacaatgataattggtttgaagaaaacaaaacaggatgatatgaatgtggaaagtaggaatgggcttaatgtatctttaaaatgctacaaatgaattcttgaaacctgcagctttctttaatcactagtagaaggcttttctttttcacgctcctatcattctctctcttctttttttttttttttttttttgtgatggagtttcactcttgttgcccaggctggagtgcaatggcataatctcagctcactgcaacctccgtcacctgggttcaagcaattctctcggctcagcgttccgagtagcagggattacaggcatgcaccatcatgcctggctaattttgtatttttaatagagacgagggttctccatgttggtcaggctagtctcgaactcctgacctcaggtgatttgcccccccttggcctcccaaaactctgggattacaggcatgagccaccgcatccggctgtatcattctcgttttaaaaatcatcctgcattgtcactcattgaagaagagtgtatctgtccttcatggtgcagctcaaacccattgccttcattactctttctttagcctccctaatcagaccatgggctccccaccccagatcttcggctttggatgtgtttctagcatcctttaatcctgccttgagtgactccctttcccctgactcatgacctatgacctgctgccttttgcacattgagtgcttaggaaaagcaatgctctgactgcatagacctaaagccctaaatccagagatatgtttaccacttcctggccctgccttcttaataatctccttctggataggtccaacattcctgtaaacatggtggtttctaatcagctctgatgtttgtcatttccaatacctgttcttggaggaatgttttacttcctgcaatccataggcatttgtctttgaggttgaagggatttcattgttgttattatgaagatcccattccagctttgagtctggttttggtgattgccctctctccttctaaaatgtggggtgggatcccttgtttactttctccagccactttgttttcatcctcatgttcctttgtgcctcatcataagatatattttgttgctgtgctggcttagatcaaaaccctcttgctgcctgttgataccgtgtgagatcttgcagctacccatatgggggaactggggtacagagacagaaataagcagcctgtcaggccaggcgtggtggctcacgcctgtaatcccagcactttgggaggccgaggcaggtggatcacgaggtcaggagattgagaccatcctggctaacacggtgaaaccccgtctctactaaaaaaatacaaaaaaaatcagctgggcgtggtggcgggtgcctgtattcccagctatttgggtggctgaggcaggagaatggcgtgaacccaggaggcggaggttgcagtgagctaagatcgcaccactgcactccagcctgggcgacagagcgagactccatctcaaaaataaataaataaataaataaataaaataaaataaaataaataagcagtgtgttataggggaaaagcccagatcccaggtgtcgaatgactctgtgctttggaattagtgaccttcagcctgcggtgtggcctctgacagtctaattctaggaagtcacatcaggattacacagaaagttactggagattgaattctagactcaagttgctgaatatgcatttgggactctgaactagaaggagaaaacacattatctgctcattatcctacaaagttctaaatacaaagtttcatttccacatgtcttctcagccaagcctagaattctcttctgtataaattcctgggttcctatataagtgaacaagggaaatagtccaaatttagcaagttcaaaggcagtctgagagtggaaacaaagactcctcaaatattggcacaaacttaccttctgtgttgaggttgcactccttctcagaccccgtgcactgacaacatttatcacctttttaaattaattgatgcatttacttatttatttatatttattatttttttttttttgagatggagtctcactctgtcacctaggctggagtgcagtggcacaatctcacctcactacaacctccgcctcccaggttcaagcaattctcctgcctcagcctcccgagtagctgggattacaggaatgcaccatcgtccccagctaatttttgtattttttagtagaaatggggtttcaccatgttggccaggctggtcttgacctcctgacctcaagtgatccacctgtctcagcctccctaagtgttgggattacaggcgtaagccactgtgtcctgccttctcacccttttttagacatgccctgtctattcttgctccctcctttcctttgctgtgcctggaagcccttcactctgatcccctttgcccacaccatcctggaccttctctgtccttaccctcaggggtcatcagcttcctctgcccctgggggtcaagggccaatgccctgatgcccttaaagcactttctgcagctcttccttagctcttcagtctgatcatcatcccacccctgcctgcagacacttccgagaccaacaccgcccaaaagaaatacaatgggagccacataagaaattgtaaattttgtagtagccacattaaaaaaaggaaaaaagaagcaggtgaaattaattttcatatgttctgtttaatccaatgtatcatttcaacacataatcagtataaaaatatatacatattgttatttttttttgtattttaagacggggttttatcatgttacccagactggtctcgaacacctgagcccaaacaatctgcccaccatggcctcccaaagtgctgggattacaggcacgtgccaccatgcccggcccagtataaaaatattaatgagatttttacattctttctttttgtacagggtcttcaaaatccaatacatgttgttcccttacagcacatctcaattccaaccagccaccctgcaagtgctcagtagccacatgtggctcttagacagaacagtgcagtgtagaccacatgaccgacaggggccatgcgttactctgctctgttccttgacacttagcccagcagctggcatagattagctgctcaaaaaccatgtgtagaataaatgaacaataccacagtcttggttttaaatataaaatatgagtaagtcacagagattttttttaatgctatgttaaatgtcatcgattactgatagatgactaatttgattttctctttcttttttttttgagaaagggtcttgctctgtcgcccaggctagagtacagtggtgtgatcttgagtcattgtagcctccgattcccaggttcaagagattctcctgcctcagcctcccaggtagctgggatcataggcatgtggtactgtacccagctaatttttgtatttttaatagagacggggttttgtcatgttggccaggatggtctcgagctcttgaccttaggtatcctcccaccttggcctcccaaagtgctgggattacaggcgtgaaccactacacccgacctaatttgatattttttgtagagctagatcttcctatttgaattatactcaaattcaacaaaattctaagtatttttgccttcatgtaaatatttctatcttaggcatatttgttatattttttgtcctttaactaaaacaaagtagggtttattcatgactttgacttttttcttcaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtaagttgaatggaaagtgggcaagatggggatgaggtttgagagaagcactttttcaaatgtttacttaaagcatttcttctccttaactgtcatatactatttctttccctccctccctcccttccttctttctttccttcccgctttctctttcttcctttccttcccttcccttctgtttccttttttcctttctcctttcctttttccttccctatctcctttcttcccctcccctcccctcccctctcctttccctgcttttttttttttttttccaggcagggtcttgctctgtctcccaggctggagtgcagtggtgcaatcatggctcacttcagcctccacctcctgggctcaagcaatcctcctaccttagcctcccagtgtattggggttacaggcgttagccattactgtgcctggcctgtcatatgttattctaatacaatctttccctagcatttgaaatgtcttttactcattaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactgggtaagtatcaacctgtctgacttacaaaggggtaaaaggcagatatgtagtgattgaactgatttagtaaaacccttttgagggaaaaatgaatgaatatagtttatcggaagggggcaagtttctgaaagaaatagaaataaggtttccagttgttatttactcaggcttccaattattatttagatttctgatttcatcatagagatgatgtgttctagcaaattcaaacctattttctctccttccacccttccttcacttcctacccggtccaacttggattccatgtcccattagtttgataaccatttttctactatccatacccctttgcatttttttttcttgagatgtagttttgctcttgtctcccaggctggagtgcaatagcacaatctcagctcactgcaaactccacctgggttcaagcaattctcttgcctcagccttaccagtagctatgattacaggcgcgcgtcatcatactcggctaatttttgtatttttagtagaggtagggtttcaccatgttggccactctggtcttgaactcctgacctcaggtgatccacctgcctcggcctcccaaagcgctgggattacaggtgtaagccaccgctcctggccccctttgcctttctgactttttgtctcctctgtctgacaaaaccctagccatgaatgaacccaattatctattttctttttgcctaaaccttagtagttgagtctctggagacatcacaccttcattgtccccacctgaactgagccatccactcttcttgggaattttgctaatttcaaccgatcaactttccctccctccctcatttcaaacatcgtatctgcctctaccccatcttatcactctcagcagcaaactcgacttcacagagaaaacagaagccatcaagcctgcctgccccattcccaccctcttcctactcactccttttacaacagaagccagatccctcctttctggggtgaccagatttagcaaataaaaattcagaatgcccagttaaatctgaattttggacaagcagtgcataaaaaattttttagtgtggaccatactttcttttttatttttatttttcagagacagggtcttgctctttctcccaggctggagtgcagtggcttgatcatggcttactgcagtggcttgatcatggctcaccgcagtctttgcctcctgggctcaagcaatcctcccagctattcctcccaagtagctgggaccacaaatgtgtgccaccatgcccagctaatattttatttttttgtaaagacagggcctcactctgttgtccaggctggtcttgaactcctgggctcaagtgatcctcccgcttcggccttgcaaagtgctgggattacaggtgtaagccactgtgcccggccacatgagtaatacttatactcaacaatatgcgtgttgatctgaattcagatgtaactgggcatcctgcacttcatctggcagttctgcttctgtctcaggccagagcttccccttgcccgggtttgtgttctctcctgcctttattctggatcatccctccctcctccagtccctccttctctcttctggaccttctccataaatatttaaacatcaacttttaggtgatccaaggacactcagaattgatatatttgcaggtcaactttgtgatgtgtgattttctccctataaccttccgtctcccaggttcagtgaatggtactaccatgcagcctgaggaacaggctgtcagcaagtcctggcagtttcacctctttttttcctccagttcactgacttgttaaaattgcaatgacattagcaaacatttacaaaatacttactctgtgccaggctctgtgctaagtgttttatattcattaatttagttaatccactctataatcctatgagtctggtgtaattcctgttttgcagataggcagactgaggttactcagctaataaatgacagggctaaagatgggatctagtcatttcagctccatagtctgcttttaaaaattgctgccatactcaaactatatcatttcttgcttatagaatgatcacagctgccttgtgatccagtttttccattgcttttttagttctccactatagtcaaggttgcattttctaatgtaatagttaatatgttcaaaaatatgtatatgtatatgatggataaacaccttgtagtatatcatatatataaccatatattgcaagacttcgactctaaaaaaattattttttagtttcctctattttgaactttatgaaaagtgtcatgctaggtatagtcttcttaactaactttttcatgatttattcatgtaacttcaggtagctatggttcatacattttcattgttgtatatttcacagtgtgaacaatccatggtttacttatccactcttcagttgatgggaagttgggctacttccgttttttttattatgaacaatgttactataaacactgtcattaatctatcttggggtacatgtgcaagggcttcttttttttatttttgagatggtcttgctctgtcgcccaggctggactgcagtggcgtgatcttggctcactgcaacctctgcctcctcagttcaagcgattctcctgcctcagcctctcaagtagctggaactacaggcacccatcaccatgcccacctaatttttgtatctttagtagagacagggtttcaccatattggccaggctggtcttgaactcctgaccttgtgatctgcccacgtcggcttcccagagtgctaggattacaggcgtgagccaccacgcccaaccaagggcttcttttaggtaaataactaggagtaaaattgctgtgcaggatatcgcatgctcagctctacaggatagtgtcaaattcattatcaaaatggttgtaccaatttatatcccccacagaagtataaaaaatacacattctcattaattcctgatattgcccaactttgtaatttttatttaaaaattattattattttgtgtcagggtctcattctgtcacccaggctgaagcatagtggctcaatcatagcttactgcagtctcgagctcctaggctcaagcaatcctcgccacctcagcctccttagtagctgggaccacaggcacacaccatcatgtgtggctgagtttttttatttttttgtaaatatgggctctcactatgttgcccaagctggtcttgaacttctggcctcaagcagtcctcccgcttcagctctcaaagtgctgtgattactggcatgagctaccatgcccagcccagacttaaaacaatattgccttgagatcttaattttatatttatttaattactaatgatgatgtgtctaattcctaatacagtaattatctaattcctaatgatgttgaacatcttttcttacatttattcatttaagtgtccatttctgtgaaacacctctttatggtttctttcccctactttcttttgaattatttatccctttgaaattgctttcttcagttccttttgtattctggatactgattttttattgtttatgtacactaaaaatctcttgccctggttgtgtccaggtgggctgtgtgttgaattggaaagggtgcatgtccttgaaaggcagcagctactactcagcatctgcctgtgttgccatggacatgtggactcagtgtaactacgtcttccaactcaaaaagatttatgtaaaatctcccagttgttaaatgttttccagatgttctctttaacatgaaatggacaaaaggcctaggacagagccccatgaaactctcacattcaagggcccacagcgttgacttaaggagtggccagagatgtgggagggcagccgggagagtcataccatggggccataaatgtgagcatttccagacagaggagaccagcgacatcgtcaactattgctgagtaccaacacttgaagttgctttttattcttggagactggtagagattttaagtgaaggattctaataattttctggggatataatttaaatattcagtctatctgggctcaagctccaagatgagcggaatgtttctttcttccaaattgactaccattttgcttctcttcacaaacaagagtttggatcctggacagaagattcaagaaaatacattagtaatgtcagttccttaagttgaccttgtcttgggtttgagaacattggtttgctgttgcagttgttacaaacagcatctactgtaaaaatacgttgcaaccatgtttgtgaggcattaggccaatggggtggggggtatttggaaggggtttctttaacctgctgctctctgtagaaggaaaactctcaggatttacatactctgcctgcaaaggatcagggagggcaatgatctttatttgtgggcaataccattataggtcactgatgtgctgttttctttgtttgccagttaagtgtgtatggaaactccagttggcactttgacgaagtgcgaaaccaatgttattttcatcagtttatgaaagagcaacctgatttaaatttccgcaatcctgatgttcaagaagaaataaaagtgagtatagatacccacacagacttctccattaatggaggtttaggtatttatttaaaacactttatattgcacagtaattgtgtaggcaaaatcaagtctttaattatttgaaatactctatagttatttgaaacactttatattgcacaataattgtgtaggcaataatcaagcctgaattaaatcccaggattaagctctctggtgcaaatgtagactctcagacatgtctgtgactccttccttcatctaactcagagtaccctaaatggaaggagtcagaaacacctgccaccctagctccaagttgccccgccacctgtgacagtgagctgtacggtgcctgtgacggtgagctgtgcggtgcctgtgacggtgagctgtgcggtgcctgtgacggtgagctgtgcggtgcctgtgacggtgagctgtgcggtgtctgtgacggtgagctgtgcggtgtctgtgactgagctgtgcactgtctgtgacggtgagctgtgcggtgtctgtgacggtgagctgtgcggtgcctgtgactgagctgtgcggtgtctgtgactgagctgtgcagtgcctgtgactgagctgtgcggtgtctgtgacggtgagctgtgcggtgcctgtgacggtgagctgtgcggtgcctgtgacggtgagctgtgcggtgcctgtgatggtgagctgtgcggtgtctgtgacagtgagctgctgcagggaggtgggtcatttggggtctggctcctgcatctaaaatgggcttcttgatggttatttggctttcatgtcttagctgtctcatctatgaaacacagttggtggcaatatttgtctcatagggctgtttggaagattagatgagataacacatgcacgacacttctgtactcattgagtaaatattaacatattgcctactccgtgccaggccctgttctaagcactgggaatgcagcagtgaataaaagaagccttaccctcaaggagtctccaatatactgaggggaaagcaggcaattagccactaaatatatatatgttaggtggtggtgaatgccaaggggaaggggcatcggagtgtcaggtagaagtggctcttctatataaagtgtgtaggagacaccttcttatgatgagatgctgtttggacaaaaacctgaagtgagaaaggaaccatgtgactatctgggggaagagaatttcgggcagaaagaagaacaaatggaaaggtcccgaggtgagagtgtggttcatgtgtttcagggatggcatggaggccagagtgtagggttgccaaacttagcaaagaaaaatacaggatgtccagttaaattttaaatgaatgatgcaacatttgagacatactgctaccaaaaaattgttcattgattacctgaaattgaaatgtaattgagtgtcttgtattttatctggcaaccctaccagtatgctggagtgaaatgggttagggcgctgaagtaagaggtgggggctgatcatttctcacaatacaattcacaaaacatatcagctatgttcttgttcttgttcttgctgctcctatggctacagtgggcagaaacttaggggagtaggggagtcctctgagccaagtaggtgggaaggagaccctaacagaacggggagcattgggtgcctttccacagctcaccacgtcagccagatagagtggatgcaagctgtcatgctggagtcactaggggcacctagaacccttggtttagtttaattttgaaataacagtttaattgacatataattcacataccataaaattcaccccttttgagtgtgtaattcagtggttttagtatcttcacagagtttcacaatcactactaatttctgaactttttttttttttttgagacagtcttgctctgtcgcccaggctggagtgtagtggcatgatcttggctcactgcaacttgtgcctcccaggttcaagcgattctcctgcctcagcctccgagtagctgggactacaggcatgtaccaccatgcccggctaatttttgtatttttgtagagacagggttttgccatgttggccaggctggtctcaaactcctggcctcaaatgatccacccgtctcagcttcccaaaatgctgggattacaggtatgagccactgcacctggcctaatttcagaacacttttatcttctcaaaaagaaaccccatatccatcaacagtcactccttatggccccctccctttcttcccccaccccctgggaaaccacaaatctactttctatctttttacccacctaagcctcagttagataggttttgcctattctggacactttgtacaacagaatcatgctgtatctgtatatccctggtaggtgtctgtatctgtgtttatttgagaaactgccaagttgtttttcaaagcagctgcataattttacatttccattaacaatgggtaagcgttctaatttctccacattctcaccaacacttgttattgcatatattttttattacagtcaccctagtgggtatgaagtggcatctcactggttgtatttgccaaatggctaaagacgttgaacatctttttatgtgcttatagttcatttgtatatctgcattgtagaaatgtctatttaaatcctttgcccatttttatttcatttttatttatttattttttttgagatagagtttcactctgtcacccaggctggagtgcagtggtgcagtctcggctcactgcaaccccagtctcccaggctcaagtgattcttgcgcctcagcttcctgagtacctgggactataggcacgtgccaccatgcccaactaatttttgtattttttgtagagatggggtttctccatgttggccaggctggtctcgagctcctggtctcaagcaatcctccctccttggcctcccacagtgctgggattacaggtgtgagccaccgcacctggccctttgcccattgttaaacagggttgtctttttattattgggttgtaaaagttcttacatattctttttctttttctttttttctttttttttttgagacagggtctcactctgttacccaggctggagtgcagtggcgtgatctcggctcactgcaacctccacctcctgggttcaagtgactctcctacctcagccacccaagtagctgagattacaggtgcgcatcaccatacctggcaaatttttgtatttttagtagagacggggtttcaccatgttggccaggctggtctcgaactcgtggtctcaagcaatcctcctgcctcagcctcccaaagtgctgggattataggcatgagccaccacacctggcctcttttcatattcttgatacatgatttacaaataatttttcctattctgttggttgtctttttactttcttgatggtgccttttgaagcacaagcgtttttaattttgatgatgtcctatttatttatttgttttttgagacagagttatgctcttgttacccaggctggggtgcagtggcgcaatctcagctcactgcaacctccgcctcctgggttcaagtgattttcctgctgcagcctcctgagtagctgggattataggtgcgcaccaccatgcccagctaattttttgtatttttagtagagacgcgttttatcatgttggctaggctggtctcgaactcctgacctcaggtgatccacccgcctcggcctcccaaagtgcagggattacaggcatgagccactgcgcctggcccaatttatttatttttttcttttgttgcttgtgcctttagtgtcgtatctaagaaccattgcttaatccaaggtcatgaagatttactcctatgttttcttctcagtttcacagttttagtcttacattttagattgtctgtgatccattttttgttaatttttatatagggtgtgaaggtaagctgtccgactttttttttttttttttgcatgtggctattcagttattccaatcacgtatgtttaaaaatactattctttccctactgaattgtctggcaacttttgttgaaaatcaattgaccataaatgcatgggtttatttctggactctcagttctgttccattcatctatatgtctgtccttatgtcagtaccacacactgtctgaattactagcgctttgtagtaagttttgaaatcgggaagtgagaatcctacaactttgttctttttcagtattgtttcactattccaagtcctttggatttccatgtgaatttctgagtcagcttgacaatgtttgcaaagaagcctgctgtggttttgatagggattgcattgaatctgtggttcactctggggaacatagccatcttatgttaagtcttccaattcatgaacatgagatgtctttccatttatttacgtgttctttcatttctttcaacaatgttttgcagttctcagagtacatgtcttgtacttctttcgttaaatgtattcctatagactacttatttttaagactttttttttttttactgtatatgtttggtgtttccagaatttgtatgaattgttttggaattggttctggaagtaagcaccatgagtgagggcaccttgcctccatggggttgtggggttgtggggttgtggggtgggtagttgtagacatggtcagcagactaactaggggttagttttaaacttctctggtagcctgtggactctcctcttcttcatcaccaaaactccttatcacccacgcctcatgctctccccacacattctatgtgctaagtgctgttcctggataatttaatgctcagaataagcctaatttacgaggttttgtgatcattttacagagaaggaaattgaggcttagataggtaaagtcaccatccttgggagtcatggagcaggactgaaatccagacactcggacttgagttcatgctcttaaccacaatcctacacctgctttgaggcaatgtatgtgtttccctctccatgcttcactttttctgcacagatttgtcaaggaggttttcagttataaattgataaatgtgagtataaaccagctggtttacagttggtttatcaggcagtagatttttccaggctccttgtggcaatagtgatgaattgtctggggatgtttagacaagtgtgataaattctgcaaaaatgtgccagccaatacattaattatttttttgactaacccagctgtgctcttccagatacccaagccgtggagtgtgtggacaggatccttatttactggtcttctggctgaaatccctcatgtgatgaatcattaatgcctccggttgagagattagactttatttgcaagactggtttagaagatttactattagaagtaaataagaaatgctgagaagctgagaggaaagcctctttgctcctggaaagggacctttggcatgaaggagacttctgtcaccctcctccccaccttacccccagcagcgcttgtttctgcaatagagttaagcaggttaataatttgcagctcagagggtttgtgtggaggcggcgtttggaatgacttgcttgcataccaacttgtactcctggagcctgagcccacttcctccccgctcctatcagattttgctttatctgcacagtgggaagctggcatgctggggaaatccagcagagagcaccctctgctgtccttctctttctcctcctctttgtactggccatcaggggacttggctctgctctgaacctcttggggcttgagtgctttcagctgaagaagtcagaaaaccttctctgaggtatcaggggtatatatttgtataatactttatactttcccaatcactttggtttttactggtcctccacatttcttatttgacaaatgaggaaactgagacacagagaggtgaagtaacccagcgggttagcagcatggcaaggaagagactccagatggcctggcctcgtatctggggtttggagtgatcctacacctgccatatgggaatgctgagccccagggtagggactgctggggagacccagctgagagggaacccagagcacaggcgtaggctccgttctgtccctactaagcatgatactgctggaggcagcagctcaattcaaaacacaattcgctcactacctgcttgattagccatctctatgcttgataataataattgtgccatttattgcacctcctctatgccaggcactttattataatcattcactcatttaatgataggtattgtgtgtcttgaccatgtgctaagggtgtgggggctggtaagatagatacctcttgtggccatcctggggcttatattctggggtgggaggtggacaattaaacaggcgattacaataaaatgtgccaagcggtcatgacagtaggaggtaggaatacacagggcaagcgcctaacctggacacatttgcagaggaggtgagatacctgaggaacaggcatgagctaagtgaagaggcatgggtgggagtgtttccagcagaggaaagcgtggatcgtgacacattagaggtgctgggagttgtccagtatcactgggatgtgatatatagagcagggagtgacccgatgagactagagaggtcactgggggtgaggtcaggagcaccactgaaggccctggtaaggatttgggcttaaaaggtcttaggtatttattttttatttttattttttttcaatttgagaaatcagtctggttttggagaaggggtttgagtagggcaggtttggaggctttggggccagggaggaggatggtgcagtaatcgggaaagaaattctggtggctttaggccagtgatggaggcatagaggtgcagagaaatcatcagggctctgagaggagtcccctgtgaatcccaggtttcagatttgaatatggggtgggtggcagaaccattgtctgagatgggagacacaggaagagagagggaaatatcttaggtatgtagagttggagctgcctgtgacacatccaagtgttcagtggacagttagatataaggacactgggctgggcacagtggcttatgcctgtaatcccagcactttgggaggctgaggcaggtggatcacatggtcaggagttcaagaccagcctggccaacatggtgaaaccccatctctcctaaaaatacaaaaattagccaggcatggtggtgggcacctgtaatcccaactacttgggacgctgaggcaggagaattgcttgagcccatgaggcagaggttgcagtgagccgagatcatgccactgcactccagcctgggcaacagagcaagacaccgttttaggggggaaaaaaaaaagatataaggacacggagctcagggaaaagtctagtctagagataaaactttgggacttgttgatgtggctgatgtctacagagctcaggcaggtgtttggtgagagaagcaggctgggtaaggtgagcaagagggccaactgcaacgtagctggagcgaattgctcacatgtgaatgagggcctggtgttggtagaccttccaattaaaagaaaaatccaagggagccaggctagcaaataagtcagggcgccgtacagttgcaattctgctgccaccacttaccaaccatgaccttgtcaaaggcacatcatcttcctgagccacagtttcctcactggtaaagggggaacaataatggtacgtacctaatggggttacttgaagattaaatggtttaacctttgtaaagcacttaggatgctattttttttactgtatacagtacttgttaaatagtcagtaaattggtaagtaaataaatactattgtgaagtgcaatgtcgagagggtgtaagatggagccccaaggagcactgacatcaaagagctgcagaagagacagagaagggagacaaaccaaggggcagggtataacggagctaaggtatctgagtgtttccagaagacgagattggtcaacagtgtcaaatgatgcagagagattgggtaatataaagactgaaaggggtctgggcgtggtggctcatgcctgtaatctcagcactttgggaggctgaggtgggtggatcacttgaggtcaggagttcgagatgagcctggtcaacatggtgaaactccatctctactaaaaatacaaaaattagccagatgtggtgacgggcacctgtaatcccagctactcaggaggctgaggcaggagaattgcttgaacccgggaggcaaaggttgcagagctgagatcacaccactgtacgccagcctgggtgacagagtgagactccatctcaaaaaaaaaaaaaaaaaattgaaaagtcaattgactctggcagcaataccttatttactccatacagaaaccctccatactatgttattgatggagacactgaggcttagctggtcttgcagatgccctatgtcatgcagctggacagcgagagagctgggttgtacccagagggtcaaattctgaagtccttgatctttcctctacttcctgcttctggaggagttagcaaagaatttttccaagatttctgaacatgagtagggtcagttttctttctcttgcctctaagtagagaaccagtttcctctgtactctgaaacatcctttctcattccttcttgagatggacaacctgtgatttatgacattttcaagatgatgtcttctgtttgtttttttggtttgtttttgttttcttaatagagacagggtctcactttgttgcccaggctggtcttgaactcctgagcttaagtgatcctcccacctcggtctctgaaagtgctaggattacaggcatgagccaccacacctggcttaagaggatgtcttctctatcatcccatgtaagagtagacagagcttttcccaaacatgggtttttaggtaaacgggcccccaaatgtcagccatctgaaaaggaaaggcttggctcaaggttccatgtatttggatatgttaacttgcttccttaatgttgacttgctttcttttcactcagagcagcgagctatttaaagagaaaggagttaaaaggtgcccagtggaaaaaccaggagtgcgtgatgtcatgggagtcagacaggagtcaaggacgtagtgtatagtccagttcccagagtccacggcacctacatgggtcactagacctagctgacccaggctctgtgcccatttttgcatctggaaccctgagagaccttcatgggagtaaagagggttaacaattaaaatctgaagctctcttttccctcctggttgagagaataaatagcatgaagcaaatatttttcaagagcaaactttggattatcttggtgataatctgaattatcagcatttaaaatgactttcagaaaatgtccatcaagcttttactgttttgtctcattaaacaatgatattatttctgattatgctagggccataaaccttctgtgcggtacaagtttctcatgtttaatgtcaggtcaacatttcacaatgctgagatccggactccgtaaagaaaaggactggctttattttaggaaatcagtgcccaaaagcttgatgtttacacagaatggtgcttaatgttttcccacatttttgtcagaggccgcttggatgccttcagttattcgtgctctgccccaaccaatgttcacacttttaaagaacagcaccacctgggtgtggacccaggttgcgcggggtctgaagctgatagtaaattagggccttcttaaaatagagcacaaaattaagtacagaaaagttggtatttacttaaaatgagcaaagaaggggagttagatgagtgcaagtgagaggtcttgaagcttaagtttggttagcttcatagtaaggtcactcctgaagccactgaaaacctgttctagaaatgaggtgcctttctttgccccaccagacttctctagcccattctctgatgaatggctgtcacttcctgtttgccagctgcaaaccctccccagggtgaattgctgttttaccctcttgtattaccatgtttctctcctttgtctcagctgtgatttaaatatttttgtgttgctatttgtctagctggagattctaaaataatccgggagacctaggactgtgtctgttgtatttttcttgtggttgtagttccagggcttgcctaagtgcctggtatacactaggagttcaaatacttattgaatgaatgaatttggtaaaagataaaggcactagtaagaacaaatttgttttttatgccccagagaaaaattccactgggtagagattactggaggttatttgggtcacctgtgcccatgataagagttattcaccccagaacttgctcttaggcataaaaaattgattcaagcttcaccattcaaaatctcagcttaaagtgaattgacaggagcagtattaacccttgcatttagctgttgagacccttgacttgacttgaaacctccatattcacgtgcagatagaaacgcacttcaagtcaaacaagttgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgtgagtcaattaaacagctttacaaattacccagtcttagatatgtctctattagcagcatgagaacaaactctaatacacaagtgaactgtgggatagttgtcatttgggatctgtggctctgtttccctccataggtgaaaattggctgtttagtactttacagatggttctgctctaaaatgatatatacattcctgtgaaaccttccatacagcaagggatgagaaaagtagggagagccactgttcctttgcagagcttgtgagcaggtgccggagccggagcaggccttgctgggagaggctggctgtggggttgaggcaggtagctgaggctcaggacctctgcttttcacggtcacctggtcctcccacctgtcccagtacaggccagcctctgcctccacacttggctcatgttgtcccattcccaccctccattgaaatcccaccaggtcatctaggtcaagttcaagctctagctcttccttctcctgctgtgcccacccacatattttgaaatgtcttgaagctcttgcagccctgtaggcagaggtgtctcctctcatgaggacctgcattattaggtaaccatcccttgtcccacatgtccccaactgttctgtagacctgaagccagggaacatgctgtacttctgtaatgtttggtcattcaggctcaatatgtcattctttcatgctacaatttgttcactaagtaccaggtgctgtttcagaggcctacagacatgtaccaccacacgcagctaatttttcattttttgtagagacagggttttgtcatgttgcccggctggtctagaactcctgggctcaagcgatcctcccacctcagcctcctaaattgctgagattacaggtgtgagccgtcacacctggctagaaaaatcttttcaaggttcatccatgtcgtagcatgtgtcagcacattgttcctttccatggccaaatattcatcgtatggatagaccattgggttgtttccactttctggctattatgaataatgctgctatgaatatttgtgaacaagtttttgcgtggacataagttttcatttctctcgggtatatacctatgcgtgaaattgctgggtcttatggtaacttgatgtttaaccttttgaggaaatgccatactatacagttgattcttcatacatcagatctttaaaaaaaatgttaagtcagcccacagccttttctgattaaaaatccctccaggggtttcccatcaccctcacaaaaatcccagatctttcctgttaactacaaagctgagcatgatgagttagttttctttacctcctcctactcttacttatgctcctctggccacactggccacccccctatccctgccactgcctttttttttcttgaaacaggatctccttctgccacccaggctggagtgcagtggcatgatcttggctcactgcaacctccgatttttaggttcaagcaattctcatgctcagcctcccaagtagctgggactacaggtgcatggctccatgcccaactaatttttgtatgtttagtagaggcggggttttaccatgttggccaggctggtcacaaactcctggcctcaagtgatccacttgcctcggcctcccaaagtgctgggattataggcgtgagccgctgcgcccggactaaccacttatttgcaccagtcttcatctctctaatctttggcttcagcattaaaaatgcctgggaacaaggcagcccacgatgatgctctcaggagcaggtgaggcaggggagaggctgagcaggcaatgactaccttctctctagcaaggtgtgttggaagagtagggcaggagaggagagtgagccaggggcagtcatacaataattgggtttctagcacacacctttggaagaaagtctgtcaccaaagaataaaattaaatgtatgagaacctggatttttagcttaaccatttgtgtttgggatcaatttatttgtgaaattaaagccagtggaataatgtagattccttttttttttttttttttttttaaaagacagagttttgctcttgttgcccaggctggagtgcaatggcccaatctcggctcaccacaacttccacctcccgggttcaagtgattctcctgcctcggcctcccgagtagctgggattatgggcacccgccaccatgcctggctactttttgtatttttagtagagacagggtttcatcatgttggccaggctggtgtcaaactcctgacctcaggtgatccgcctgcctcggcctcccagagtgctgggattacaggcatgagccactgtgcccagcccatttcatcttttattatctgagtgtattcaagacaacactagtatctgagttttaccacaggatcgtcactattcttagttatttacttggttgatggttgattctattttttttctgtgtgttccttccatattactcctagcaggagatcctttaatatctaagcacttcacctctcatctgccttcctagtaaggagtgaaatatttaactattgaacaatgtgttattttctttgagtttgcagtgacagttaaggagttgggcatgagggagatgagaaactttcctagtttattctgagtcctatcttttcttatggtttcattctttcatttttagtagactctctaaactttgaaaacatccttataacatccattacaaatgtaactaattgtaattctgaattcacatatgaaggaggtgtgggagtcgctaaatgcagttagagtgcattttagtaagacagttatgctaaatagataaaaatagactgtgaatactgtgcttgttctgtatgtagatatctgttttatgatgccaagttgttaacagtcaaaactttgattaaacgttgtgataataacgtagttaatgtaaccaagcattttgcttcttcatctttaggaaattttacggttctggctcacaaagggtgttgatggttttagtttggatgctgttaaattcctcctagaagcaaagcacctgagagatgagatccaagtaaataagacccaaatcccggtaaagttttattttaaacgtttttcttttgccttttctgaaaatgtcatcagagtgttttctttctcagcctgagataccagttacaaagatgagttttgtcctgtgtctagcaagtaccctgatttatttctttaggaaatgtgcaagagtttgaaatgcatatgcactcgatgtttttttccactggttccctccagagcgagggatcccttgaggagtccttcagtgacaagggttctgaagacatggacagtgtgggctctaccaagggccacaaaatagaggacatttactcctgcaattttatcatctgacataggctcaagtgaggaggccttggcttggatgagatgtaattttttgttttgattctaggagattattgtcatcctagaaagacatagaaatgagacactgacatagaaatcctacaaagatacagaaactaggaaaaatttactgaaaccccgagaaagtataacagttaggagaaaggatagtgatggtaaagaaacaaatttaagtgcatgatgttaatagttttgtgagcagataaagtatacatgtaataatgagctctataaccactaagatctttttttttgtttttaaaagggtctgaaacattttgacaattacgtgttgagaactttgtaatcagtgttttgcttggtaaaatttatttgctaaaatgggtgacagtttattagagaaatattgcttagtagatttataaagttaacaacttgagcatcaaatgaagcattcttctccatccacaaaaccatgtttgagtgtgcgtctcgcttggcttgagccctttgaagaggttgtctacattcatatagagcgagctgtgggcatgcaatgtatgaaatgagggtaaccatgtcgtcctggttttcaaaggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgttagccatgagctattattttttctttttcaaaaaccagttccaggccgggcacagtggctcacgcctgtaaacccagcactgtaggaggccaaggcaggcggatcacgaggtcaggagtttgagaccagcctggccaacatggtgaaaccccatctctactaaaaatacaaaaattagctgggtgtggtggtgggtgcctgtaatcccagctacttgggaggctgaggcaggagaatcacttgaacccgggaagcagaggttgcagcgagtcaagattgcaccactgcactccagcctgggcgacagagcgagactccatcacaaaaaaaaaaaaaaaaaagaaccaaaaaaacaaaaccagctccacctgggtgcggtagctcatgcctgtaatcccagcactgtgtgaggtcgaggctggtggatcacctgacggtgttcgagaccagcctgggcaacatggcgaaacccctcctctactagaactacaaaaatgggcaaggtggcacatgcctgtaataccagctactcgggaggctgaggcaggagaattgcttgaaccggggaggtggaggttgcagtgagctgagatcatgccactgtgctccagtctgggcaacagagcaatactccatctcaagaaaaaaataaaaataccagctccttctctgcagtattatttttatcattgttattggatctatagtttcctagtacagtatataaatccatatgtttcagctaaagtatcaggaacacagctttggaatcaggtaggtctgaaggagtcctgctctgtagctgtgtgacctagggccagttaattaacataagtctcagttgtctcatcaataaaaaagtgatagcaataacctctataaggctgttgtgagattaaattagataatgtatataaagtagtgcctggatcatagtaaacactcaataaaattacccatcattaagtttacatagatcactcaacagaatcaataggaaggaattaaagaaatttcatctccttaaagtaggtactccgattactctgtctccattttatagacaaggaaactgaggctctgagcatgtaagtaatgtccacaggtaggagtggcagctatgggatttgaactgaagcagttgggctccagagaccatgcacttatccataaatatgctgcctcaaatagctaaagccagcattgatcggagtcatttcaggtgaatgtgtcttcccccagggttttgctttcagcaattgagagtgcacaccaataataaggcaagatgttatagggactccaatacaagggggaagttcttttgaagaaaataccccacctaatttgcagacataaactttagattctaaatggagtgatgagaattgctaaagaaagtcttcatggatgtcaacgagttttagtgtcaggatgttactgaattttgattctaggagattatttctcctaggattctaggtttagaaagaaaagaacaggcttggtgcggtggctcatgcctgtaatcccaatagtttgggaggccaaggcaggcacatcatcagaggtcaggagtttgagaccagcctggccaacatggtgaaaccctgtgtctactaaaaacacaaaaaaattagctgggcgtggtggcgggtgcctgtaatcctagctactcgggaggctgaggcaggagaatcacttgcacctgggaggtggaggttgcagtaagccaagatcatgccattgcactccagcctgggcaataagagtaaaactctgtctcaagaaacaataacaaaaaaacaaccaatatagactgagatccaatttttttttttttttttaaagacattctcactttgttgcccaggctggagtgtggtggcatgatctcatctcactgcaaccttcacctcccaaattcaagtgattctcctgccttggccttccgagtagctgggattacaggcgcatatcaccacacctaatttttgtatatttggtagagatgtttctccacgttggccaggctggtctcaaactcctgacctcaagttatccacctgcctcggcctcccaaagtgttgggattacaggtgtgagccactgcacctggcacccaaatgtgtttcattttttttggggggggtggatttttctgccttattttttattattatacttttagttctggggtacatgtgtacaacatgcaggtttgttacataggtatacatgtgccatgttggtttgctgcacccatcaacttgtcatttacattaggtatttctcctaatgctatccttcccttagccccccacccactgacaggccccggtgtgtgatgttccctgccctgtgtccatgtgttctcgttattcaactcccacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtcctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctccccacatatctcagagtttatgatgtcaatgggaagaaagaggatttcgggtgtagaagaggtacacagcaattcagggcaacataaaactgtgacaaaacaccaatttgtggggcaggatgcactgcaaaaagcatttaaactacagagattgtcggagaaagaatttctcccccttctgtactacactcttgaaaacaatttttttttttttttttttttttttttgagacaggggctcactctgcacccagcctggagtgcaatggtgcagtcatggctcactgcagcctcgacctctgaggctcaagcaatcctcccacctcagcctcctgagtagctgggactacaggtgcatgccaccatggctggctaattatttttgtttttgtatttttagtagggagggagtttcaccatgttggccaggcttgtcttaaactcctgacctcaggtgatctgcctgcccaccttggtctcccaaagtgctgggaatacaggcatgagctaccacgcccagcactaacatttttcaagactggcaatacattacttcagtgaagaacagaagatacagcaatacatacctgtggtaacagaccagtattctcacttccacacccatcagggttgctttccctgatctgatttttctgtctttgggtttgagttagaggtcaatattaggctccttcgtaagatgtctgtagtattatagatgtaagccctgctgcttcaaagtcccacggtaatagtggtttaaacaaaatgcaagtttctttctctcatataaaagacaacctttcttttcttactttttttttttttttttttgagacggagcctccctctgttgcccaggctggagtgcatggcgtgatcttggcttactgcaacctccacctcctgggttcaagcaatttttctgcctcagcctcctgagtagctgggattacaggtgcacgccaccatgcctggctaatttttttatttttagtacagacggggttttaccatgtttgtcaggctgttcttgaactcctgacctcgtgatccacccccacctcagcctcccaaaagtgctgggattatgggcatgagccaccactcctggcccttcctttctttaatatattataaatgtaaactctaaaatgcctctttagtctcgataatcctccatctctctgtatctctaccaccttagactgtttctgtggtctcatcgtttaggtctcaggtaggtgtcaccacaggaagccttctggagcccccaaatgaggtgtcaggtctacctattgtatactatagcacccgttcattctctttccttaaagtccacacaattccacgatgtctgctttccccactagacagttcactggttaagggcagaggcaggttcccagcatccttgcacggtgcccacctcacacggaggtgctcaggctcagggtttgtttgttactggtgctgttgttattcgtatgcagttcagcgacttaccaaaggtgtgccttatatatagagagagagttgccttacactagtcaatatcttctgttgtacccccacaatacctgtaggtttgatctgggccctgaaaagtggtatgattttgatacttttcgcacagatcctgccagctatcttacacagcctgatgaaaacctgaaaggataaaggagaaaatgcagcctaggcagaaaaacactggcagaatctgtgaaccacaattaagcttatttcaatcttttctgatgctttaataggcaggaatgtgtgtttccattgccagagcctttctccgtctggtgaggggaaagaggctcaaatttttaggcatggtaaaagctttaatttgttaaatgtaagtattaaaactatacaatttttaaataacagctttgtcgagatataattcacataccataaaacttttttttttttttttttttttgagacggagttttgctcgttacccaggctggggtgcagtggtgtgatcccggctcacttcaacctctgcctcctgggttcaagtaattctcctgcctcagcctttagagtagctgggattacaggtgcccaccaccacacccagctaattttttgtatttttagtagggacacggggtttcatcatgttggccaggctggtctcgaactcctgacctcaggtgatccacccatcttggcctcccaaagtgctgggattacaggtgtgagccactgagcccagccaaaatttaccgttattaaagtatataattaagtggattttcggtatattcacagaattatgcaaccatcaccaatgtctcattccagagcattttcatcacccccaaaataaaccacatctccactagcaataactgcgcatggcccctccctctctgtcctcagtctctggcaaccactcacctactttccgtgtctatggatttgcctattcagggcatttcatataaatggagctatacgatatgggacttttgtgtctagcttctttcacttaacatagtgttttcaaggtttatccatgttgtagtatgtctcagtacatcgttcctttttatggctgaatagtaacttccataaagcccattttgtttatctgatcatgaattgacagagatttgttttcacttttggactattacgaatagtgatgctatggacatttgtgtacaagtttttataaaaacatgttttcaattctctctgatatatatccaggagtggaattgctccactgggcatatggtaagtctacatttaactatttgaggaactgccaaactgttttccaaagtagttactccattttacattcccaccagcaatgttacgagggttccaatttttccacatctcatcaagccttgtgatggtctgcctttctgatgatggccttcctactgagtgtcaagttgttatctcattgcatttttttttttttttttgcatttccctgatggctaattttgttgagggtattttcatgtgcttattggacatctgcatgtcttatttggagtaatgtctgttcagattctttgcctataattaaatttggttgtctttttattgtttagttgtaagaattcctgatatatactggataggtgatttgcaagtattttctcccattctgtgggctttcatgtcactttcttgatagtgtcccttgaaaagcacagaagtttttaatttttatgaagtccagttgttttgttgttgttgttacttgtacttttagtgttatattagaaaccattgcctggtctatttattccagcaccacatgctaaaaagactattctttgcttcattggattatcatggaatctttgttgaaaaatcaactgattgtaggctgggcgtggtggctcacatctgaaatcccagcactttgggaggctgaggtgggagttgagcccaggagttcaagtttgccttgagccatgattacactccagggtgaactccagcctgggtgacagagtgagaccccgtctctaaatgtaaaacaaaacaaaaaaaagaaaatcagttgattagatttccagactctcagttctgttcatctatatgtctgtctctatgcctgaacaccctgagttgattagtgtagcttagtaagttttgacatagagaagtatgggtcctccaactttgttatttttcaagattgttttagctgttctgggtaccttatatttccatgtgaattttaggatttccatataaattttagaatagccaactgggattttgatagggattgcattgaatctgtttatcatttttggcaatcatgccatcttgtcttctaatccatgaagacagatgtatcttatttaggtctttaatttcttttgatgatgttttgtatttttcattgtacaagtcttagactttttgttcagtttattcctaagtattttgttcttttgatattattgtaaactgaagtgtttgcttaatttcattattggattcttcattattagtgtatagaaatacaatagatttgtgtatattgatcttgtatcctaaaacattgctgaacttgtttttcgtttctaatagtttattgtgaattcctgaagaatttttttttttttaatttgaggcagagtcttgctctgttgcccaggctggagtgcagtggtgtgatctcagctcattgcaagctccgcctcccgggttcatgccattctcctgtatcagcctcccaaatagctgggactacaggtgcctgccaccatgcctggctaacttcttgtatttttagtagagacggggtttcaccgtgttagccaagatggcctcggtctcctgacctcatgatctgcctgcctcagcctcccaaagtgctgggattacaggcgtgagctactgtgcctggccttctgaggaattttttgttttaaaattattgcaaaatatacataaaacaattttaaacattcaaaagtgtgtaattcaatgcattaaatacattcaaaatgttgtacaaccatcaccattatcagtttctagaacttttatcatcccaaacagaaaatctgtacccactaaacaataattcctcacttccaccactaacccctgatatcctccattctattttcagcctctataaatttgcctattctaggtacctcatataagtggaatcataacaatatttgtccttttgtgtctgcctcatttcacttagcttaatgttttcaactttccttcatacatacaatagcatgtatgagatcttactccttcttatgactgaataacattccatggtacctatgtaacacgttatctattcatctgttggtgacgtttgtggttttgcctccttttggctgttggaataatgttacaaaccaatggtgtacaagtatctgtttaagccccagatttcaattcttttggatctataccatggagtggaattgctggatcacataatacttcttttgttttgttttttgagatggagtctcactgtatcacccaggctagagtgcagtggtatgatctcggctcactgcaacctctgcctctgggttcaagcaattcttatgccttagcctcctgtgtagcttggattacaggcatgtgccaacatgactggctaatttttgtatttttagtagaaatggggttttaccatgttggccaggctggtctggaactcctggcctcaagtgatttgctgccttggcctcccaaagtgctgggattacaggcataagccactgtgcccaggctttttttttgagacagggtctcactttgtcatcacctaggctggagcactgtggtgtgaacatggctcactgcagccttgacctcctgggctcaagcaatcctcctgcattagctcccacaaagtagctgggactataggtgcataccaccatacctggataatttttgtattttttgtggagatggggttttgccatgttgtccaagctggtcttgaactcctgagctcaagtgatcttcccaccttggcccttaaagtgttaggattacaggtgtgagccactgtgcccagccttggatcatatagtacttctgtgattttgaggaactaccaaactgttttccatagtgacttctccgttttacattcccatcagccatgtacgaaggttccaatttcttttcatcctcaccaacacttttctgtcttgatttaaaaaattatactcatcatagtacaaatgaagtggtatctcattttttcattattgaataacagttttgctggatatagaaatcttggtttacagttctttctttcatcactttgaatatgtcatcccattgccctctggccttcatggtttctgataagaagtcagttgctaatcttattgagactccttacatgtgatgtaccaattttctttgctcctttaaagattctgtgtcttttaacggtttgactgatatgtctaagtgtgggtttttaaaaattttgtcctacttggagttcattgaggttcttagatacacaatttttaaaaaaatcaaatttgggaagttgttggctattttttttttaaatattgtttctgaccatttctcttccttctctccttttgagactcccattatgcatatgttggtatgcatgatagtatcccacaggtctctgagagtctggtttttttttttgagacagggttttgctctgttgcccaggctggagtgcagtggtgtaaacatggctcactgcaaccttgatgtcctgtgctcaattttcccatctcagcttcttgagtagctgagactacaggtgcatgccaccatgcctggctaaatttttaatttttttgtagacatggggtctcaccatgttgcccaggctggtttagaactcctgagctcaagcatcttcctgccttggcatcccaaagcactgggattacaggtgggagccacagtgcctggcctcattcttctttttctttctggttctcaggccagatactctcaattgagtcttcaagttttctgattcctttgctagttcaaatttgtcaagtccctctagtaaacgtctcactttagctattgtactttttaactctaacagttttattttttcataatttctcttatctatttgataactgttcatatactttaaattcttcaggcacaggttttttctttgaatatcaaaatattagctggtttaaaatctttgtctagtaagtccaatgtttggtcttcctaagcaatatttgctattgactccccccaccattatatgagccatattttcctgttttctttgactgttttgtatatttgttgttgttgttaaaaaccggacattttaagtagtatgacaattctggaaatcacattcttcctttcccagtgtttgttgtgctctatgtccagaagtcttgagaaatcaaagggtttcttgtcagaagatctcatgacagtgaaaagaataaaaggatggaggcaaaaattgacctaattttctggccataaacatagaaaaatacttcacaatggtctataaaaacgtaattataaagatcattttcatacagctaaggaagttaaaaaaaaaaaaacccaacctcctatttcttgaattgtagcaattaagtcttgtcctaagactcaagttcgaacgctagttctgtcttagactactacttgaataaatgatgtaatttctcagagcttgtttcctcatttgtaaaacggagatagtacttgctagcactgttgtgtgaaggagggaaatataggtgtgaaagtactttttaaaaagtaaagtgccatgctcagcgtatgcacatgagggtttgagttgtgggttatggagagagttgtcaggtgatttaaataaattcttatttaaacaaacttatttaaataagggctagaatatacctagaacgtttaacatggaaatatatttacaaatagaaaacactttataaaatttcatcttggagtatgtaaattctttctaaaagttgatttactttaaaaattttgtctgaataattcataagtcaaaacaattttttaaaagaggacacatcagaagtctctcatgcctgtccctttcacctgggttcccttgtcttgctctctgccacagttttgcttcctttcctgtcaatattctcttatccaaatatgagaaaatatgactatgtaccctctgagttttatttgcaatatcattgtacaataaattcttatcacccttttcttgctcatcagtggccaagataataaattggtcagttacacagcaaatagcaggcctaggactcaagtccaggcttgctagtaccaaggtaccacatctactttgttttgctacgttgtgaactttctgtgaaatagggtaaatctttcagaaaactgtgtatacagctgtgttcttaaaaatatctgcctttcagattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataaaaccaagtattcattttttattttttgccaaatcagagaacttactatctctctattgcattgctgaaaatcatggttactttgcttttctttcttactgttagtaagaattctcagctttcttggtggtctgagagcttattttaaaaatgctttggagccatacaactaaaagtttcttgggtagggcattttaaagatgttttctacctgataggcacattaaaatttatttatttattttgccaggaatactgtgttgagaggcacactaaaattggagaaccggtggtttagtttagaatatgactcatttccctctacttgaaatgtggagttaggaacacttatttctttagttctcatttgtcctgtttggtcttgggtgaccacagcacaaggacccttttcttttctgttatcaggtgcagtgcacagcctcagagttaagcagtttttattttgtagctacagatttcagaattgtgttgctgggtagacgactatcttgcaactttaattgcctagttagctttcaactatatgagatccaatttccctaatatttgattaaggtgaagcttttttccctctatcagctcctacatttgtgtgtgtgcactcatgagcaataatcaggctgaataaacgagtaggacagaattcatactcacttgtacatggcagtgttcttaaattcaccaacactgtaccatagtagaagtcgtgtaaactggcaatagcacattttgaaatcctgtattattgatttttaggaaaaagcagcagagatttcaagcatgtattaaagttcgattagtattgtctattcaaactcaaaatgttattaggtactttctagttaaaagggtgaaactggtttatgtaccgaaagttgaggccttttcatcacaaatgctaatgagtacaaacactagctaagaactatggggaattaaataattatgaagtaaatcaggaccaaagcacatttcttctaataaccaaaccactgttttccctttctggtcttttgacatagaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatctaccaagtgaagtgaagtatcatatagaatatacaagtcttcattgcaatgacctttactaaggcctttgagctatgaaggaaattttatgaagttttttagctagcccagctgcctttcctcctctcttcccctcaaaaggcagggagagaggcgagtggataggcagccatgcaggcagtaaggagatcaatcaatcaacccagagcaaggctcaaatccacactactgttctgaagaaacagaagccatacatgatccttaaagtggttgctctggcatactaatacaactttggcttttacccttttttctgttcccatagtgatcaagcactaatgtcattcactagtgaaaacttcactggaaaacaaactaaaccaatttaggggaaatgaaattatagatgccacatggagatagttaagaaatgcatagcaccctctgccacacacacacacacaccatgcccatcccactctactgagtaatctgaggaaactccccaggatattcagatatagaaagccacacaaaccctcctgctcccacagctccctgctacaagcaccactgagaattcttggatagtataagctttgttttatatagttgtaagtcttgaagacacaaaatatatatgggttgaatgcctcttgattctcattatgtctaaaatattcccataggccaaggccaatctgaatacagtatgtaggaagtcctacataaaaatgcataccagcaaagatggagaaaatgcaaattaaaacagtgattttttttttttttttttttttttttgagatggagttttgcttttgttgcccgggctagagtgcaatggtgtggtcttggctcaccgcaacctccatctcctgggttcaagcgattctcctaccttggcctcccaagtatctgggattacaggtgcccgccaggcgcctgccaccatgtatggctaatttttgtatttttagtggagacggggtttcaccatgttgggcaggctggtttcaaactcctgatctcaagtgatccgcccacctcggcctcccaaagtgttgggattacaggcgtgagccactacgcccagccaacaatgacacttttttctaagtcataaatcccagacaatgccattttaataaaatacatccaaatgaccctggaaaggaacagaaaatttaagtaatttctaaaatacataaagtaaaattagggctgggcaccatggctcacagctgtaatcccagcattttgggaggcaaaagccagaggaatgcttgagcacaggagtttgagaccagcctaggcaatatagtgagaccttgtttctaccttccccctacccccgccaaaaaaaaaaaaaaagggaaattagctgggcctggtgacatgtgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaaaagaaggaaaacaagacctaactctagcactgtcccctggcgagaattcactgtggaatgctctcagaaaggagagcttttactactcagctcagagtcacagacaccaggagaaaaaaggtgggaatctagaaagcttatcaccttcaagtaggaaaagaaccctacatcccaatgtcccaaagacaagtcagacccacatccaacttggcttcccattatgagaggcaggcaaccaaagacaggcaaacaaggaaggtcaaaacacaaaagcaaacagatcaagaatcacacagcatctgagaaaaaccaaggccataaaagggagacaccattcctaacagaacactgtagaaagcagagaaaattatagcaaacataagacttaaatataagtataaatacccccagtagattgctgtttaatggagctccttgacattctttcaagaagtgattagatctctcagaagtataaaagactgtcaaacaatgaaataaaatagaacataagtgctaattagtgtgctgaaaaattgatccaggggcttgtccagaacgtactgaaaaagacaaagaattaagagcataagaaaaaatcgggatacatggaagatagatacagaattccgtacatgcagtaacaacaattgcacaggagaacagactggaggaaacatacaaagaaataaaatacataacccagagataaaggaagactttgtcttctttcagaacaggtaggataaagagaactccaaaactactcagaaagaaaccaaacctgaaaatagattgcctgagaaaagggttgagaattggactagcatcagacttctcaattggatactacaccacattagaactctatcttcaaagttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaaggaaaaggaaataacttgatttaaataatttttgatacacaatgtaaaacaaggtattctggaacaaaaatcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggtatggtggctcacgcctataatcccagcactttgggaggccaagactggaggatcacttgatcctaggagtttgagaccagcctaggcaacatagtaagaccctatctatctcttaagaaaaaaattagctgggcatagtggcacacacctgtagtcccaactactcaggaggctgaggtgggaggatcacttgagcccaggatgttgaggctgcagtgagccatgatcatgccactgcactccagcttgggcaacagagggagattgtgtcaaaaaaaaaaaaaaaattcagttcccatgtcatagcaacacttcaagtgctcattagctgccatattggatggctctgatatagaacatttccagcattacagaaagttctattggccagcattgttctagacattgagaaacattattttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaa

SEQ ID NO: 2480 - DNA, 173227 bp, Homo sapiens
cctcggcgctcttcatctaccgcactatggtgccggaggaggtggaggtggagattggtgagcctcgacgcgccgctcccttccccgggcttccctcctgcccgtcccggcctctccggcgggcgccggggctgctagagcctgcccatcgtccggccccggcctcaggtgctgtccacaaacgctgccgcccgccacgtgcaggccccgggcgaacccagcaatcacagccgtccctgccctcctgggcccacagcccacttgaaagtcaggccttgattgaaaaatcacagcaaacactgacttagcccgcaccccgtgccaggtgcggttccaacgcttgtatcaactccttaaccctacgaggcgggtgtatcctcatccctattttacagatgagcaaactggcacggagggggttaagtaacctgcccaaggcccacggggcgtcaagatccactgtgcaataatccgaacggctgggtagagccatgcccaggtgtggcagggacccaggtcactgtcactctccttgacggtcgcagcctctcacggagggtccgaagagcacccctttctacttctggaggctccttatatcctaaaaagtaaaataaggctaggacaaagtttaaaaactacagtagactttaaatgtttatgttgaacaaattagcatcgcaaatacaaaaagacagtgaccagggtcccagaaccctctgtggaggcggatccccagccccacctactctctgataggccagggacactgagagggcagggaggggccagcacaggtgagaggaggaggcaggacaactcgcttcagaaacagctagaaggagactgggacctcgaaagccgcctcctcgcaggagcaccagctggagcacagctaccgggacctcctgcctggctgtccagtctcctgggctacttttccagccccttaaggacttggggatcccttgcagggcctctcactgggttcgggtggcagggccggcagacctttgattttttttttaaaggtaccaggcagattcatttattgtattctattttttaacttttttttttttttttttgagatagggtctcactttgtcacccaggctggagtgcagtggtgcgatcttgactcactgcaacctctgcctccagggctcaagtgattctcccacctcagcttcctgagtagctgggactacaggtatgcgtcaccatgcctggctaatttttatatttttggtagagacaggtttcaccatgttgcccagggtggtctcaaactactgaggtcaagtgatcctcccgcctcggcctcccaaagtgctgggattccaggtgttagccatctggcacctggccacttcttttttttttttttgagacagagtctagctctgtcgccaaggctggagtgcagtggtgcaatctcggctcactgcaacctccacctccctggttcaagcaattctcctgactcagcctcccaagtagctgggattacaggcacccatcaccatgcctggctgatttttgtatttctagtagagacagggtttcaccatgttggccgggctgctcttgaactcctgacctaaagtgatctgcccacctcggcctcccgaagtgctgggattacaggtgtgaaccatcgcgcttggccaccttcatttattttaaatattcattatttgcttgcacaaaataaaacgccttcatcataaatccaaaaccataaataaacaacaataacaaatccctagtgccatctggagagaggaccacgtgatcacgttttggaatttaaccttccagcctattatttttttctccctggcagacctttggacctgaacattagattataactggacctcggatgtaggcactttcattggcaccaagtgaaattatggaaaccaaaaacacactcgcaggattgaccgtttaacatgtaccaccactgcaggaactcgggtttcgtttacattaaaaaaaaattacaagaccctaaaacaatggatgtgacttggatttcttgcagaagccctccaagggcctctgttaacggtggggtggctgttgtctgctgtgtttactagcacgtgtttagcccaaatgtcatccagtgtggaagcagagttcagtctcacctcagagggtccccctggttaattcctggaccctccaaagggagctcagaactcccccaccccgccccctgacccgtttctgggctgtctctgtccctggtcttcccttccattcccgtcccttctccactatcacctcatggtgaaaagctgatggattcctcgccgaagatgctgtctctggaaactctcaaagctgccgattctggaggtgccagatggcgtcgggtgttgggggttctggccaggtggggagaagagacctcatccccaactccacacgttgtcactcactctctgcttgttaaacctacaggctcatataacccttgaacagtttccctagattatttttgggggacaggtggttctggtctgttcagaggacctgcagagagcccagcgtgtcctttgtttccttttttttcctctttctgccccccttccccggtcaagatttctctctgctcctggttaaaaatgataggaatggagacaagcagatactggggcaggtggtggtaataaaggcgaggtgtccttccgggcagcagatacccaagatactgatgcagtaggtacatgtgttccttctggaaaaaacaaaacggaatcgtactgtacatatcatttagtaacttccttacatttaaagaaattacacaaatactgccataacacatgttctcttatgaattcacagaacatagaattacatataaaaagaaaaagcaacgcttctccatcccttaagccccagtcctgctcttattcctaggggtaaccactattattagtttggtgtgtttctggttggctcttttgtcaaattatcagtcaatcaatcagccaatcacctaccaaccgactgatctgtctccctaccttcctatgcatctatctatactttatctatctatctatctatctatctatctatctatacatacctctatctatacatctatttatctatctcctgtctacctacctacctatacatctatctctctctattatctatctaccaactgaccaatctgtgtgtctatctacctatcattcacctatcatctatccatctatcaattatctaccaatctacctacctacctatacatctatctatctctgtctatacatctatctacctacctacctatacatctatctctatctatatatctatctacctacctacctatacatctatctgtctgtctcctgtctacctacctaattacctatacatctatccctctattatctacgtgccaactgaccaatctgtgtgtctgtctacctatcacttacctatcatctatctatccatctatcaattatctaccaatttatctacctacctatacatctatctctgtctatacatctatctacacatctgtttatctgtctatacatctatctatacatctatctatctatacatctgtctgtctatctatctatacatctatctcctgtctacctacctacctatacatctatctctctctatctatacatctatctatctatgtacctacctacatgtctgtttatctatctgtctgtctgtctatctctgtctgtctaggcataaggtcagggctgttgagatcaattaatcagcctacctacctacctacctacctacctgcttgtcatctatatctgtctatccttgttccatctacagtctatatttctctctataatgataatatatggatatatagagttcctaaaactataaatatcatactatatatacatattattttgtgacttctccccccaccacatgttttggttattttttcatgccaattcctatagttctacctaacttgatagatttaaatacatagatgtaccacattctactcatccattctctaattaatggacacttagcttttcagagtattcattctacaaacaatggaataatgtctgtctatccttgcatactttgtgtatttctggaggatagatttataaaaatgaaatgcatctgtaacaagtgtggtcttttacaatttgagtgggtcctgttggtccacagccagtggtggtggatgaggcacctgtttcccaatggcctcctgacatttgatattggccattttttagatttttggcaattccatagaaaaaagtagttgtactcccttactctaatttatgtaaatgttagtgtagttgagcctctttttttcccttcagttttttcttttcttttcttttttctttttttttttttttgagacagagcctcactttgtctcccaggctggagtgcagtggtgtgatctcggctcactgcaacctccgcctcttgggctcaagtgattctcctgcatcagcctcccaagtagctgggattacaggcgcgcaccaccacacccagctaatttttttgtatttttaatagagacgaggtttcaccatgttgaccaggctggtctcgagctcccgatctcaagtgatccacccacctcggccttccaaagtgctgggattacaggcatgagccactgcgcctggcctccttcagtttttaaattgtggtaacatacacacggcctgcaatttacatcttaaccattttgaaatgtacagtttagggtgttaaatacgttcatagtgttgtgcacccaggagcctctttcttatgcttcttggttatttgtatttcttctgggctggtggtaactctgatcatttctgtatccttcgtctcttggcagaatttgcacaaacctccttggctgtcactgaaagctggctccatccagtaaggaatactgctgtaccactgtaacataacgagtctcctgtgggccacataccaaccccttggctccacagaaagcaaagatatcaggtgtttcatgcagtgaacaattacgtttaatattttcttcccatttatgtggccataaagatgagatacctgtcctgtctgaagagggagaagaggaagaagagacttattctcaaaaagtggagtccgtggataaagtgcgaggtgtggagttgggaggggtcatgggagggtggaactgagaaagcccccccgcagcgggagtagggtgctgcctgccgtgccacaatcagttgtactttcactgggtatgaaccacaaagagaaagtgctgggtcatgaatagacggatgtagtagtttcccacggctgctgtcacaagtgaccacagactgggtggctgaaaacaacacagatgtattctctcacaactctggaggccggaactccaaaatcaaggtgctggcagggctgcgctccctctgcaggaccaaggggaggatccttcctagcctcctcactgcagtctgggggtcagggtgtccttggcctgcagcatcatcactccagtctctacatccatcgtcacatggccttgtcccctctgtatctttcttctccgtgtgtcctctctcctcctcctcctcctcctcctcctttttttttgagacagggtctcgctcttgtcacccaagctggagtgtaatggcgtgatctcagctcactgcaacctccgcctcccaggttcaagtgattctcctgcctcagcctcccaagtagctgcgatctcaggcgcccaccaccacgcccagctaatttttgtattttcagtagagacggggtttcaccatgttggccaggctggtcttgaactcccgtcctcaggtgatccgccctcctcggcctcccaaagtgctgggattacaggcgtgagccaccatacccggccgtcctctctccctcttatacaggcaccagtcacattggattttgggcccactctaatccatatcacctcatctttactaattacatctgcaaagaccctgtttccaaatgaggtcacagctttaggacatgcattgtgggggacactcttcaaccgagtgtagtatgtaacatacaaacactcatgcaggcgatgtctcagccagctcagcaaacacatgctttgtactttgttttgtaggtgggcttcccactgtgcaagctacagatgccattttcttaggagaatcttcaaggcacagaacttttcatgtatttatttgtttttgagacaggacctcactctgttgcccaggctggagtggtgctgtcatagctcactttagcctctaacttctaggctcaagcaatcctcctgactcaggctcctgaggagctgggactgtagaggtgcaccaacatgcctggatgacattttgattttttgtagagatggggtctcactatgttgcccaggctggtcttgaagtcctgggctcaggcagttctcccacctcagccttccaaagtgttgggattacaggcatgagccactgcttctggccaagcatttatttttaaccaaattgtaatcccctcaagtagcaaagactgtggagagggaactacaagttagaaataaaagatggtttgagtaagccttgtttaaagtgggtttttggtttttttggagacgaagtgttgctctgtcacccaggctggagtgcaatggtgcgatctcggcttgctgcaacctcctcctcctgggttcaagcgattctcctgcctcagcctcctgagtagctgggactgcaggcacacgccacctcatccagctaatttttttttttttgagacagaatcttgctaatttttgtatttttagtagagacggggtttcaccatgttggccaggctggtctcaaactcctgacctcaggtgatccacccacctcggcctcccaaagtgttgggattacaggcgtgagccaccacgcccggcctaaagtgggttttgataaggcagatggtagttctggatgccacagcaatgtctgctgaggtatcctaggaaggcactctcggcttcggagcccagtacatccatgaagaggacaggtttgggaaggaagagctgtttaggtgggaaggtcggggaagtcctttctcataaagtaaattaacattattatatattttcttcttttctttttatggtggtaaaatggatgtcacttttaccatttttaccatttctatgtggcattaagtacattcataagtgtattttcctttttaaagatggggccttgctctgtggcccaggctggagtgctgtggtgtgatcatagtgccctgtagccttgaactcttgggctcaagcgatcctcctgcctcagccttccaagtagctgggactacagatgtgtgccaccatgcctggctaaggtttttttttttttttttaacttaaatttaattttttgggctgttgtggtggctcacgcctataatcccaggacttagggaggccaaggcaggaggatcacttgaggtcaggagttcgagactagcccagccaacatgatgaaacccatctctactaaaaacacaaaaattagccaggtagccaggcatggtggcatgtacctgtaatcccagctactcgggaggctgaggcaggagaattgcttgaactcgggaggcggaggttgcagtgagccaagatcgtgacactgcactccagcctgggtgacacagtgagatttgtctcaaaaaaaaatttttttttaaaattttttttgtagagatgaggtttcactacattgcccaggctggtctcaaactcctggcctcaaatgatcttccaccctgtagctgggactataggcggcaccatcactcctggataacattttgattttttgtagagattagagactactctaatgctgttagggaattagcaatggactacaggctatttatggcacggcacctgctcgtaagtgtgattttttttttttttttttttttactgtagtctattgctagttctctaataatgttggtactgctgtctatagactattcccttgccaaccacggtgccaatgcccttacccgtgctgtcatttagtcctccagaatttggctggtagatgttactgtcccattttatggatgcaaaaactaatagcagagaggattcagacccctgacattgagttgatgccaaagccacagtgactttgcacagtgcctttcaaagtaagagctgagggaaagctcccagggaaagctcctttctctaatcaccggccttgttggatgttctgagggctcagacttggtgtctgctgaggtttctgaatctgtatcaatcagagtggacttgagacaggtgcgtcatttcatttagactgtttttcttcttgtccctcacaagttttgcatctcatagtgaaaaaggagtaaatgctaacatgctagctgtaattcttttttttttttttttttgagatggagtctcgctctgccacccaggctgcagtggcacaatcttggctcattgcaacctctacctcctggcctcaagcgattctcctgcctcagcctcccgagtagctgcgattacaggcatgcatcaccatgtccggctaatttttgtatttttagtagagacagggtgttgccatgctggccaggctggtctcaaactcctgacatcaagtgatccacccacatcaacttcccaaagtgctgggattataggcatgagccactgcgcctggactgtaattcttgtctttatgataaactcccttttaagtaaaaaacctcagagaagtcacacggtcacagggtggacactgtacctgagagaacgcagacacaaacatgtaaaatttctgatggacaccctgtcaaaaacgaaacacaattcttgtcaattacaatgtgagtcaaggccacaatttgattgattggaacagaaggtatgcacagctatttgataactcgccttttgaatgaaatgtactggtgcacaaaatgcagggctgctcttgatggtaggaaacctaattttctgattattttctcttaaactgattgctgttttgcagctaagcgtgtgtcactgagaaccgaatctctaggccaacctctaaacagagaggatgaagaaatggacaaagagatttcagaaaaactcccttccaaagtaagcatggctctttgtccttgttggtggggtaatggggacccttgatgccctctaggattcagggtaactgacatagccccatccaagggatttatcatgttggaatggaaattataggatcccaaggccaccctcagattcagtgattggctggaaggactcacaggacccagaaaatctgttatattcatagttatagtttattacagggaaaggatgcaaattagactcagcaaaaaaaggaaaaaacgtgcacaggacagagaccagcagaaaataggcacaagcttccatctgttccctcccaatggagtttcatggatagcacttaattctcctggtagctatgagtgacaacatgcatgaagtattgccaaccagagaggctcacctgagccttgctgtctggggtttttaatggggatcagtcacacaggcatggagcatccacgtggctgaccttagttactcagctccccttcatctccagccctcaccaccaccctagaggttgaactgatcctgtatgactggggccccagcaaacaaaaacaggcattcaccaaactcgcattgttagcatacaccttcaggcatggcccaaggctacaggtacacaaagactcccatattaggaagggtattccaaaagcttggaagttgtcaccctaagagccgaaggccggttctgaagacgtttggcatgtgtggggtttggacaacacagacctgctaaatgaaccctgttctgtgaaaaccccaaggttggagtttaaggctaggatgtaagcattcagcctggcctatgcttaccaaaatcgtgcttcattgcttcataagtacgtcccatctgcaaaacaaaattcaagctccatctggacctttgccaggtcagtttgtttaggtgttgctgtactggttggtcaatagaggagtcaggctgacagctcagagtctgggtgcatttagctcctgtgtttggctggtacccactgtgtggctgtggctacattgtcagaacatgagaccagccattgtgttgagaggagagcttaggtgtacttgaatattaggttctttaggtgaatggatgtatcacaagaatgaatggtttttgttccccatgtttcagagaactgcgaagcacatcatggaaaagatgcatctccacatgctctgtacccctcttcccgaggagttcctggaccaaaacgtggtgtttttcctcagaaataccaaaggtacatttctggcacgtgtgtgtgtatgtgtgttgagggggtgtggttgtgcatgcacttgttcactctcattctgttgtctttttatggttatctttcacctatgccaagctctctttcttttccatactgtactgggttcttacgtagtcttctcaaagctaatttccagtaaagaagtgttagagataaagaaatgtattcagccagtgatagtgcatgtctgcacatatttggagaaggtgtgaagactgaaacttgtgaaataatggcttcagtgggcatatttcttgtgtctcttttgtttcccagttagatcaagggaagagtccaagtaacctttaaaatgtttaccatggtgattgatttttggtcaggtagagcaaatacatatcaaataaaaccttgtttgttggaagggtagatattaccaagtaggtcttttcaaacaacccatgactcaaaatatgctttggcaatgaattgaggaagacttgctggggagtgaagacaggcaaagcccatgcccaagccagcttggatggttgtaacaaattgccataggctggggggcttcaccaacaaacatctatttctcacagctctggaggctgggaagtccaaatcaaggtgctggcagatctggcatctggtgagggccacttcctggttcacagatggcaccttctcctatcctcccatggtggagagcagagagagagagagcaagctctcctgtctcttcctatagggacaccaatccaatcgtgagactccaccctcatgacctaatcacctaccaaaggccccaccttctaataccttcaccttggggatttaagcttcaacatgtggattttggggtcattcagtccatagcagcaaagaatccagccaacatttctagacaacccaaataatttctgattttgtccagcgttagatactccaaccagatcagcaaatgtgtgcagctcttgtgcactgttcatactaatccacgaaccacagtgcattggtatccatttcagcttctcatgggccctcagatttgtttaaacacaaataggggatattctgaatctgtaaccagaacattccttgtagcagcttgggaagaaggagaagattcctgttctcttggaaatgttaactgttggctgctctctcccactgaccttacattctacacctgttcttctttagaggcaatctctgaagctaccgacatgaaggaagctatggaaattatgccagaaacactggagtatggaattataaacgctaatgtgctccattttctgaagaatattatatgtcaggtaaacatggagaaaggaagaaattctagtatttctaaagttgaggtcatgtggtttgtttattccacaaataggtagcgggcagctcttctgtctcaggtgctgttatgggcactgaggtgctgagaccagctcggttggggagaccctaacccagcggcgctagagaaattaaagacacacacacagaaatataaaggtgtgaagtgggaaatcaggtgtctcacagccttcagagctgagagccgcaaacagagatttacccacatatttattaacagcaaaccagtcattagcattgtttctatagatattaaattaactaaaagtatcccttatgggaaacgaagggatgggccgaattaaagaaataggtgggctagttaactgcagcaggagcatgtccttaaggcataaatcgctcatgctattgcctgtggcttaagaatggctttcagcggttttccaccctgggcgggccaggtgttccttgccctcattcccgtaaacccacaaccttccagcttgggcgttggggccattatggacatgttaccatgctgcagagattttatttatggccagttttggggccagtttgtggccagattttggggtcttgctcccaacactgagggtcaagcagtggacaggacaggcaatggccctgctctccaggagcttatgtaggggaaagacatggcacacaagcacatctatgagaaaataccgacaagtggcatgaggaaaataaaccctgatatgagacagaaataggcatgtgcactgtgtgtgtgcagagggcatggtgaggaatggccttgctgaggatgtgatgtctaagctttcttttttatttttattgtttttcgagacagggtctctccgccatccagtctggagtgcagtggcccaatcacggctcactgcagcctcaactctcaagtgatccttctgcctcagcctcctgagtggctgggattacaggcatacaccaccatgcctggctcatttttgtacttattgtagagacagggtctcaccatgttgcctaggctggtctccaactcctgggctcaaacaatctgcccgccttggcctcccaaagtgctgtgattacaggcatgagccaccatgcttggcctgagctttatagaccaaaaaaatgaaaaactcatcagcaggcctttttcatgaatgataagttattagggaaatgcactagggaaggaaggaagaggtgatattgaactgagacccaaatgaggccaaggcatcagacatgataggatgtggaggaagagcatgctgggcagagagaacagcaggtgcaaaggccctgaggtagaagcagcctcagcttggcccagtagcaggaggatggccactgtggctggagggagggctggaaatgaaggcaggtttaagcaggggaacaacaggatctggtttgcattttacctctggctattgtgggaaaacatattgctggggtggaggggaaggaaagaccaaatagaaagccatggaagagcccaggtggagggctgtattagtccattttcatgctgctgtagggaactgcccataatttataaaggaaagaggctaaattgagtcacagttctgcatggctgtggaggcctcaggaaacttaaaatcatggtggaaggggaagcaaacacatccttcttcatatgacggcaggaaggagaagtgctgagcaaagagggaaaagccgcttataaaaccatcagatctcatgagaactcactcactatcatgagaacagtggcatgggggtaacctcccccatcattcaattacctcccaccaggtctctcccatgacacgtggggattatgggaactacaattaaagatgagatttgggtggggacacggccaaaccacatcaagggtgatggttatttaggctccaatcaggggagggagggagaagcagacagtgtgaggaatgccttgaggatcaggccatgggacttgctaatgaccgggatctggaggctttgaagagtatcacaagaatagagagtaccaagaatgactcttggtcccagcactttaggagggtgaggcgggaggatcgcttgaggctaggagtttgagaacagcctgggcgatatagcaaggccccatctctaaaaaaaaatttaaaaaagaatgactcttaggatttgggcctgagaaactgggaggatggtgaagtcattactgagatggaggatggggagaaacagatatggagggaaactcaagtgttgtattttgcattctagacgggaaggttgcagagtatggtggtcatgccactgcactacagcctgggtgacagagagatattccatctctaaaaaaaaaaaaaagaaaaataaattaagataacatcaaaacatgatgtataatgttaagcacaggtggcctcttagacattcaaatcaagacgtgaagcaggatgtatgaatctggagctctgcggggaactcagggcatccgtctagcaaatattcattgagcacctactgtatttcatagcaatgaacaactgagacaaggtctctgcctcgtggagctttcattctagacaggaagatgtacattaaccaagatcaatgagaaaatatatagtgtgttagacagcaacaagagttagggagaaaaatgaagccagataggaaagaaaaaggaaacaagggggagagggaaagttgataggtggaaaggtggggcttttgcaattttagatagggtggccaggaagacttcactgagaagatttggacaaaaaagtccaaaccaacacaatatcctcttttgcttggactatcgcaggagcctccaaaaagatccctcagtttctgttcttaccctctacgctgccttctccacatgccaaccagagtgatgctttaaaacatgggcatcatcagcacagagatggtgtaaaaccaagggactgggtggaacaaccaagggagggagtagagatggaagagatgaggggagaggaaagttaggacgtgggtgatccagaagccaagagaagacaatgcttcactgaagaagggaggggcccgccgtgccacttgctgctggaagtcaagaaggcacaggcaaagaagagctggagggcttggccctgggtgacttccatgtgagcagttctggggatgggagcagacgaggtctcacggagtacaagtcatcctgtgagttaggctgtggggccctccccactgagctgcctgcacacaagggactttctacctgaagacaacctccttcatcgggatgatgtctttttctagtgtgactttggaggactcaagaacattggctaccttcttatttatttatttatttttatttacttatttttgagacagcgtctcattctgccacctaggctggagtgcagtggcgcgagcatggctcactgcagccttaacctcccaggcttaaacgatcctcccacctcagcctcctgagtagctgggaggattactaaaaattagccaggtgcacgccacaatgcctggatgatttttgtattttttttttaaagacggtgtctcagtatgttgccaaggctggtctcaaactcctgggctcaagtgatctgccctcctcggcctcccaaaatgttgggattgcaggcatgagccaccatatctggccacactggctaccttcttatgcaaactgaacttttcattctaaaataacaaaataacatcaaccccatctctaccaaaaagaaaaagaaaaatctgctgggcatggctgtgggtgtctgtagtcccagctactctggaggctgaagtgggaggatcgcttgaacccaggagtttaaggttgcagtgcatggtggtcatgccactgtactacagcctgggtgacagagagatactccatctctaaaaaaaaaaaatgaaaaataaataagatgacatcaaaacatgatgtataattaattcttagtggttatatgcattatgacaaccagtcatgtctaaaggacacagggctcaacttgaagaggctcatgccagccacagatgggatattttgaccttcagtaaggataaaattgcagtgggttgaagcatagaaaatatattcaaatacagccaggcgcagtgactcgtgcctgtaatcccagcactttgggaggccaaggtggatggatcacctgaggtcaggagttcgagaccagcctgatcaatatggcgaaacctccatctctactaaaattacaaaaattagctgggcatggtggcatgcacctgtagtcccagctacttgggaggctgagggaggagaattgcttgaacccaggaggtggaggttgcagtgagctgaggtcatgtcactgcactccagcctgggtgacagaaagagactccatctcaaaaaaaaaagaaaaaaaatatatatgttcaaatgcatgagttaaaaacatttttttaagagacacagttcttactctattgctcaggctatagtgcagtggcacaatcacatctcactgcagcctcaaactcccaggttcaagtgatcctcccatctcagcctccggagtagctgggtctataggtgcacaccactaagactgtctcatttttttttttttgaggcggagtctcactgtgtcgcccagtctggagtgtagtagtgcgatctcagctcactgcaacctctgcctcccgggttcatgccattctcctgcctcagcctcccgagtagctgggactagagagaggcacccgccaccacacctggctaattttttgtatttttagtagagatgggttttcaccatgttagccaggatggtctcgatctcctgacctcgcgattcacccgcctcggcttcccaaagtgctgggattacaggtgtgagccaccgtgcccggcctaatttttttcttttaattgtagagatggggtctccctatgttgccccggctgttctcgaactcctgggctcaagagattttcccgccttggcctctcaaagtgctggattacaggcataagctaccatgcccagcttttcaaatccatgaatttataatgatctttaaaagtcctgatgggtcatttctggaggatgataggggaccactgtactatttcaaaaattgggcaaataaagaggagtcaagcatttatgttgccttccccatatgaaatgtacgggatcatctagcagtagctgtgagaggcgtctttatatcagcatctcagctaataaacagacattttagaacatttcaattttggaacccccacttgattaatggacctgggggtgggggagagagagagagagagaaacaaaaccaaaaccaagaatttgattcctgatggaagatacaccctggtcaagtctctggtcccagctgccaatttgcaggaaatacacatcacagaggaacttcaactgcacagtgagtgtgtagtcagcaaaatttggattgggcagctctacaaatccaacattctgggttcttcagtatgttgcaggaaatacatatagattcaaagagtcataaaaagatgtatcaaaattttaagaaatatagacaaaactaaaaaacaaaaacaaaactcagccaaccaaccaaccaacttaatcaacccacaggcatttatagatcactttttatgtgggctgggggctaagttgtttcgtaattgtattcaggtgacttcataaatgcatgcttctctctctagctacattttgaagaaactatgtcctcaagaacttaattttcaagaacaagatggtcctgagctgatggtttaacacagtttcttacctccctgtgccagtttcccctccctccctccctcctttctctctctctctctctctctctctctttctttctgagacagggtcttgctctatcgcccaggttggagtgcagtggtgcgatctcggctccctgcaaccgccgcctcctggttcaagcaattctcatgcctcagcctcccgagtagcttggaccacaggtgtgcaccaccacacccagctgatttttgtatttttagtagagatggggtttcaccatgttggccaggctggtctcgaactcctgacctcaagtgatccaccagcctcggcctcccaaagtgctgggattacaggcatgagccaccgcagccagctccctgtgccacagtttgtaacttctcagttactggtggtatacagaaataacagcactgtttttggggcagttgtgtcaggcctggttaaaattgatgcccttggatcactttaagtcaaatgtaatctctctgtctttaggtctgtgctccggtttgagtggttttcactttgcatatttgtatctcaatataaaagaatattcaggctgggtgcagtggctcacgcctgtaatcccagcactttgggaggccgggggtggatcatgaggtcaggagatcgagactagcctggccaacatggtgaatccccatctctactaaaaatacaaaaattagctgggtgtgctggtgtgtgcctgtaatcccagccacttgggaggctgaggcaggagaatcgcttgcactggtgaggtggaggttgcagtgagccaagtgcacagcactccagcctggtgacagagtgagactctgtctcaaaaaaaaaaaaaaaaaaaagaatattcaaaaccagaggcaatttgaataaagaatattcaaaaccagaggcaatttgaatacatgaattattgaaaatgacttcatatgatgtatttcataaaattggcatttcaggtttttttgccagcattgtccttcaatcagcacaggacgagtacaaccgtgggagtcacatctggagaagtctctaattcctctgagcatgaatcagacctgccgcccatgcctggggaggcagtagaatatcacagtattcaattaatacgggatgaatttttaatgaacgtgcagaaatttgcaagtaatattcaaagaaccatgcagcaacttgaaggtaaggtttcattttcctcctttttagttaagaatgattaatttactgtagttgggattacaggtgcatgccaccatgcctggctaacttttggaacatttttgtttgtttgttttgtggagacggggtctcactttgtcgctcaggctggcaaaaatcattttagcacaggattttttgttttgagacagagcctcactctgttgcccaggctggagtgcagtggtgagatctcggttcactgcaacctccgccccctgggttcaagggattctcctgcctcagccccccgagtagctgggactacaggtgtgcaccaccacacctagctaatttttgtatttttaatagagacggggttttaccatgttggccaggctggtcttaaactcctgacttcaagtgatccacctaccttggcctctcagagtgctggggttacaggtgtgagccactgtgcccagcctagcacaggatttttgaatacatttttcttcattgttttctagtagtcaacatccagtgatgagaaactgaatgttcttctaatttttctcccctccccctttacgtaagcttttaagagcatctggttatccctagtgttttggtgttaggatgatgggcctttgtgtggaattttttccattgattttttaaacactcagtgggtgttttcagtccaaagactgaaaaatcatcttgacgttttcctccactatttgttttctcttgctgaaattcctgctggatggatgtctagagattctatttcttatcttttctcttgtatttttcatctttttgtctttgtattctttcctggagtgttcttcaacttctatgttaccaacgtttgattgatagtcatatcagctattatatttttaatttttaagacctctgattctctgattgtatcttttttcatagcatcctgttcttgtttgatggatgctatatgtctcaaatctctgagacaaatagttgggctttccttttggaaatgttctccttttgccctgccctgcctcccctcccctcccctcccctccccttctctcccctccccttcccttttctttcttttctttcctttctttctttctttcttttttttttttttttttgacaaggtctcactctgccgcccaggctggagtgcagtggcacaaacatagctcactgcagtctcaaccttctgggagctcaggcaatcctcccacctcagtctcccaagtagctgggattataggcacacaccaccatgcctagctaatttttgtatttttagcagagagggagttttgccacattggccaggctggtctcgaactcctgactgcaagtgatcttcctgccttggtctctcaaagtgttgagattacaggtgtgagccatcgtgcctggcctgttctccttttctttacattatttcaatttcccctgatgtcatttttcccctgatttatctttgactgactgtttcaggctggtggttatctaaaatgtctgctggctctttgttcaagtttttaaaaattgaagtcactaggttataaactcaggaacatcttaaataactaaatcattttgatcaagcttaacaccggaacaattatctaaaatgtttgaattacattctaatgaaagagaatgagatacagatattatcaggacaggggatgcgtcagaccttattatactgatgaagcttgagagacgacccagccggtgaacttgaatgtttctctttgtaatcatttttcctgaacgaatgactgactgatcacttttattttcctaggtgagatcaagttagaaatgccaatcatcagtgtggagggagaggtgtctgacctggcagctgacccggaaaccgttgacatcttggagcagtgtgtgataaactggctgaatcagatatccacagcggttgaggcccaactgaagaagacacctcaggtagtttgtgcagggctttcagagagccccgatccaggtcatgcttaccatgctgggaaagagcccggagtctggggtctgcatcatctggcatcttttcttactgttttatgacttccttaagccatcaaaataaacacacccaaaatatcatttctgggctttctgatgttaatgtgctaccaggttactgcctggattgataaagataacactttggatcagtcaggaagcttgggctgccaaaaacaggaaacccaactcaagtcgatcaactaagaaagcaaattccttggctcacataatggaaaagtccagaggcagggttggcttcaggtccagtctgatcagggctctggctatatttctgaatctctcagttctagacccctttctaggggctggagagcttcattcctcaggctggcttccttgcagcagtttctggcctcacattctgtacacctcagttgtccggagaaaggcagagtgtgtttctagcattctcagctggagccctgagattcactatgattggaccacccagggtcaagagcccacccctgaagaccctgaaggattggagcagttggacagaaagaacggatgctggagaaaccaccataagtgtctgctccaccctaataatgagagttctttgtgtgttcatttcacctctcagggtaaaggccctctggctgaaattgaattctggagggaaagaaatgcaaccttaagtgcgctgcatgaacaaacaaagcttccaatagtcagaaaagtcttggatgtgatcaaggaatccgactccatgcttgtggctaatctgcagccagtgttcaccgagttattcaagttccacacggaggcctcagacaatgtgcgctttctctccaccgtggagcgttatttcaaggtatgctgggtgtgctgcactttgcagtcagctctgtcaaagagatttcatatgatttaatttcccttttaaaaatgttcagcatttggccaggagcagtggctcatgcctgtaatcccagcactttgggaggctgaggtgggcagatcgcttgagctcaggagttggaaaccagcctggccaacatggtaaaaccctgtctctccaaaaaatacaaaaattagctgggtatggtggtgtgcacctgtagttccagctactcaggaggctgaggtggaaggattgcttgagcctgggagatggaggttgcagtgagccaagattgcgccactacactccagcctgggcaacatagcgagaccctgtctcaaaaaaaacctcagaatttaaaaaattgtgataaaatagacatgacatgatattatcattttaaccactattaagcatacagttcagtggcactaaatacatacacaatgctgtgtgtccattacactatttccaaaacagtttcatcttcccaaactggaattctgtgtccattaaacactaactcccccttcttccttaccctaagtccctggtaacttctgttctgctttctgtctttgtaaatctgactactctagggacttcatataaggggagtcatgcaggactgatcctgtgtgcagtctctttcactcagcaccaggttttcaaggttcacctgtgttgtagcgtggagcgtgttagtgtttcactcctttctgtggcagaatcatattccatagcatggatagactacatttggtttctctattcatcagtcggtgggcatttgagttgtttctgcattttggctattatgaagaatgctgctacgaacattcttgtacaaggatttgtgtggatgtgtgtttttaattattcatgtattatgcataggagtggaatagctgggtcatatatggtaactgtttaacctcttgaggaatttctagactgttttccaaagtggttgtcccattttacattctgaagagcaatacacgaaggttctggtttttccgtatcttcaccaccacttgttatcgtctttctgataatagccattgtggtttaatttgcatttccttaacaactagtgagactgaacaactttttatgtacttaatgtgcttattgtcaatttcatattgttggtgaaatgtctgttttaatcttttgcccgttatttatttgagttattattataagagattaaaaaaagtctgctcacctgggcaacatagtgcgacctcatctctacaaaaataaaaataaaaaattagccggtgtagtggtgcatgcctgtattctcagcttacttgggaggctgaggtgggaggatcacttgagtccgcaggggagtcgaggctgcagtaagccatgtttgtgccattgcactccagcctgggcaccagacttggtctcaaggaaaaaaaaaaaaaaaaaagagtgaaacttcttgcatgcttactgttttatgaaactatttggaccccaaggctaagggctcttgcgtggctctctcctctcttggtcagaacataacgcacgggtctggcttccacgtggtcctggacaccatccccgccatgatgagtgccctgcggatggtgtggatcatctcccgacactacaacaaagacgagaggatgattccgctcatggagcgcatcgcctgggaaatcgctgagagagtctgccgagtggtcaacctgcggactttgttcaagtaagaagccatggcgttcatttttttgttttgttttgtttcactttttactttttagatcttaaacagctctattgagctataattcacatataattctcttacttaaaatgtacaattcactggctcttatggctgggcacagtggtgcacacctgtaatcccagcactttgggaggccgaggtggcggattgcttgaggccagaagttcgagaccagcctggccaacatggtgaaaccccatgcgtggtgggctgtaatcccagcttcatggaagtctgaagcatgagaattgcttgaacctgggaggcggaggttgcagtgagtggagatcacaccattacattccaacctgggcgacacagcgagattctgtctcaaaaaaaaaaaaagtacaattcattttttttttttttagtatattcacagaattgtgcagccgtaaccactatcaatgttagaacatgttcttcatccctcaaaagaaaacgtgtgccttttagcagtcagtcctcgcctctccccaattgcccaagtcctgggaaccatacagcgtgctgtcttttgcatataaatggaatcagacactatgtgacttttatcactgacttctttcacttagcagcatgttttcaaggttcatccacatcgtagtatggatcagtgcttcattcctttttatggctaaatcatattccattgtatggagatatattttgtttcagatacatatatgtgtgtgtgcacacacatatatctacatgaaattttgttttaactgcaatgttcttccccagttgtacctggagagactgaggctgaggtggaaccacctttgagggtgtagggagatgatggaggatgctaagggagacagataacttttttcactttcttaaaaaatatctatatagatgaggccgggtgcggtggctcacgcctgtaattccagcactttgggaggccaaggcaggcggatcacttgaggtcaggagttcaagaccagcctggccaacatggtgaaatcctgtctcaactgaaagtacacagaattagccgggtgtggtggtgggcgcctgtaatcccagccactcaggaggctgaggcaggagaatcgcttgaacccaggaagtggaggttgcagtgagccgagattgcacctgtctatatctgtatctatatcatcatctagcgatctatctagatagacagatctatctggatatctatgtagatctatctatatgtatctagatagatatctatatttatccatatctatacataggtatctatgtctatatccatctatacagataggtatctatgtctatctatgtatatgtatttatatagatagcatataaatggaatcagacactatatgactttttgttatctatagatagatatctatatctatatgtatccatatctatttatatacatctctctctctctctctatctacctgcatagctagatctccatttctgtctatttgcataggtgaagtaggtacccaaatggaggcattgtcctgcgccgtgttgcagctgccgctgttgacctctggcctggggccaaggccacctgccccttctggtgtagggagcgaggtcaccaggtagccccagccctgcacgcaggttggcggctgcaacggaaacctcgcagcttgggactcccgcccttgcacatgggacagggcagccgcttgcccgctctgccttttccgatgaggccgtgaaaccagggggggcgcccgggtcagagcttcacgggacactggctccccagccggggagtgcggctcggacccggagctccgccctcctcccatcacggcatctcttggcttcgcagagaaaatcgagcgagtgcccaaagcaaaaccttggaagccaggaacaccctcaggctgtggaaaaaggcctattttgacacccgggccaagatagaggcttcggggagggaagatcggtgggagtttgaccggaagcggctgttcgagaggacggattatatggccaccatctgccaggacctctccgacgttctgcaggtaggggctgggcgaaggccggcggaatttgccccgaagaaggcagttggcttttgacagtggccccctccgtgtcaggtaggagctgggcgtcagaaagggcctggcagggagaagcccttcaaagaaagaacctacggaatatactagaatgtaccagaatggaccagagtacaccagagctttgcgactttttgttgctttctctgacattcttccctctccctgctttttggctttcctttgacctctttggccactccttctctgtgtcttttgcaaagctcccttcctctgccttccccttaagtattggaatccctcaagaggccagtctgagacctctcttcactctccctcagccaggcccagtcttcccagagctccacggatggacaaagtgcctagtggctgattgaattagccacagcacttgtctcctaaaggttcacccaccccttcattctaaatgcattcacggagaactcacggtgtgccgggtactcagatgtcttaatgctagaggaaccatagtgagtacaaagcaggtccggctgcggtgtggcagtgcccagcccgagagggaggtgatgccctgtgctcaaagacaggaaaaaaaaatgctgtaaaaagaattcaaacaggccaggcatgatggctcacacctgtaatcccagcactttttgaggctggggtgggaggatcccttgaacccaggaatttgagactggcctgggcaacatagcaagaccctgtctattgaaaatacaaaaattagccaggtgtggtggtgcacacgtgtagtcccagccactcagaaggctgaggtggcacgttggcttgagcctgggaggttgaggcgcagtgagccgtggtcacgccagtgtaccccagcctgggcgacagagtgagaccttgcttcaaaaaaaaaaaaaaaaaaagaattaaaaatataaagctttttcggctagatgcggtggctcacgcctgtaatcccagcactttgggaggccaaggtgggcggatcacgaggtcaggagttcaagactagactgaccaacatggtgaaaccctgtctctatgaaaaatacaaaaattagctgggcgtggtggcgggcgcctgtaatcccagctatttgggaggctgaggcaggagaattgcttgaacctgggaggtggaggttgcagtgagctattgtgccactgcactccagcctgggtgacagagcaagactctgtcccaaaacaaaaacaaaaaatatttaacttctatgtggaatcaccgtagctagtgtgtgcatgggtatttcattgttaccagaacagtggaaacgctgcatagaactacctcagtggtttatcatctcacctctttgtgtgtgtgtgtgtgtgtgcatgtgagacagagtctcgctctgtcacccaggctggagtgcagtggtgcgatcttggctaactgcaacctctgccttccgggttgaagtgattctcctgcctcagcctcctgagtagctgggattacaggcatgcaccaccacacccggctaatttttgtatttttagcagagacagggtttcgccatgtttgccaggcttgtcttgaactcctggcctcaagtgatccgcccccctcagcctccctgaagcactttcaactgcaagtgcaaaggtcctgaggcagaaagggacatggccttggaggagggtgggggtggctgcaatgtggggaggaacaggcaggtgcagacctggatcttatcctatgtgccttgggcatcgtaccgaagggcttagtccgggaggaggttactgtgtgacatgattcttgcccccaggtcagtctcgatatgctatccatttgtagttctaatattcacaggaaaacccaaatgtaatctcctcattgttccgtttgattggacagattttggaggaattttataacatatttggtccagaactaaaggcagtgacgggggaccccaagcgcattgatgatgtcctatgcagagtggacggcctagtcacccccatggaaaacctgacctttgaccccttcagcatcaagtcctcccagttctggaaatatgtgatggatgaattcaagattgaagttctggcaagtgacacgtccattgagtccatcttgggagtcgacaccatgttttctctgtgttaaatttgttgggttatttagtgatgcttagtctttttttttaaatcacaagtaatacctgcttattaattataaaaaacaaaaacaatgcagaagtgcataaggtaaaaatgaacattcctccatcttctttgtcctcacacccattctccaggtgggataagtttaagttgagctagacacagtagcatttctacaaagttttgtccaatataagttcacctatctaggagtgaagttaaaagtaaaccagatatggcaagagaatcacaaagcgccctgtgagtttttgagaattgcgttttgtcagaaggcgggggcatggagagctgattggaaacaacctttgggattgaggaagatttggatgggggaaatggggacgaggaaggaggctgagacagcggagggggtttcaggtgggaagaacagtgtgaatgaaggtgacagacatgagaaaaacaggaattgtctgaggcagagcaaacagaggggtttggcataacacatatgggtagtagagggaaatcaagctagaaaggtgggttgggtaaataattggtgatgaacaaagaggacaggagtgaggaaggagacttacttcagtaggcaagagggtgccattgaaggtggttgaccaaggaatgatatagccagaattataggtcgggtgtagcggctcatgcctgtcatgccaacactttgggaggccgaggagagaggactgcttgaacccaggagtttgagaccagcctgggcaacctagtgagatgcccatctctacaaaaaactttaaaaaattagccaggcatggtggcttcttcctgtagtcccagctactcaggagctgaggtgggaggatcccttcaacctgggaggctgaggtcacagtgagctggctgagatcacaccactgtactgcagcctgggggacagagtaagactctgtctcaaaaaaaacccaaaaaacaaaaacgtgaaaaaaaatcaaggtttatacttcaggaagatttttctggctacagtataggctgctttggactggggaacaacagagagtggggagatgatacaggaggtgatagcctgaggtgcggggaggcagagtccatcagagagaggctgcagctgagaatcagatttcacttcccacagtatgaagagtgacccattgcgctcaccttttcagtctcatgcaggaagcgtaattaggagcatccccatttatgtcttacacagttgtttttataacctcacagcatctttttatatgcacaaccctagacagttctacttggttatatagacattgccatgttaactatatctaatttattattagctgctattttaagtgttacttgctttttcagttgaacctttttttggttttcttttattattttttattttttagggacagggtcttgctctgttgctcaggctaaagtgcagtggtgtgatcctggctcactgcagcttcaaccttctgggctcaagtgatccttccgcctcagcctaccgagtagttgggaccacaagcatgtgtctggctaatttttaaaatttttaagtagagatgaggtctcactctgttgcccaggttggtcttgaactcctggcctcaagtgatcctcctacctcagcttcccaaataaattgaacttttcatcaaagtcacttaatcaagtgatactaaaggattcataataagaaaaaacagctccatgcttaactccttcctcattcttgctgtcattttccacaattttagatgtttcttttgttgttaacccctatatttttttaagaacaagccgatgtggttattttctgatttattaatttagacttctgttaacttctcagagtagatacaggctggactgtcccattcctaatcccatttgcctctctgtcatctaacacagtttcttcataacttttagttaaattaatgactagtgtttacttattatgtctatgcaaatattgttcattgctgagctgggaagaccatcataactacaatacctttcttggccaaccttcagttttcctggagttaataattgcttttgttttttatttgcctggttatttatgtacccattgttaattttttccaacttctctaatatctctgccacatacctatcaacaatagcctctaaatacttaaacatatcagtgccattatttacctagaggccttcctcccagagctcattgtcctcctactctagcttgtttaccttttttttcctttgtcctttttttttttttttttttttttttgagacagagtttcgctcttgttgcccaggctggagtgtaatggcgtgatcttggctgactgcaacctctgcctcctgggttcaagcaattctcttgccttggccttctgagtagctggggttacaggtgtgtgccaccacacccagctaatttttgtgttttttagtagagacagagtttcgccatgttggccaggctggtcttgaacttctgacttcaagtgatccgcctgcctcagcctctgaaagtgctgggattacaggcatgagccaccacacccggccagcttgtttgctttttgagcctgttacaaagcagtctaggaccctaggacttcctatcttctctcatctgtgttggattttcaattttctagatctcacctcttcctctttccttgtttactccttcgttttgctggagcacatttagtagcttcctaagtaaggtttcatgagacatatattttgtgagtcttatatgtatgaattctgaaataacaggtatagaatccaaggttgaaaatcacctttctttagaaatttgaagtttttaaaattgatttctagcttccaatattagaagtctgatgttattcttgagttaatttttctagaactaaccttccactcttttatagaatggagtgggggtgggagggattgaggctgcagagtggcctggctgtgcaaggtgagaaagggattccctgtttgcccctcaccttcatgcacactgactcccttcctgggcccagtgcctccaaatgctaagccttctggagtttcttcaaggaacaaacagggactcacttgcgccccctattttcagcattaggttgtaactacctgccttagttactgtctttttttttttttttggaatggagtctcgctctgtcgcccaggctggagtgcagtggcgccatctcggctcactacagtctccacctcctgggttcacaccgttctcctgactcagcctccagagtacctgggactacaggcgcccaccaccatgcccggctaattttttgtattgttagtagagacggggtttcaccgtgttagccaggatggtctcgatctcctgacctcgtgatctgcccgtctcggcctcccaaagtactgggattacaggtgtgaggcactgcgcctggccctgccttcattactttcttactaaaaattcctgaactatttcctctgttgttgtgtcctctcctgcattttttgtttatatgagttaatactttaaaaaattcctttacctttgaactggttggggagagagatcaggaaatcaacatagccaatctcccactttaaattggataccagtttccattacttatgccatagaaatctgtcccaaaccactgattttttttttcttatttcttgccactttattttggcaggataattacaggggcatgagggttgttttgttgatttttttgcaggttattgagaaagaagcaaaacattttattgatgaatcttttaagacgcttcgatctgctgaagcagcatttgacatgcttttaaaatttaagcacattcgttcacgggaggctgttaatcgacaaatgatgatgaaatttaatgatattcttgcacagtactgtaaagaggtaattgaaaaatcgatagctgccatagcattaaaaatacacttggcaaaatgtgaacaattgaatcccactattgtctgtctttcccatctgaattcagagaaactagaattttcccaaattagcatgttacgtaatacacgtaacccgaacaaagtgggtttgtttatttagtggagaaattcaataagaattaagtatattatgatttactcacattgtggtgggccctgtgtgggttagtaataatcatggtagtaatagtaatcatagttaaccatgtccaaggatcatatatgtatttataattaactcagaacaatttatctggtgctcacatatctcaagtatggtgttaggcacagagatagagagatgaacaaaacgtggattctgcttttaaagaagtcagtatctagttggagaaatagaccaaaaaatgcttataatctgctgggcacagtgactcatgcctgtaatcctagcactttgggaggccgaggccagcggattgcttgagttcaggagtttgagaccagcctaggcaacatagcaaaactccatctctacaaaaaatatgaaaattatcctggtgtggtggcgcacacctatggtctcagctacttgggaggcagaggtgggagaatcacctgggccaatggaggttgaggctgcagtgagccatgatcttgccactgtactccagcctgggcaacagagtgaaaccctgtctaaaaaaaaaaaaaaaatgctggccagtcgctgtgactcatgcctgtaatctcagcacttggggaggccgaggcaggtggatcacctgaggtcaggagttcgagaccagcctttgccaacatggtgaaaccccctctttactaaaaatacaaaaattagccaggcgtggtggtggtgtctgtaatcccagctactcaggaggctgaggcaggtgagtcgcttgaacccgggaagtggaggttgcagtgagctgagatcgcgcgattgcactccagcctgggcgacgagtgaaacttcgtctcaaaaaaaaaaaaaaaagaaaaaagaaaaaaatgcttataatcttatgtagaagacaaaatgagaatatgtggaatgattaggtgagcataaggtagtataaaaaaaggcctaaggtggtctcctgatgtcttagtttcccaatgctgctggaactaatgaccacagatgcagtgacttagaacaacacagatttattctcttatggtactggaggtcagaagtttgccacgggtgtccctgggtttaaatcgaggtgtgagcagggctgtgttcccttcgggagtctctagggatgattcagtgctttgctttccccaaattctagaagttcctggttccctttcatcttcaaagccagtggtggccactttcacttcagatcactctgacctccttttctgcctcctccttcctgttttaggacccttgtgattacatagaacctccccagaaaattcaggataatttatctattttaagatcagctgactgacaacattaattccatctgcaaccataattcccctttgtcatgtaacattacatattttcagcttctggggattaggacgtggacatctttgggaggcgaggccatcattgtgcctgccacacctaattacccccacgagagctcagacatgcttcttttaaaaacacagttctggtgactgtagtcaataacctaattatacatctaaaagtaactaaaagagtataattggattgtttttataacacaaaggataagtgcttgaggggatggacaccccattctccatgatgtggttattatgcatagcatgtttatatcaaaacgtgccctatagcccatgaatatgtatactttacctgcaaaaactaaaaactaaaaattaaaaaaaaaccaaaggtctgccactgtggtcatgtctagaacagatttccggatttctgataattggatcaagccaatatacacagtgtgcatgctctgtaattgtaaggcaatttggagcattgcatatgttgaagaaaagattactacagccgggctcggtggctcacgcctgtcctcgcagcactttgggaccctgaggtgggcagatcacctgaggtcaggagtttgatacctgcctggacaacatggggaaacaccatttctaccaaaaatacaaaaattagctgggcatagtggtgggcgcctgtaatcccagctacttgggaggctgaggcaagagaatcacttgagcctgggaggcggagttttcagtgagccgagatcatgccactgcactccagcctgggcaacagcgcaagactctgcctcaacaacaacaacaacaaaaagattactacagagcataagaaaaagtagtaaataataagtaaacagtgaaaacactattctgcatcttagaatattttttgacattccacttttggtttccttaaagattcaaatctcatctttcttggctaacctggcgatgtttatcacttacagaagctgtttgattgcttttcagattgacatcattaataaaatctttgtccagaaccttgaaaatccaccactgtataagaatcaccctccagtagcaggtgcaatatactgggaacgatctctgttctttcggattaagcataccatcctccgatttcaagaggtacaagagatactggacagtgatcgaggacaggaggtatgttgctcttgctagaattggctccttttgtatttgattttttttttttttttgagatggagtctcgctctgtcgcccaggctggagtgcagtggcgcaatctcggctcactgcaacctccgcctcccaggttcaagcgattctcttgcctcagcctcccaagtagctgggactacaggcatgtgccaccacgtccggctaatttttttgtatttttagtagaggtgggattttaccgtgttagccaggatggtctggatttcctgacctcgtgatctgcccacctgggcctcccaaagtgctgggattacaggcgtaagccatagcacccggccctgtatttaatgttttaatcctagactggctgccctccccgatcccatccaggagaagcattagatcaggctgctgccgccatgcagcacgctatgtagagtggcccatttgagaagcagctcaatttcagacccatgcctgtgagttagagggtctttctgttgtccttgcattcatgctcatagtaaactgccttttgcgttccttctttttcttttctttttcttttttttttttttaagacaaggtcttgctgtgttgcccaggctggagtgcagtggcacaatcacagctcactgcagccttgaccttctgggtttaagcgatcctcctgcctcagcctcccgagtagcggggcctacaggtgtgggccaccacgcctggcccatttttgtattttttgtagagatgaggttgcaccatgttgcctgcccaggctggtctcaaactcctgagctcaagcaatctgtccacctcggcctcccaaagtgttgggcttacaggcgtgagccactgcacctggcctgtgttctttctctttggcatcttaatacagaagacatcttccagaatgtggtcatgtgggcttcttcctgtattgaattttcagcttctttggaggatgcctaccatcttttcgatatgatctcaccccccacccatggatttttatatgttatatagcagaggctggtaagccatttctttgaagatcccgatagtaaatattttaggggtttggacaatttctctgcaacgactcaacctgtcgttgctgcaataaagtatcccccagataatacgttttgaacaggcgtggctgtgtccaataaaactttatttatggatgctgaatttgaatttcatatctttttcttgagttacaaagcattattattcttttgatttctttttaatcatctaaatcatttccttctcttcatgtaaaagctgttcttagttcatgggtagagaccaaggcagttcatggactgtggtttgcagaaggctgccagtcaacctagatttcaagttatcaactatattagtccattttgctataaagaaactgggtaatttataagaaaagaggtttaattggctcacagttctgcaggctgtacaggtagcatagccttcctgggaggtcccaggaaactcccaatcatggtggaaggcaaagtgggggcaggtacctcacacagtgggagcaggagcaagagagagtgaaggggcaggtgctgcccactttcacttgagcagatctcccaagaactcactcagcatcaccaggacagtcccaagagaggtggtgcaaaccattcacgagaattccgccttcgtgatccagttgcctcccagcaggccccacctccaacactggggattacaatgcagtatgagatttgggaggacagagatctgtgctatatcaccatcgcagaccaactctccaagctttgggaaaatctattgacttcctttttcaaaatgtgtttatatctaatactattttatattatattatttaatattatataactatatattatttattatattaacatttttatttattatatttataatgtatgtatacaaaattatgtagaaagatatgaaaaaatgtttatatataattatataaaaatgaccaggtgcagtggctcacacctgtaatcccagcactttgaaaggccgaggtgggcagatcacctgaggtcaggagttcaagaccagcctggccaacatggtgaaaccctgtctctactaaaatacaaaaattagctgggtgtggtggcatgtgcctgtaatcctagctacttgggaggctgaggcaggagaatcgcttgagcccgggaggcgaaggatgtagtgagctgagatcgcgctactacactccagcctgggcgacagagtgagactccgtctccaaaaaaaaaaaaaaaaaattatataatgtttataataatttatatattatatttataatttgtataaattatctgtgtagagcgagatgaaaaatgttattttcaaggacaaaatgacggttgcttgaattctttgataggtcaaacaaaaatatttggaagtaggtaggacaatgaaggagtatgaagacagaaagtatgagcagtggatggaggtgacggagcaggtgctgccagctctcatgaagaagagccttttgaccaaggtgcgctgcccacgccctcattcccgattgccgcgtgagacgatggcgtctgccacattttctcaaggcttgatttgttgacattcatgaagttgggtcagtttccagaatcaaagacaaggaagggctaggggaggaggagaaaggaaagagtggagatggcacgatgccatggctaggacgcgggctggaaacgggcagccctactgacttcttgggcaagtggctgaataccaagcctccgtttccccatttatgaaatgcgttttataaatcagatgatgtagacaagcaaagggttggttgaatcatatatgaaacagagctgacagctggccatctttaacctgcagaaaaatgccattccacctgattcatcctcttcttcagctctgggccccgcacttggtgaatgctcgataaacgaacacctgccgttagggaggaaagatgcagcctggcagttttaggtctttggttcctgaaatcctgacgtagggaccaaagcaagtggagagggccaggtgggacccctagggaacaggtgggctcagatccgaccaaagaggcaactgctccatgtcagattttccagtgtttcaagggaaggcagaaggaatttttaggtgaaattgctccattttcaaatgccggcaactgaattgattcttcaaaatctccgttcaccaaacaaaatacatattccagccagttccagccagcacccccgtctggtgaagggcccagtgttgatctttttcatgttcacttttggtgtgggttgtgttgatccaactgtctcttggactgccctggccgcgctgatggaatgtctcttccacagtcttccatcgccacagaggagccttcgactttagaaaggggagctgtttttgcaatcaacttttcaccggctctcagagagattattaatgaaacaaagtacttagagcagctggggttcactgtccctgaattagcaagaaatgttgctctccaggaagacaaattccttaggtaaaaaaattcttcttttaaattagcagtaagctttttgttcttgggacccctttacgctcttaaaaattattgaggacccctccaaaagctttcatttttgtggattttataattatgaattcttaccacattagaaattgaagctaaggcctgggcgttgtggtgctacctgtagtctcagctacttgggaggcttaggtgggaggattccttgaacctgggagattgaggctgcagtgaaccgtgattgctctatctccagcctgggagacagagcgagagcctgtatccaaaaaaaaaaaaagaagaaaaaaaaattgaagctaagaaaagtttaaaatatggggttgggtgtggtggctcacgcctgtaatcccagtactttgggaggccgaggcgggcagatcatgaggtcaggagttcaagaccagcctggccagcatggtgaaaccccatctctactaaaactacaaaaattagctgggcatggtggctcatgcctgtagtctcagctacttgggaggctgaggcaggagaattgcctgaacctggcaggcagaggttgcagtgagccgagatcgtgccactgcactccagcctaggcgacagagcgagactccatctcaaaaaaaaaaagaaaagtttaaaatagggatcaacaatagtaaacctatttcatgtaatataaataacatctttaatgagaagtaaccaatattttccaaaaaagaaagttaatgagaagagtgatgttttaaatttctgcaaatctcttgatcaaggttggtcttgattgagaccacggtcttttgtaatctcttgaccgcaaaagcttttgatgagcttaaaggtgctctcctcaggtttatgacattcctgtcatgtgcaggtacacagctgggatacagcgcatgttggatcattatcacatgctcataggaacgttaaacgatgcggagtctgtgcttctcaaagatcattcccaggaactgctccgagtgtttaggtcgggatataagaggttgaactggaactcactaggtaacgtcattcatctattgattgccttttagacttgggatgcaaagtaattcttttaggttgttttatttgaattaccattttcatatgtttatagagacaattaacaatttttgagggttaagaaatacaagttgcggaacttagaactgatctccaggctgtcgttgggatgaagataagaggggtgatattttcacactctgcagacccaaagcacatttctcccaaaagaaaatcacctttacttttatttttttaattaaaaatgtaatttggaggtaattatagattcacatgcagttgttaagaattacgacagagggagccttcgtaccctttagtcattttccctaagtagtaacttcttgcaaaactagttaagatcacaaccaagatattgacattgatacagtcgagatagagagcattttcaacaccacagcgagtactgtcaagtccacttccctcccatccttgccctctccttaatccctggcaaccatgaatctttattcaatttctgtaatgttgtcatttcagagtgttatataaatgagataacacatagcccttttttgatttggctcttcttgctcagcctaagtcttcaaagatctgcccttgttggatgtgtcaacagtctgtggattttcgaagcataccccacggtatcaatgtaccatagtttgttcagcctttcaccttttgaaggacaactaggttgtttccggttttggctcttaggaataaagctgctataaacatttgtgtacagggttttgtgtgacaggagtcttcactttttctgggataaatgcccaggagtgcagttgctgagttgcacggtagttgcatgtttagtttaaggttgttgttgttgttgttttgagatggagtttcgctcttgttgtccaggctggagtgcagtggggcaatctcagctcactgcaatctccacctcctgggttcaagcgattctcctgcctcagcctcccgagtagcttggattataggcacctgccaccacttctggctcacttttgtatttttagtagagatggggttttgccatgttggccaggctgatcttgaactcctggcctcaagtgatccatccgccttggcctttcaaagtgctgggattacaggcgtgagccaccacgtgtggcctttttttgtttttgtttttgttttactgtcatgctgtcttacagggcggctgtgccattttacatttccatcatcaatatatgagtgactcggtttctctgcatcctggccagttttgctgtcactttttttttttttttttaattttggccatctgatagctgtgtaatgatatctcatggttctgatttgacttctgtaatggctaatggtgttgagcatcttttcatgtgctaataagcacaaatatgtcatgtgtatggcctcttcagcaacacgtctttttatgtcttttgcctattttctaattagattgtttgttttctttactgttgagttttgagcatccttggtatactctagatactcgtcttttattggatgtgtggtttgcagctattttctcccactctgtcgcttgtcttttctttctcgtaggagggcctctggtagagcaaaaactgtaaatttcaactaagtccagtgtatcaatttttcctttaatgggttctacttttgctgtcaagtcgaagaatcataagtttttttctctccttgtgttttgtttctaaaaatgttatagtatgatgtttcccagtatagtctgtgatccactttggggtttttattttcataaagtgagaccgatcgtaagtacttagcccgagtttactgttcatgttcttgctgttcgtctaagctccaggccagaggaggctgcgggcaggtggtgcagagtggaggttcagggagctccagcagtgagaagacagctaggcttgatagtccctttctccccatggtgctccagccaggaccgtgctaacatttgaatagaagagatgcattgcttggttgattctgggctcaggactccttgtcccagtcccttagggttcaaagtggatctttgccagcccaaagacccaaggggttggaatgagcagggtctttcctgcaaagggatgccagtattaacatcacagacgttggtggggggatgtggaaagacagagttggaagccaaatgtctttctttctttctttcttcaaaggtatcggtgactatataactggttgcaaacaggccattgggaaatttgagtctctcgtccaccagattcataagaatgcagatgacatttcttccaggctgacattaatagaggccataaatctctttaaatatccagccgctaaaagtgaggaagaactcccaggtagatctgacttctgggttctccagttatggaattaatgagaacatatattgtatatacatacatgtgtatatatgtacctataaatatacatatgtatttgtatgttccatgaatggcatcaaaccatttctaatgctctcagtcatttacttgaaagaatcacgggtagctattactttttgtcatgttttatatattgcttagtttaacaaattcatgtttatttgtttttgttttgtttttttctgagacgagggctcactatgttgcccaggctggtcttggactcctggcctcaagtgatcctcccacctcatctgcgaaagcctgtggtactttgttgataactttgtaacagtaaagctagttgtattttttatgggctcacatttacttgctaaagaaagatactttaggcagggctcggtggctcacgcctataatcccagcactttgggaggctgaggcaggcagatcacaaggtcaggaaatcgagaccatcctggctaacacggtgaaaccctgtctctactaaaaatacaaaaaattagctgggcgtggtggtgggcacctgtagtcccagctactcgggaggctgaggcaggagaatggcgtgaacctgggaggcggagcttgcagtgagcccagatcgcaccactgcagcactccagcctgggtgacagagtgagactccgtctcaaaaaaaaaaaaaaagatactttaagtggtcttagactagtcaacaaggaattcaagatatgtcaacaatgaattgaagaaaaacaagattgcccaaaggtataaaagccactagatgtgcgtaactggttgtcatttatttgttgcttagtgtgtgttctgatattgacttatgttctgctttgggctgaggttggaggctggttttggtttttttaagacacacagctcatgtttggattgccttttgagtgctgtccttccctgtgttcgtggacagctctaacagacatctttctctccaggcgtgaaggaattttttgaacacattgagcgagaaagggccagcgacgtggaccacatggtccggtggtatcttgccattggaccactgctgaccaaagttgagggcctggtcgtccacaccaacacaggcaaggcccccaagctggcctcctactacaaatactgggaaaagaaaatttatgaggtcctgacaaagctcatcctgaagtaagttcatcttgttgcatgctttaaaatggtgtgtgtagattaaaacagttgacaaatatggacagttagagggggtggcaaggtagagaatgaaaatcagttggatggtcagaggctttctggcagaagggcactcacagaatggggggatgaccttcatgatcttgttaggcccctcaacattccaaaaaagaaaggatccctctccccacttcaactgtctgaaagccatcgtgagcctgtgttcagctggcagcagagaatcgctgtcactcaatattggctagaatcccagaggacttccttgttcatgttgagagtgacagacgtgaaggacacatggcctattccttgctgatttcaagtcagcccctagttagcgcggtctgtgcgtgttgaatgcctgtttcatgtgccagcctctgacacgccagactctgtcccttccctcctgggcctcaccctcagcagctcagccagaccagctggaagctgagtgcctggaccccatcgcattggtggcccacagactgttctggggtgtgaggctgacagtttaggatcattctaggaaaccagcctgtgaaatccatcaccgttaccgtcacgtctatattgtcaagagtagtgttcattttatcatgcagtgtcttccttatgaaggggaactccagaagaaatgactctagttccttctttgaccccagcctcacatttttctcttcttttctttttttttttttttttgtttgagacagagtctcgctctgtcgcccaggttggagtgcagtggcatgatctcggctcactgcaagctccgcctcccgggttcatgccattctcctgcctcagcctcctgagtagctgggactacaggcgcccaccactacgcctggctagttttttgtatttttagtagagatggggtttcaccgtgttagccagggtggtcttgatctcctgacctcatgatccgcccgcgttggcctcccaaagtgctgggattacaggcgtgagccactgcgcccggccaccccgcctgacatttttctttttcgttttttgctttcattttcttgtttggtttttaagtgatacggactctatggattgttaacttcatagctttccctttcacgttggctgctaggaagcttagaaccaaatttgtggcctaaatgcagcaagtgtgtaggtatctatgattcacattttagtctcatctgaacacataggaaagctcaccttgcaccatgttctgtgctggactctttccaattctcatccctgttttacagaggaggatacagaatcttggcaggttaagtgactcgtccgggaccacacagccagtaagagaaagggctgggatttgaacctgggcagtctgactccagtatcatttcctgaaatggtgtctgattagtgtcttcttcgttccttactttacctcactttgattttaggatctcttactgcagttaaagtatctttgtgagctgctaaaaatctcttttggaataatacactgaaaaataaaacaaaaacctttggtcttcttgttttctggacccagtttcgcaaacttctctaagttgatcctttaaataactctgttttctgtgtatttcatttattctctgttactacttttaatttagattcctaaagcagtcccttacatggagctacctcctatagtgtttcccttactaatatgctatgtttttttttttttttttgagacggagtcttgctctgttgcccaggctggagtgcagtggcgcaatcttggctcgctgcaacctccgccttctgggttcacaccattctcctgcctcagcctcctgagtagctgggactacaggtgcccaccatcacgcccagctaattcttttgtatttttagtagagacggagttccactgtgttagccaggatggtttcaatgtcctgacctcgtgatctgcctgccttggcctcccaaagttctgggattacaggcgtgagccaccgcgcctggccctgctatgttttcttttgatccatttattaactcattcattcatttgttcatccatccatccatcatccatccatccatccatctgttcattcactcatccatccacacattcatccccacatccatccatccatccatccatccatccatccatccatccatccatccaaggttgagtaaagcctgccctgtgctgcctgttggattagactctggtcacagacaaggcccctgtatccttgcagtttctctaacctcatagagaaggcaggacacagggaaacagacataaaagagatgagttctgtaaaagaaacaaagcagcctagtgttctggggagagaatggagatgctgctgtaattgggtggtcaagaaagaccccggaaattccacattttagtagagacctgaagatgaggagtgagctgaaacggggaagagctttctgggggaagccaaaaactgctgtgaagacccacaggtgggcctttggtcagtggaagaaacagaaagaaggaaagatgagattgaaggaggggatgaagctggagagggtggcaggggtggatcaggtcacagggagcctgggaagccacggcagggagcttgcattttatctgacagccatgggaggctgctggagtgttttcaactggagaaagaggaggagagggagggagagagaaacagggagagggatcgagagagagaggtggagagagaggcagagggggagagagagagagataaggaggggggaagagggagagaggaagggagaagcctggagagggagagagaaacaggaagagggagagagaggtgaagagagaggggagagagaggagagagaaggggagggaaaaggagaaggagggagggagagggtgagagagggaggtggagtgagagggagagggagagagagacgggaggagggagagggaggagttagatgtttttgttttgttttgttttttgagacagggtctcactctgtcaccaaggctggagtgcagtggcatgttcatggctcactgcagcctcaacctccctgtctcaagcaattctcccacttcagcctcctgaatatctgggaccacaggcgtgtgccactatgcccagctaatttatttttattttagagacagggtcttgctgtgttgcccaggctggtctcaaactcctgggctcaaatgatcctcccacctcagcctcccaaagtactgggattacagatgtgagccactgcgccccgctagatgttttaaaatagtgtctctggctgccatgtgaattactggatggggttgggccggcagggggaagcagggagactgggctggaggctgatgaagttccatccctgggtgtcacatctactttcatcctggaaaggatggagccagtagggcaggctgggtggggatgtgagtgctcctttttccttaccagagttgagcaggttttggaagtcattattgtttaactattttccaaccaaaaggtcttcagttttccaaaagtggaaatgaactgtttgtataaatttagtgcaaaaaaagagtattttaagtaagactcaccccagcctgtctaggacagcctcacagtgtgccattgcctgtacctgtgatttttgtggccctggtcatttccatcaattgcttggtgtatttcactctagtgagatacactctgagtctttctcatcaacccctcttaggaacttgcagtcttttaattctttgatccttggaaatgtccctctgttccacactgaaaccattctgacggcacctgagatcatccttcatcccaacacaaatgagatcgacaagatgtgcttccattgtgtccggaattgcgtggagatcaccaaggtgagagcggaggtgcttgtgtccttgctcagacggcatctcaggatgcctccgcctcccaaagtgctgggactataggcgtgagccactgcccaaggtggaattcttgaccttctgccttgtgactcagtcatcccccagttttccccacttcaggaaatggcaccaacatcaaaccaactgcttgacccagaaactcgtccttgtttcttcttctctcacccagccctgcccggctcacatcagtaagtcctccaaacatacttcccatctgtcctcttctctcctgtccccccagtaccttcctatcccaagtggccatcacccctctcctggactgttgcagtgacgttccatcaatccattctccaccaccggtggtcagaattaccttaaacaaatacaaatcaggccaggtgcagtggctcacgcctgttatcctagcactttgggaggctgaggtgggaggattgcttaagcccaggagttccagaccagcctgtgcaacatggtgagacccccccatctctaccaaaactaaaattaattagctaggcgtggtggtgcacacctgtgttcctagctacttgggaggctgaggcagaggattgcttgagcccaggagttcaagggtacagtgaggtatggttgcaccactgcactccagcctgggcaacagagcaagaccgtgtctctaaaacaacaacaacaacaacaacaacaacatatcatttcgtgtcatccctgttgtaaactgcccccacccaccccatgacttaattacacttggaacataatccagatatctttgtgtgctctgtgaggccgccatgctctagcccctggctgcctttctgatctcagtcctacgaggatcatgctccctcatgctgcagcttgactggctgcctggttgtgcctccagcaggcaccatgggttcctcttgcaaggatctccatagctgttccctcacctggaacattctgctcccctgaccttcttgtcctctctctcccgtcacccccctcccatcttcctaccacgtaccactctccgaccttttcttatttttttccttgcttatttatctattgatcctttcaggccactagaatgtaagatccatgggaatacagaccttgagtgttttgttccctttagaatccccagcaccaagaacatctggcacatagttggttctcagtaaatgtttgttgaatgaacatctgctggcagaaaacccaaggtttatgtcttaccccaaattggaaaatagagctgtctttgtgggtatggggcatcaccccccagcacactggcatcttcctcttcacttggcttgttcagcaagtcagacatgtttccggcatttttaggggcataaaaataagtttagaaatcagaatagggaatttcatttcacagtacttaaaaattgatgaataaggccaggcgcggtggctcacgcctgtaatcccagcactttgggaggccgaggtgggtggatcatgaggtcaggagattgagaccatcctggctaacatggtgaaccctgtctctactaaaaatacacacacatacacacaaaattagctgggcgtggtggcgggcgcctgtggtcccagctgcttgggaggctgaggcaggagaatggtgtgaacccaggaggcagagcttgcagcgagccgagatcgcaccactgcactccagcctgggcgacagggtgagactccgtctcaaaaaaaaaaaatgttgaataaacggtacatgttttataatccatgctaagacagttatttattaagtctctgttacataaattctcttataggtgctgtatgttataggtgctatgtatgtttcctttgtaagggaaacagcaatttttaagaggtaaataaataggaaagttggcctataaaacattatgaatattaatcacaatattccatgccaacttaactttcctccttactaatagatggatttgaggctcttggtgaagcctgtattattttagcttcataagttttttcttttaaatgaaaataatttttacttattctcttagataaggttaaaaatgtatttcattaaaaagatcttggcaaatgaacatgcatggctaggccacttaatatggttgaactctttgatcttcaggattcctatttcgtggcaaaaaataatgagccaaagttttaactagtttctgaattttacctcctctactaagtggaaatgataataccattcaccttctagtgcgtgctgttgggaggattaaattatataacacgtgtatacagcttagtgcagtgtttggcaatcagtagctctgaataaatgttagctattagtattagtattactttttttttttttttgagatggagtcttgctctttcaccaggctgaagtgcagtgttgtgatctcagctcactgcaacctccacctcccgggtgtgagtgattctcctgcctcagcctcccgagtagctgggactacaggcatgtgccatcacacccagataatttttgtatttttatttatttttttttttgagatagagtcttgctgtttcgcctaggctggagtgcagtggtgcaatctcagctcactgcaagctccgccttccgggttcatgccattctcctgcctcagcctcccgagtagctgggactataggagcccaccaccacgcctggctaattctttgtattttttttagtggagttggggtttcaccatgttagccaggatggtctcaatctcctgaccttgtgatccgcccacctcggcctcccaaagtgctgggattacaggcgtgagccactgcgcctggcctaatttttgtatttttagtagagacagggtttcgctattttggccaggatggttttgatctcttgatgtcgtgatctgcctgcctctgcctcccaaagtgctgggattacaggtgcgagccaacgcgccccgcctagtgttagtattactgttattagtaatattggaagcagaagtattaggtcagtgcaaaagtagctgtggtttttaccattaaaagtattggcaaaactgcaactacttttgcaccaacctatagtagttgttattcacattttacagatggtgagcatattgttcagagaactaatgtgtcacatacctatggtttgctgttatgactcacgcttgattaaaacagagccttggccgggcgcagtggctcacgcctgtaatcccagtactttgggaggccgaggtgggcggatcacgaggtcaggagatcgaggccatcctggctaacacggtgaaaccccatctctactaaaaataccaaaaattatctggatgtgggggtgggtgcctatagtcccagctactcgggaggctgaggcaggagaatggtgtgaacccaggaggcagagcttgcagtgagctgagattgcgccactgcactccagcctaggcgacagagcgaaactccgtctcaaaaaaaacaacaaaacaaacaaacaaacaaaaaacagagccttaactctacagcagggagatgtcaaattagcagatttgttctgggacactaagcagtcaatttgcctgaatgtgtgttttttcctctgtaaatatggaaataaaagtttttttaattcatccatggtgtagttggcctttatgttataacaagccacttcaaaacttactggcataaaacaataatcatttagctctgggttctgtgggctgagttctgctgaacagttcttctggtcttggctgggctcactcgtgtctagcagttgatgacctcaagcacagctctgatgggtggcggctggggttctcttgtgtatggcctttcgtggtgtagtagaccagctcgagctggtggttgcaaggttctgagagcatgagagcagaagctgcagggctttcttgactccttggtttgaatttgcataataccatgtccgcccctttccattggtcaagttaagtcacaaggcttgctccggaagggaaataggctccatctcttgatgagaggaacaaaggattatggtaatttttgaatctcaaataatttattaataataaagtgattttccattactggcaagacttattactgaatactaatatgtacgttggaggcaaaatagatactaaaatactgtcttttctcctaattcttactttgccagcattttgttcgttggatgaatggcagctgcatagaatgcccacctcagaagggggaggaagaggaagttgttataataaacttttacaatgatatctctctgaaccctcagataattgaacaagctgttatgatcccccaaaatgtccacaggattctgatcaatcttatgaagtatctacaaaaatggaagcggtatcgacctctctggaaattggacaaagctattgtgatggagaaatttgctgccaagaaacctccttgtgtagcatatgatgaaaagttgcagttctattccaagatagcttatgaggttatgcgccaccctctaattaaggatgagcattgcatcagacttcagctcaggcatctggcaaacacagtgcaggaaaatgccaagtcctgggtgatttcgcttggaaaacttctcaatgagtcagcaaaagaggagctctataatctccatgaagagatggaggtactcaatcgctgtgtgtaattgaaactacttttcgtgtaagttgggtcttcatttgcgccattactgttttttctgtgtttgcttagtgttctttgtactttctgttatagcacctggccaaaaaccttaggaagatccccaatacccttgaagatctcaagtttgtccttgcaacaattgcagaaattagaagtaaatctctagtcatggaactcagatatagggacgtccaggagcgataccgtaccatggcaatgtataacctctttgtaagtcaacttgtattttcttattcatttaacaattggattgaccactaacgacccttttcagaaatgcttctcaagtatactgccattgatttgttttcaaataagtgactttaagtaatacattgtaaatgtaaagcaatgccactgttatttagaataatgaaaatatagagtatttttcaatctgtatggctcaaatggattgatctgtaactataccatttccattctcccttttcttttcttcttttttttgtgttaatttcctttaatagataaagagctcttgcaaaaatgataagaagagagtgaaagatttaagataataaaagaaactggtagaagataattcaattagtcttgctttgtttagggttgttaaatttgggttctcaggatctttcaaagtcatggatgagttttagggggtctgggttccccctgaagttgtatggaaattttacatactgtacatttttctgatgatgaaagaaagtcaagtttttggcccaggtctactgctcagcaagggcatttgtgagctccacatcctaaccactaggctgcaagggtcctggtgtttgaagcagtcaagcaatagaaatgctgaaagacaaacttcatgcaaatcctgatttattcatagcaatttgtttctcttctctagtttgtatttctcccttggccaggtagatttttttttttttttttttttttgagacggagtctcgctctgtcgcccaggctggagtgcagtggcatgatctcggctcactgcaagctccgcctcccaggttcacgccattctcctgcctcagcctcccgagtacctgggactacaggcacccgccaccacacccggctaattattttttgtatttttagtagagacagggttttactatgttagccaggatggtctcgatctcctgaccttgtgatccacccaccttggcctcccaaagtgctgggattacaggcatgagccaccgcgcccggcctagccaggtagatttttgtcagactttgcttccctggtttacgtcacagaaataatagaagaatcactgtaacaaaggattttgcactaagtgtgcaatgggtcacacacaaaaaatgaatcagaatgtcaaattccaacaacaacaacaacaaaacaacaacagttgagattttgattgtgattgcattgatcctttagattaatctgcacaaatggacatcctgtagtattgagttttcctatccatgaacatgttctctctctctttatttaggtctttaatgtctccccgtaaagatttataattttccccatagaggccttacctattttttgccagatttattcctaggtacttggtatttttagatgctcttgtaattggtatctttaatttttattttaattattttattttttattgttatatagaaagacaattgatatttgcattctacttttttatgatcagtaattatgaattttaatcatttatccacagattattttggattttctaggcacaccattttataaactgtgaatattgacagtttcattttaatttttaaatattttgtttctttttctcaccttatgactctagctaggaattcctgtacgaggctggatgaaaggggaggtaggggaaatccgtgtcttgttcttgatctcagaggaaaagcttttggcactgtatcattaaatatggtaattgctgtgtggtttattagattaactccaatacaataagagaaatatacagttgtgtatatttaacacaatggggatatattctgagaatgtgtcaatgggcaattccataattgtgcaaacatcatggaatgtacttatacaaatctagatgatatagctactacacacctaggccatatggtagaacctattgctcctaggctacaatcctgtccagcatgtactgtactgaatactataagcaatgtaatataacagtaagtatttgtgtatctaaacatagaaaaggtacagtaaaaatacagtattgtaatcttatgggaatactgtcatatatgcaatcaatttttggcccaaaacatcattttgttgctctttgatctttgacaaaagaccaatgactgtctttggtcattgtccctggttcctgacacaaagctttcaaaacacttgtaatttcctgagtgataggggtcacaggaacatcttttgttacaatattgttctttgtccctggttcctggcgcacagcctctcaaatccttggactctggagtgacaagagtgtcttttgtatgcaagtgaaatgactggtggctgggagccctaggcagcttcagcatgggggctggttgccagaaagatcaagccataaattatttagaggtttggaactttcaggcgcccatctttgccacccttggggagggaagaggggctggagattggagatcaacaaaggccagtgatctaatcagtcatgcctgtataatgaaacctccatgaacatccctaaatgatgggatttggagagcttccaggttgttaaccacaccaaggtgctgggagagtggtgtgctcagagaaggcgtggaggctctgtgcaccccccaaccccataccttagcttatgcgtctctttcgtttggctgttcctgagttgtgtcttttataataaatcagtgatgggaagtaaagtgtccttctgagttctgtgagccatttcagcaaatggtcaaatgtgaaggagacgtgtgtgggggaacccctgattttgtagccaggttggacagaagtctgtgtaccctgggcacctaatacttgcaactggcatctgaagtgaggacaaccttatgggacttacgcctgcatttctattgagtataggcctagacgtgaagttgctgggttacaggaatccacgtgttcagcttcactagattctgctaattttccaaagtgatggtacccctttacatccataccagcacgaataagggtttcagttgctccgtctccttacaaatacttagtttgttgatcttttggaaacaccaactttgggttttttttatcccttctatgtgtggatattattccatcatcttctggcctctattgttttgacggaggagttgactgttaatctttttgttgctccctttcaaggtagtccagtctaactttttttttttttttttttttggtctgcttttaagaatttttttttggtctttggttttcagcagttgtaatatgatgtaactaggttcttttgttttgttttgttcttcttttttttttcctgattgagatttgtagtacattcaaaatctgcaggctgatgtctttacctagttttggaaaattaacagtttttgccttattttttttcccttctgggactccaattccacatatgttggacctttctacaataccctgtacatcttacattcctttctgccttttctttctgtggtttattctaatactttgtcctaaactttaagttcattaattttctatttatttatgtctgatctgcttttcccggttccttaaacaatcctttgagtgcttgatttcaggtattgtcattatccattccagaatttccattttaaaaacaatttcctgtgctctaccaaaattctcaattttttgtcttttgtttccttgactctattaaataaaattattttaaattgtgtgtcttataactctgtcgtgatcatttatgttgtgtgtgaatctcttggttttgtttaagttctttcgtgtctttatatggctggcatttctaactgagttcttaacagcctgtgtgataaattggagagagaggattggaggcgttgggtgatgttatattttatcagaggagatttatttttgcttctaacagacaccataactgggtacattagcaagctaagctaaacttattctaatcagagattaagttgatttgaagctgggctttagtttatgaagggcttatctctctgtaatatctctatttctttttctctttttttttttttttttgagatggagtttcactcttgttgcctaggctgagtgcaatggcacaatcttggctcactgcaacctccgactcctgggttcaagtgattctcttgcctcggcctcctgagtagctgcaattataggcatgcgccaccaccccagctaattttgtatttttagtagatacagcatttctccacgttggtcaggctggtcttgaacgcctgacctcaggtgatccgcctgtctcagcctcccaaagtgctgggattacagacgtgagctactgcacccagcctctatctctttatttttaaaaatgattttatactgattttattttaattataaaattcaactttaatatttatttttattttactttatttttttgagatagaatcttgctctgtcaccgaggttggagtgcagtggtgtgatctcgactcactgcaacctctgcctcccaggttcaagcgattctgccacctcagcctcctgagtagctggaactacaggctcctgccaccacgcctggctaatttttgtatttttagtagagaagggatttcaccatgttgtccaggctggtctcgaactcctgacctcaggtgacccacccgcctcagcctccaaaagttctgggattataggcgtgagccactgtgcccagcctaatatttctttttaaaatttctttttctttttatatttacagagatacagtctcactgtgttgcccaggctggtctcaaactcctgagctcaagggatcctcctgcctcagccccccaaagtactgggattacagccatgagccatgtaatcccagtctggccatgtctggccttaatatttcaatcagcttttgagttggtttgaattacctagcctcctgttgccacaagcagaagtccctgggaggtaactttgaccatcaatttcaattccaaattgctcatcatttgttgtttattctgttttttgtttctcctaattagcctcctgatgcagagaaagaactggttgataagattgagagcatatggtccaatctgtttaatgattcagtgaatgtggagcatgctcttggggacataaagagaactttcacagaggtaccttttaaatttcacttcctgagtaaagacattgaaaaacgtatttgggctaaattaatgtaacctcgtttttctcagcttactcgaggcgaaataatgaactacagagttcagatagaggagtttgcaaagcgtttttacagtgaaggccctggttctgttggtgatgatcttgataaaggtaagaatgttcctgttggtcttactgagcgatctgagtagcaaatgtttgagtatgttttgcttaagagttttatggcaagtgatgatggtgccgtgattaaaatatttatttcttcctcaaatacttttttcttggctcattttagtggtcacattaaaaaaaaaaaaagctggattaatgcgactcattgattgttgagtgcctgctacccgaaggtgttgagagaagtgccaaggagcagcctccactcctgtgggggatacagaggtttctgccgcagctcagaaatcttaaacaccagcgactgcctttacaaaggcagcgtcttatccatccatctgcctctctaatgcctgttacatttattctttggattcagatgcttgtcctctgcccttcacatcacataggctaaaatggtgacaagttaaaaatactaaaattctgttttttttttttttttttttttgagacagagtctcgctctgtcacccagactggagtgcagtggcacaatctcagctcaccgcaacctccacctcctgggttcaagtgattctcctgcctcagcctcctgagtagctgagactacaggcacatgccaccatgccttgctaatttttgtatttttagtagagacagggtttcaccatgttggccaggctggtcttgaactcctgacctcaagtgatcctcccgcctcagcctcccaaagtgctgggattacaggcctgagccactgagccgagtcctaaaattcttattctaaagagaatttggtaaataccatgagacaaaaaaaataccatgagacaaaccaaagactgctgtggcttccaaagaaatgggtgacgtttatttaaggatgctcaaaaaaggcatctgggaaatgtggcatttgagtagatgattgtgagcagggacgtagtgacctagagtggtagtggtcattggaattgggggagaagcatagaactgggaagttagagtggtaagggagttatcagtaggatgatgatgttctcaagggggcggcaaaggatggtgatgtcgaccacaacatagaccacctcagattcccttaaaatagtctcctttctgaatgacctggttgtgagaattaggcacaattttctaactggaggagactgcagatgtcattggtcttttggttttacttagaatggtgccatgattctaaatttgtcttcccgtgtggtttatgaggatgaaattataattgagatacattatgcatgatttcttattcaattttgtacaccttaaaattgtatttattcactcatcggtgtatttatttactaggagtagagcttttaggtgtttatgaaagagagctggcaagacatgaaaagagccgtcaggaactggctaacgctgagaaacttttcgatcttcctattacaatgtacccagagctgctgaaagtgcagaaggaaatgagtgggctgaggatgatttacgagctctatgaaggactaaaggtgagcatctccctgaaagcgaaggactcaggctcactgaaggggatgtaggaattacttaagccctgcagactttgatgccaccataataatgagcttgggtctgacgttgtggaaacgctcattttggccgcagggaagggggatggggagtgattgcttatgggtacagggtttccatttggggtgttgaaaaagttctggaaataggctgggtgcggtggctcacgcctgtaatcccagcactttgggaggccaaggcgggtgcatcacctgcggtcaggagttcgaggtcagtctggccaacgtggtgaaaccctgtctctactaaaaatccaaaagtcagccaggtatagtggcaggtgcctgtaatcccagctactcaggaggctgaggcaggagaatcacttgaacctgggaggtggaggttgcagtgagtccagattgcgccattgcactccagcctgggcgacaagagcgaaactccatctcaaaaaaaaaaaaagttctggaaatagatagtggcgctggctgtgtgacattgtgaaagtacttgatgccacggaattgtacattttatttttatttttgagacaaagtctcgctctaacacccaagctggggtgcagtggtgtgataataactcactgcagcctcgaagtcctgggtcgaagtgatccttctgcctcagcctgcaaagcagttgggactacagaggtgcaccaccatgcccagctattctttttttagttttagtagaggcaatgtctcactgtgttacccaggctggtctggaactcctgatctcaagcgatcctcctgccttgacctcccaaagtgctgggattacaggcatgagccattgcacccagcctggaattacatattttaaaatgattaaaatgacaattttttttttatgtattttactgtcatcatagaaaagaactctctttggaggtcaagggcttggttaaggcatggggtaaactgtttagttgcaagcggagattaaaagttgccgtgtcagcctggtgtggtggctcatgcttgtaatcccagcactttgggaggctgagatgggcagattacttgaggccaggagttcgagactagcctgggcaacaaggcgaaaccccgtttctactaaaaaatacaaaaaaaagttccgggcacagtggctcacacctgtaatcccagcactttgggaggcaaggcgggtggatcacttgaggccaggagttcgagactagcctggccaacatggcaaaactccatttctactaagaaatacaaaacttagccagatatggtggcacatgcctgtgatcccagctgcttgggaggctaaggcacaagaatcgcttgaacccaggaggtggaggttgcggtgagctgagattgcgccactgcactccagcctgggtgacagagtgagactctgtctcaaaaaataaaaataaaaaagttgcaaatgtcatgtcatttgggtgcctctcattggtatgtttcccatgcaaattcatgctattcattcatttatctattgacttagttctttatagctcagtgctgtgctggttggagtgtggggtccagaaaaggagtcatgtttgcccgttcctgcccttcttgagtccccaagggagactgactatgttagtctgggttcttgagaaacagaatcaataggagatatgtgtatctatatctatatctgtctatatctaatctgtatctataacctgtatctatacctgtatctatatctaatctacatctgtattacattatctaatctatatctatctgtatctaatctacatatctatttctaatctatatctaatgtatatctatatatctgtgtctaatctatacctatatctatgagatttgtgatgaggaattggctcctgtgattatggaggctgagaaatcccatggtctgcagttggcaagctagagaccctggagagctgatggtatagattctagtctgagtccaagtccgaatgcgggagaacactgacgtcccagcttgaagacagtcaggcacagaggttgcattccaccttcctcagccttttgttcgattcaggcctgcagtggattgagtgaggccatccatgttggggagggccacctgctttactcagtcccccaatgcaaacgctcatctcactcagtatctctcacaaaacaccagcgtccacttgacacacaggattcacctttgcaccgatatgtgaacaaataaccacgcccccaagatatgtgctggaaatgaggtggacagagtcctgagcttgcagaggaggaaggagagtggcccactggcccagggaatgctgctgaggaggtggcctgggagtgaggctcagaaccagagcaggcttttgcctggtgcagaacaaggctttccaggcagagcgctgggcaggagcagagacaggagatttgaagttgtgtcttgtgtccataacctttcatccagactggtggctttaccaaccatggatgcaccaggaaatggggttgggatgtgcgaagcggccggtggagatgaagccgtgagaagggactccggaggcagccgggggattgcaggcagggggtcctttaggaggtcactgccccagtgctggcagaagggatgggagcttgcattttaggacaattatagagggaatagagaggagagaagattccagagatggggtggaaagtgatgagacctggtgcctgcaccaggcaaaaaattcataaagttaaaaacataccgtcagcttttaaaaggaaaggtatcatgagaactgagaacaaccacacacatgtcaaaataagtggttttaaaatgtttaatttttctgggttcatagtaggtgtctatatgggatacatagatgttttgacacgggcatgcaatgtgtaataatcacatcacggggaatgggatgtccatcccctcaagcttttatcctttgtgttacaaacaatccaattatgctcctttagttatttaaaaatatacaatttttattgactatagtcaccctgccatgctatcaaatactaggtcttattcattctttctggtttttttttctgtagcaaaataagcatttttaaaaatccaatattgagacatagcttggtccccccagcctactctggtctgtggatgttaagggacatttcatcacctagagtgacttccactctccttgaaatttattttttcctagcaattgcttttcaaagttgtgtgctgagaagagtctcagtgacacactgggtggcttctgggaggctgggcaggggactgtcatcataatcccaggggatcctggggtggcagcggtgcaggttgggaagcatgggtggattctggatctggtttgcaggtagagtcagtgggacctcctggaggtgtggatgtgggatgtaagagcaagagaacaaggaagactccaaggtttttggcctgaggagccggaagagtggagtcactcttaagggaagactccaggaaaagaaggtttggggacgatggtgaacatctggaattcagggcaaggtgatgtctgctggacgttcctgtggtgatgttgaggaagcagcacttggatgtatttgtctggagctcagaggagagctggaggtgtgaattgggagtgtccaggtgcggaaggtactgagccaccagttcagatgggctcacctggtgccttcgtttcctggggctgccagaacaaatgattatgaatacatggttgtgaatacagaccaggaggctgaaaacaacagaaatgtatctcctcacggttctggaggccaggagtgcaaaatcaaggtgtctgcagggccacgatcactctggaggctgcagaagaggcttcttcttgcctcttccagctcctggtggcttttgactgtccctggcgttccgtggcttgcggctgtgttgctcctgtctctgcctccctcatcacattgctgtcttccctctgtgcctctgtgtctgttttctcttcttatacggacaccagtcactggatttagggcccactctaatccagtatgacctcaccctaactacctctgcaaagaccctctttccaagtgaggcttcattctgaggttctgggtggacgtgcatttttgggggacgctattcagcccggtacacttgggagtggggttggtggaggagaggagcgaggtctgagcctgggtctctccaacattaaatgccatgagaatacgtccctaaaaaaggaaagacgaggaagaggaggagtggcccaggtggtaggagaacaaacaggtgagtgtgacatcttggaaacgtgtttccaggaggtaggactggccaactgcaccagatgctgctgatagatcaggtgagaagaggatggaagattgatcacagtattgcatattgtggaggccactggtgactgcaacaagaaaaaaatcaatggagtgtggccgtggaagcctaaatggagcgagtccaaggtgtttacctgagagaagagaaagcatggtccttgcagagacttctgcatgaatgttcataaacagcattgttggtaatagcccaatactagaaacaacccaaatgcccattaagtgaatggataaataagctgtggctcatccacaccacggaatactactactcagcaaggtagaggattgaaccagttctcagcgcatccacgcaacaacatgggcgactctcagaatcgtcatgctgagcgaaagaagccagatacagaggaatgcatattgtattattccattcataaaaaaccctggaaaatgcaaacgaatttatggtggcagtacacagatctgtggttaactgggggtagggacaggaggagagagatgggaggggttatgacacagggaaatggggcagcttttgagggtgatgaatgagtttgctatcttgattgtggtggtgctttcacaggcatgcacacctgtcaaaactttgcagattgtacctttagttatggacagcttattatataccagttaatcctcaataaagctgttagaaaaacaggccaggtgtggtggctcatgcctgtaatcccagcacttggaggctaaggcaggaggattgcttgagcccaggagtttgaggccagcctaggcaacctagcaagaccccctgtctctgcaaaataaaataaaaaatatccaggcctggtggtgcatgtctgtcgtctcagctactcaggaggctgagatgggaggatcacttgaggccaggaggttgaggctgcaatgaactgtgatcacaccattgcactacagcctgggtggcagcgagaccctgtctccaaaaaaaataaaaataataatttttacattaaatctcaggaaaatataacacagaaaatcttctctttacaatcatcaagtaggaacatgtttttcctcacttcttagcctcaacctgatggtttgtaaacagattcttggattagtgatctagagtgtaaatattttgtaaccttagctgctttcatcagggaaaagaagcaagctatgacagcacctgaatgaagtacatcctttaagacccacgcaactccctgatttaaaaaacacctgttaattactttatacctctcacttttgtctttagaaagggaagatgtatttctggatcccacacatcctcagatacagcattatttttgcaaaagcttacaaaaagtggaattcttttcttgttgttttagatccttgtagtcaacctcttgtttgtgaatttcaggtagttgtagatagatgggtaatactttaaaatatctgaacgtgactaagagtcaagaacttgctctccttgttgcatttccaaaggggtctttgttgatggagctgttccttgcacgtttccaggttgcaaaagaagaatggtctcagaccctttggatcaacctgaatgtgcagattctccaggaaggaattgaaggttttctcagggctctcagaaagctacctcggccagtccgtggcttatcagtgacctactacttggaagcaaaaatgaaggcattcaaagactcgattcctttacttcttgacttgaaaaacgaggcactaagagacaggtttgttttgtcctctgtccgcagatgtaaaagtgtgggaggagcttttagttaaaattgtttccctcagtacattatctttggtctgatgatgaagcacacaatttcaacaatgccgcagggctatacatgggcacgacacagttctataatgttgtttctatgtaaagtgtctgtaaaactgtcaaccacaggattcttttaaaaaagaaagatcccagcaggtgcaaagtgggcgtttgcagttgcttttctcgaagatttaaaaaactatagtaagtgaccttgatcagccccatccagcagacatcaaacggaactcacatatgtaatttacagttttttagctgctacagtaaaagagtaaaaacaggtgaaattaattttaatagtatattttaattaactcaatatatcccaaacattatttcaacatgtaatcaacatgaaacatttattcatgagatattttacattcttcttaaaaaatatgtcaaagtgcaatgtgtattttatatctatagcctatttcaacctgggcttgccccgtttcaagtgctccatagacacgcgtggcttgtggccaccatactgatgggatagccagccctgtgggtgggacagagggggcatgggtctgtgtttatttggtgatggcaccacacagacacgaattaggagttacagtcctcatttgtgagttatgcttctgctcgtgttcctctattcctcggtcatgttttccaaagtgtggtcatctagtcatgccatgacatcaagtgacttcattttccctagtgagaaagtcatcccttctttggttcccttcctatccttgagttcacactgagaaagtctctcgtaagtgctggcttgttttcaacacctgttacatctgtctctccctctcaacaaggagcaggcagccctcaggccctggtgacgtggagtcttagccctcttttcactgtctgctggcttccctggagcactcacctttacctttgcaggcttcagtttcctcatctgtaaaactaggtagaagtaggcattttctagctaaagttctcggttttataatcccataacccagtgtttctcaaactttggtcctgtctcatcatttttgtcagatctgagtatcatctatgctgtcatggctttatatttttcttcctatcagtttcttttttatggaaatgaatgttattctaaaaataaacttccaccaccactgtaaagagaaaaccaaaagctcttgccagaaatagaaagtaattattaaaaaaaaaaaaactagctcaaaacagtcgcctgtctctgagccagagaccttcgctctaagaaaggtgaatgaccctggggagggactgaggacacagcgtaagaattaaagaaagaggaaagaaacacaaaaggtggcttgccagtcaaaacaggtttattttagagaaaacaaacctgagaggggattctggccaagttaggtcagagccacactctcttagagactaagagtttttaaggatttagggtgggagagcttatctgaggcttggactgcttctgtgtctctctgttgtgcttatctgggagggagagttgtgtgtctattcccattcatttttctgcagcagcaggcatactcgccgagtctgcttttagctcccctatcttagtgcacctgaagggaaaggaatgttcttattaaggtccactgttttactgggacccattgtataagggtgaagtttggcagttacccaagagacttcctcctctcctccctctgtgcctgagctgtcttgtctatgttttcctgtctgctctttctggtggcttgtagttagaagataagtgatttccttaaaatgcatgggctggaaagggagctggaccttaaagtggtggtgtttgtccaagatgaggttgctcctgctctgtcacacagaagcacaaagaggagactttcccttcgatgtaatttactgtaattgaaaggactgggcgggaactggagagggaatcactctctcccagtgactcagggctgagttatgttgagtgtggaccctctaatccaccaccagggttatgtcacaggctggccccaggtccgctctgcccacatgcagtccatcaatcgccgtgacatgggttttgcgaaacagatttatttgcaaggccgccaagcaaggaggcaggtgagcagccctcacatctgccttcctgaagataaggcttagggatgtttaggcattaggggagtggggtggtcgaagttgagggggaaggtggttggtggtgggaaaaaggaagtaacaggttcattctgagcaagtgtagctggggttcacagcatttcacaggacataggcacagaaagtgggggcatcggcatggcctgagggtagagtgtttggccttccaacgtcaaaaaggccacctctggggcacttgcacaggcccagttgaaaggtcagtggtctcaaccagttggaactggacagaggagttggttcaacttcctgaaaaacaaccaaagtcaccatcgccatcgtggcctgtgaatgttatccatagtagccagtgaaggttaagtttcagcgttcagtggtgagaccttcagcttcatgggaaaagggggaaaaaaataaaaagcaagtgaccataagccacagagcaggcactgatgacccttacccttcagtttcagttctgacaccctccttcctgtccgtgctgtgctaggccagggggttcagagaccgatgaaccagtagggcctcctttctgaccatttccatggccgtgtgtgtgtgtgtgtgtttacaacactcagtgattcaacacttgctgctcacgtgctgggtacgtggcgttctgctgtctagcgtcatgcttagctgccttactcacacccattccatatacacagaactaaaacatgggcaaattcacaggccaaatgcaaaaccttaaaggaaggccagtcaggtgaagagcagagctgcccccgttgtgtctgtgtgcacaggagtctgccccgactgtcccgtctgaatgggccccttcatacctcctctggcacactgcagttttctcatagtactcaaaaccctatgtcattatttaatttatagatttgttgattgtttgttgtttgtctccccaagtaagtggcaggttctctgaagctaggagccttgcccttgataactctgtaccccagtccactgcctggcacggagtcagcactgaaatatttatcaaatgcacgagagctcataatttacatgaggctctcaaaaaggctgagtgattcaacagaggttgaggtcattggttgagagactatgacagaagccgttcccaataattaaaagttgtgtattttatgagaaggccgtgaagactagtgtatagtgtatacagtattttgcaagatgttgttttccggtttaactctggaggccagtgggattttggagaactttgggaatatatttctaatgatgtcctcatgttgcagaatttcattataagaagtttacaaaatgagatttgtcctgtgatttaaatgggagtaattgaactcctcactaaattcagtaagcataaagatttgaatgctgatgtgctttcaggcattggaaagaacttatggaaaaaacgtctgtcttttttgaaatgaccgaaacgttcaccttggaaaatatgtttgctatggaactgcacaaacacacagatgttctcaatgagattgtcacagcagcaatcaaggaggttgccattgagaaggtaagacttcagttaaaaacaggctggagaaaacagtctttttttaattcaaagagaaaatagggagaactcatctatactaaaaaaaaaaaaaaattagctgagcgtggtggtatgccattactcccagcttcttgggaggctgaggtgggaggatcacttgaacctggaaggtggaggctgcagtgaactgtgatcgcaccatggcactccagcctgggtgacagggtgagaccttgtctcaaagaagaaaaacaaacaaaaaagagaaaacatatttgctctagtacctgctgtacttcagtaataaagaattatttgttgtagaaatagaatttccttaattaaattttttgttgttcccaattgtagtttcattttccattgtttaaaaaaattttttcttattgtttcttatttatttattttgccattgatttttaaatagatgtaatggatgttcatggtagaaaattgaaaaaaaattcataatcccactacctgaaaataattattaactttttagtgtatttctttgcctacttaaaaatgcatgcacacatgtatacatatgcatacacacatactactcatatatgtgcacatacacccatgcatttgtatgcactaacatacacgtacacaggtacacacatacacatatccctacacatatatgtatatagtcaggtgtcacctaatggcagggacacattctgagaaatgtgtcctgagttgattcgtgattgtgcaaacaaacctagctgggatgactactgcacacctaggctattgggtagaatctattgctctagactgcaagcctgtacagcaaggaactacattgagtacggccagccattgtaacctaatagtacgtgtgtatctaaacatagaaaaggtacagccaaggccgggcatggtggctcacgcctgtaatcccagcactttgggaggccgaggagggtggatcacgaggtcaggagatcgagaccatcctggctaacacggtgaaaccccgtctctactaaaaatacaaaaaaaattagccgggtgtggtgccgggtgtggtggcgggtgcctgtagtcccagctactcgggaggctgaggcaggagaatggtgtgaacccaggaggcagagctgcagtgagccgagatcgcaccactgcactccagcctgggtgacagagcaagactctgtctcaaaaaaaaaaaaaaaggaaaggtacggccaaaatatggtctaataatcctatgggaccaccattatatatgaaattcatcactgaatgaaacatccttatgcagtacatgactgtacatagtacaccacacatgtatacacacgtatatgcatgtagacacatatgcatgcaaacacacaaaatatacatacagtgtgcacacagtgtacctaacatatacacataatgtatacacacatgtacatatgcacataatgtacatacagtgtacctaatatacacacgtacacataatatatatacatgtatacatatacacataatgtacacacagtgtacctaatatatacatgtacacataatgtacactatgtattcgtatacacacgatgtgcacacagtgtacctagtatgcacacgtacatataatgtacacacatatacatatacacacaatgttcagtgtacccaatatacacaggtacacatagtatatacacatgtatacatatacacacagtgtacacaatataccaaagatacgcataatatacatataatgtacacatgtacgtatgtatacacatatacatatgtatcaatacagatttttttttttttgagacagggtctccctatgttgccaaggctggtcatgaactcctgggctcaagcagtctgctcaccttgacctcctaaagtattaggattacaggcatgagccaccgcacccggcctcaatatagattttttgttttgaatatggaatcataagaggcatatcattttgtaatttggtttttgtgacagtagagtaagcacaggggcagaatctcataactgtgcagacttcgggggcagactgtggggtttagaccctgtttctggggctcagtagctgagcttcatgtctgagccccagttgccatctctgtaaaatgtgggtgataataatccctaccaatatactttgaggtatttgctttgaggactgaatgagatcgtgtatgtgacatgcttacctgccacatagcgaatgcttgataagtggcaattattaccatgacagaatcccaacttttcaggaaacagacccaggactccgattgcattgttggccaaaagcaagctaaggaaggtgtttttgggttggggctcggtcctttcagttcgtgtgcctgaatcattctttttctattcctgaacaggctgtgaaggaaatcctagacacgtgggaaaatatgaaattcactgtagtcaagtattgcaaaggcacacaggagcgaggctacatcctgggttctgttgacgaaattattcagtctcttgatgacaacactttcaacctgcagagcatctcaggaagcagatttgtggggccttttctgcaaactgttcacaaatgggaaaaaacgctttctctaataggggaagtcattgaggtgagagaaaagatgaacaaaagatggattagagccagtgcatagcagtggcttttatatgaggatattttgtgcttagaacttttatatgaggatattttgtgcttagaaacaaatgatcctctttcatacttttttgtcttgatttattttgaggacaagagtgcatgatcaaaggaattgatctgaatttttattttagtgaatgattttcatttccaagattcctaattgcttctttttcatatatctctgtttttctttgatactgtcctgttcttgttgcaaggatgcttttgcctccttgatgacactgaaaattagaaacatacttattttacattccttttcgatttctctacactttttaaaaaaatgtctgttgactctctcttgtggtggtggattttcctctgtgtgattttgatttttttttctagctcatctcacatgtagtttttttcttgtgtttgcttcactttgtcatctgtttttgcagcctctttaacctgaggcctgtcacactgggaagtagcaaggtcttatagtaggtggtttggggctttcttccttttgggcaatacttatccagacctctgtgagcaacccaggctcactgcaccatttttgtgcagttgcctttttttcctccccagaccacaggcaagcaccttgtttttggccacaatccaagccttgggtgggatgaagccaggcctggttcactggccaactgtgtgatcaggcctccatcatgcctgggcttcctttccttgcttttttgtttgtttgttttgtctatgactttgtgttagtggaagctcttatgtgggatatagcactgttttttaatttgtgagtaaaaaacaatttttttttagatggagtcttgctctgtcacccaggctggagtgcagtggtgccatctcggctcattgcaacctctgccagccggattcaagtgattctcctgcctcagcctcccgagtggctgggattacaggcatgtgccactatgcctggctagtttttgtatttttagtagagatagggtttcaccatgttggccaggctggtcttgaactcctgacctcaagtgacctgcccacctcgggctcccaaagtgttgtgattataggcatgagccactgtgttcagtcaaaaaaaattttctattgaggtaaaatttaaataacataaaactagtgattgtaaagtgcacaattcagtgacatttagtacattcacagtgttgtgcaaccaccacctctaattccagattttcatcaaaccaaaagacaagccagtaccccttaagcagtcattccctaccatctcctcccccagcacctggcaacctccagtctgttttctgtgtcaatggatttacctattttggataattcatataagcggaatgacacaatatatgatcctttacgtctggcttttgtcacttagcgtgatgttttccaggttcttccatgttgtagcatgtgtcagtgcttccgtcctttttatggcccaataatattaaatcatgtggattgatcacatgttgtttttctatccattggctgatagacatttgggttgtttccaccttttggctattgtgaacagtgctgccgtcagcattcatgtacaactacttgagtccctgttttcaattcttttgggtcaatacctaggagcggaattgctgggcacatggtacttggctcactttttgagtgtctggcatggcctgtccttcgctgttgtgggtcacaggcttcaccctcttctcataactagaagttttcctacctgtgctgggctgcatggagagctttcttttgcttttgagtgtggccgttagttatgctttccccagcattcccattcatttggagtggaggggagctggccatgcagatgctcactctgtcaccttgcctggaaggtcctcccacctgagttgatttggttctgtctcatgtcaggatggggctttgccatccacttttggaggtatctgataacccctgctgacactgaccttttgtacatttacagatttggatgttggttcagagaaaatggatgtatcttgaaagtatttttattggtggagatataagatcacaacttccggaagaggcaaaaaagtttgacaacatcgataaagtatttaaaagggcaagtgactcgcttctattttagtaatgaaagaagggcagcgatttgagatatttgtacctttttatttgcacattgtattttctccattagtagcttctctctcattttttagagacagggttttgctctgttgcccaggctggagtgcagtgatgtgatcgtggctccctgtagccttgaacttatgggctaaagagatcctcctaactcagcctcccaagcagctgggactacaggcatgtgctgccatgctcagctaattaaaacattttttatagggataggatcttgctatgttgtccaggctggtctcaaactcctagcctcaactgactctcccacattggcctcccaaagcactgggattacaggagtgggtcaccttgcctggcccactagtagcttctgaatttttcgtgtcattatttatgaccctaatctgtctagtaaaaattcccatttgatttttagctgctggcatatgacactgaatcttttttacatttattataaaagcaatatttgcttgtttaaaatattttgaaagtgtagaacagtggaaaaatgtatctctcatggttctgtcactttaatgggaccactttaacatgtcaatatattccttttatctttttcctatgtgtataagtttaaaaagcataattgtaatcatattgtgtacaactttatatcataattttctcttaatattatgagaaacagttcatattaggaagtcatctgagaaaataatttcatggctctctatattccagggagtgggctgacattagtttagttgattactctccagtaatttgacattttgtttgaacagagttctttgctttcataaataatgtacaggttcttgcctaatgctttttccatagttagagtgaatgtcttaagatagattgttagaaagcaaattgcccgtgaaagggtgtgtgtattttaaagtcatttccaaaaagggttggactggtcatcacagtgactgtagttagtgtggctgggattttaacccagctctcctgctctcaaagcccgggtattttgctacttagctttgctgctgtgttctttaattataggtggccagttcatgttttgatctcttttatccactagagtttataactgtttcatataattgttgcataagctctttttttaaacttaaaagaattgtacaacacatatcaggctggacggtgactcacgcctgtaatcccaggactttgggaggccgaggtgggcgatcacttgaagtcaggatttcgagaccagcctggccaatatgatgaaactctgtctctctctcttttttttttttgagacagagtctcgctctgtcgcccaggctggagtgcagtggcacaatcttgactctctgtaagctccacatcctgggttccggctgttctcctgcctcagcctccgagtagctgggactacaggtgcccaacaccacgcccggctaattttttgtatttttagtagagacggggtttcaccgtgttagccaggatggtctcaatctcctgacctcatgatctgcccaccttggcctccaaaagtgctgggattacagatgtgagccactgtgcccagccggtgaaactccgtctctactaaaaatacaaaaaaaaaaaaaaaattagccaggcatggtggtgcatgcctgtaatcccagctactcgggaggctgaggtgggaggatcgcttgaacccaggaggtgaaggttgcagtgaactgagatcgtgacaccactctagcctgggtgacagagtgagactctgtctcaaaaaaaaaagaaaaaagaaaaagaagaattatacaacaaatatcaattcattacagaatactttagaaattacaaaaagccaagaaaaaaaagaaaggaagaaaaaaatacctataatccccttgcccagggtaaccattttaatagttgagcatatatctttccagaacatttattcctgcataaacatacaaatagatataaataaataaataacattctacaaaatatgattgttcttttttttttttagagacgaggtcttgccttgttgcccaagctggagtgcagtggtgtgatcatagctcactgcagcctccaactcctgggctcatatgatcctcgccttggcctcccaggtagctgggactgcaggtatgcaccaccacacccggctaacttaaaaaaaaaaaaattttttttttttttttttagtagagatggagtcttgttctgttgcccagtctggtctcaaactcctggtctcaaacaatcctcctaatcctcctgtcttagtctcccaaagcactgggattacaggcttgaaaatagaatcattcttaccaatgtcactggctatttttattgaacagtttgacctatttcaataaataaacattgaaattatcactcacagcagatgattgacctgttgctggacattgaggctatttctttctttttctgctatgatgaagaatgctgcagtgaatattctgtatatacaaattgctcacagtggaattgccagcttcctttactcagcaagtgttgaatgggcgcctactgtgtgtaagcacttctgtagggtggggtggggctcatcagtgaacaaaacaaaaaaatcctttccctgcgcagctggccttcttacgggataacgaaaagaaaaaccagaaaccagttagttacatgtagtacattagaaggtgctaaggatatgcatgtttaaaaatgataaatggatcccctgaaagccaatggcactgggcagcttgtcagttttgtctcggccgtgcctgggctctggtgagtgcctgttctgggctcaagaacagtgtctccgctctccctgctcaccctgcttgacggctgtcctctgttctggtccagatcatgggtgagaccttaaaagaccccgtgatcaagaggtgctgtgaagccccaaaccgcctcagtgacctacagaacgtcagcgagggcctggagaaatgccagaaaagcctcaacgactacttagattcgaagagaaatgctttcccaaggttcttcttcatttctgacgatgagttgcttagcattctggggagcagcgacccactctgcgtccaggagcacatgatcaaggtcagccctctgggtgtgcaggggctccccgtgtaagccttagaaccgccttcggtcctccctggttccctttgccatgaggttcaacccagagggttaagactgaaatgctgctggagttggttttttggtttgttttttgagacagggtctggctctgttgcccaggctggagcgcagtggtacaatcatggctcattgcagcctccacctccccgactcaagtgatctgccacctcagctgcctgagtggctgggaccacaggtgcacaccaccatgcctggctaatttttatatattttttggagagatgaggtctcactgtgttacctgggctggtctctaactcctgagctcaagcaatgctcccacctcggcctcccaaagtgggattacaggtgtgagccaccacactcagccctcgagttttaatttgaagtgtaagcctgatgatattcactgagtctgaaatcacaccagattcagctatttttccacagtccaaaacctttctttttataaactaaaaaaaaaaaaaaaacaaaaaaaccagaaatatatgaagactaatatattaaatagggaggcattagaggatagtggtttagcacatggactctagaaccagattgctggggttcaaatctttgctctattctgagtttctgtgtgatcttcggcaagttccttgatctctctggacatcagtttcctcatctgtgaatggacataaccccaatggttacctgtttcagtggagctgttgtaaaaatgaaatgagttactatttataaagtactttgaacagtgcctacctttcaatgttggctaaataaccctctccactacccagaattggcacttgttaccatttagtcatatttggtttgtctcttttttttgtaaagttgtacaaatttgcaatactttttgtccccatccccattcatacttcctctattttcttttctattttttttttttttttttgagacagagtctcactctgtcgcccaggccggagtgcagtggcgcgatctccactcactgcaagctccacctcccaggttcacgccattctcctgcctcagcctcccgagtagctgggactacaggcgccagccactgtcatgaatttgttatgattccttccagaccacaatttcacactttttaaataaatgtatatgtatccatgaaccatttcctgaatggcgggaaacaacagagaacactgtcccttgtgatagagaacagaggctggccagacatgatctttggcctgctaatcaaagctctttatctagcgtcagcctgggcaggggctctgagcctcggcgctgctggcatttggggctggatgactctttgctgtggctgctgtcctgtgcattacaggacattacgtagcatccctgaccacaacctactagatgccagtagcaccccctccctagttatgacaaccagaaacatctccagacattgccaatgtcccctggtggcaaaatcatccccggctgagaatgagtgttgcacggtaattcctccattccaaattaacagagcacttaggaacgagtgctttctcctattactttccctttaatcaatgctaacttccttcttaaagtaagattcatattttcgactgcatatttttcctttctcaaaggggaggcttcttcagtattctgtttccagttttttttttttttttttttttttttttcagacagggcgttgctttgttgcccaggttggagtgcagtggtgtgatcacagctcattgcagcctctacctcctgggctcaagcaatccacccgcctcagcctcccaaagtggtgggattacaggcatgagctattgtgcctggccttctgcttccactttgtaaacacatattttactgttgtagaaaaatacagtgttaggaatacttcatttactgttcgcctcttttgcaaacctctgtttttattctttaaagcctgtttgttgccttcctctcctctctgatttgtgagtgccttgtatatggtgggccctaaaggactcattgtcctaaatgttattctgattaataacaatgataatagtcaacaaatgccaagtgtttaacaacatgccagcatttgactcagattgtttcatttgattctcccaagcccaccttgttaagtgccatgattgtgtttattccaggcagagagaggaggagcaactcacccatagttgcgcaattggatagtggggaatctgggattccatcacaggtctctgttccccagcctggggtgttaatcacccttccgcctcctccacgttccactggctcctatgtccagatacctccccactccagcagggttagggacagagtctgctttttctttctcttttcaatcctccacagatctttgcacagtacagagtaaatgaaaatccccaataagtgtctttgggatgaccacacaggtgggtgaacgacatccatcttgcctgcgatctcggctcaccggttgccattgcttgcatcgtggcagctctgctggatggagcaccgctggctggtctttgattccagaactccgtgcaggtcttacagggctgcctctccctgtttgcagatgtacgacaacatagcatcactgaggtttaatgacggcgatagtggagaaaaactggtgtccgcgatgatttcagcagaaggagaagtcatggagtttcggaagatcttgcgggctgaagggcgcgtggaggactggatgacggcagttttgaatgagatgagaagaactaatagactaattaccaaagaggctatttttagatactgtgaagacagaagcaggtaaggctgcgaatgtggacatgcattgctctatccaattcatagtcataatggattaattttaaaggcttggagtagattggctgacattccaaatgaggttttgtttttttgcaataggtcattagtggacagatagatgtctttatttttatttttttgagacaggatcttgctctgtcacccaggctggaatacagtggtacaatggctcactgcagccttgacctccctggttcaagagattctcccacctcagtcttcagtgtagctgggactacagttgtgcactaccatgcctggctaattttgtacttttttgtagagagggagtctcactgtgttgcccaggttggtctcaaactcctgggctcaagtgatcctcccaccttggcctcccaaagtgctgggattacaggtgtgagccactgagcccgggcagtctttagcatatgtgctgccaaagcgagcacaagatagcagtctttcaatgatcacccgatgcagtactctcaaagtgtgccccctggtggcagcacagggcccctgggattgttagaaatgctgattcttgggtcttaccctgcacctgcccatcagaactctgggggtggggcctgaggatttgtgtttttgcaagctctcaggggattcccagcacccttagcgtgtgaacccctgacttagtgaaccaccagaaactaggcgtttagtgggattatgtgtatgtaacgttgtttctaaaatatttactgaatttccaacattctttgatttttgtggctagagaggcttcaggatatcatgctgagccctgcctgctcctagcagctgagtgcagtccaactagaaatacagaaagcctctttggctaacttattctattagattagacaggatcccccgtaaagttggagaatatttggcagggccttcgtgcagacatagaatctttcttgttattatgagaacaccattctcttgattttgtacactgcctttttgattttacaaagtgaaaacatctacttaaaaattattagcgaatagcataatatttatttgattatgatcctgctgtttccgaggtactgaggcatatcaaaaatttgtttgcatctttatgtggatatgttcagtggataaactggtaaaactggatgtctggaaaaaatttttttaaagctttgatttaaagcagttgccaatttccatggtgcaaatattcctgccatggctgatttcaaagctaaatgaaataagtggtttaacaaccagcttgcaaaattccagaatattcgacagttagtcttgtgacaggaggtggccctagcattcatttaactaatatttcttcaacccctgctctgggcgatttattatgctagatgctatttcaaaactgaactagacagaaatctctgccttctgtatgtattaatcactgaatgttttaaattatcttttctgctccaaaatactgtgaagtttacaccagcatcagttgattttattttcacgatagctaccactttgctagggcattgctatgtttggtagtgctgagttggtggaagagagtaagggaatgcagcctgatggactgaaaaagatctttttctcatccagatgctcctttgagcacgtgaacttgttgcttccaacagggagaatagttgacatgagcatgtggttttatttgagctgataggtgtggcatcactgagaagttagggccagctgtatctagtcccaggaagcacctttgccctggtcatttaatcttctctgatcctatggcctcagctgccacctctccgtttctgattctaggtttgtcgcgtcctttacaaggcccgtctttgttcatcatttcggtgtcgtcctctgggccttcgtaatctttgttgtctctctcctgatgtgtaggaatcatggatataagtgatctttaggttttcgctgcaccacacaattttaaaataaaacaacaaaggtcaatgttatttttattgcttttcctacttatttatttatttatttatttattgagacagagtctcgctctgtcacccaggctggagtgcaatggcgctatctcggcttactacaacctccgccttccaggttcaagcgattctcctgccttagacttctgagtagttgggattacaggtgcacatcaccacacccggctaacttttgtatttttagtagagacagggtttcgccatgttggccaggctggtctcgaactcccgacctcaggtgatctgccggcctcggcctcccaaagcgctgggattacaggcgtgagccaaagcattcggcctcctactcttttaaatttattttgccattaactgtaggtcatcaagataatgactatagtaatccgcagtcacttttccagtattggcattgtattactgtgttttcacactgctatacagaaatactcaagactgggtaatttataaagaaaaaggtttaattgactcacagtcacgcatggctggggaggcctcaggaaacttacagtcatggcggaagacaaaggaaaagcaagtacctttttcacaaggtggcgggaaagagagagagagaaggaggaactaacaaccacttataaaaccgtcagatctcatgagaactcactcagtatcacgagaacagcatggggaaaccgcccccatgatccagtcacctcccaccaggtccttccctcaacacctggggattatggggattacaatttgagacgagacgtgggtggggacacagagccaaaccatatcaggcatttacagctctgagtccattattttttaagtgcagtttagaaaaaaagctttgtctaaatgtgtctcaaggcaatcacaagctttgtaagttagtgcctctggagaggacatccaagtggccaataaacatgaaaagaggagaaaccccacgactcagcaggatctgtacattaagggaggatgagatgttttgtttcacttttcagactggcaaaaattcaaaagcgtgttacaacctggcctgcaaacctgggcagtgtggtcagagattatgaaattctttgttggaattttaattttctttcttgagacagggtcttgctctgttgccctggccggagtacagtgatgcgagctcggctcactgaagccttgagttcctaggttcaagcaatcctcccacctcagcctcctgaatagctgggaccacaggcatgtaccaccacatctggctaatttttgtatttttggtagagacaaggtttcgctgtgttgcccaggctggtctcaaactcctgagctcaagcaatctgccccagcttggcctcccataatgctgggattacaggtgtgagccaccgtgcccagcctggaatattgttttacttcttacataaacctcaaatactaagtaagtttgaaaacctataatcaaatattttattttattttattttttagagacagggccttgctctgtcactcaggttggagtacagtgcacaattgtagttggctgcggcctccaactcctgggctccagcgcccctggagtagctgggactacaggcatgcgtcattatgcctggctagtttttaatttattttttgtagagatagggttttgctatgttgcccaggctagtcttgaactcctggcttcaagtgatcctcttccttggcctcccaaagtgttgggtttacaggcgtgagctaccacgactggccccaaacatttaaaaagtgatctggcatctttctgtgcagtcaggtacctgcaacattttttgtggagagaggcaccctcggcctggaattttactacctagtcggagataggtaacatcttactctcacctaagtcttactcctctgacttacttaggtaaacaaatacaggcacttgcttacctaaaacctttactttgccctccctattccagatcaaagaaataaattcctgaagggactgttttgggtaccagtccccggattgatcagagcctcttacaggtgtgcgttttctgcagagtcgactggatgctcctgtaccagggcatggtggtgctggccgctagccaggtgtggtggacctgggaggtggaagacgtcttccacaaagcgcaaaaaggggagaagcaggccatgaagaactatggcaggaaaatgcaccggcagatcgatgagttggtaacgcgcatcaccatgccgctaagcaaaaacgacaggaaaaaatacaacactgttctcatcattgatgtgcatgccagagacatagttgattctttcataagaggcaggtgagcattttccggggtcactggcatttcaaaagggaccctttgtggtccgctgatctgtctcaacggtttccacttcctccacctttcttgccgtccagtatcctggaggcccgagagtttgactgggaaagtcagttgcggttttattgggaccgggagccggatgagctgaacatccgccagtgcacgggaacctttggctacggctacgagtacatgggcctgaacggcaggctggtcatcacgcccctcaccgatcggatttacctgacgctcacccaggtgactgccagcctggcacttgtggttaccacttaccttggggcggggcattttctctaagcttgaggtgtgatgactgcagtgattgaaatagcaggggagatcattgctttgaaatctcgaaaagcttttccatttgggatgtgaccagattgtcaccatttgggattggcatgtaagtgtggccgtgcttagccactggtacactggtccctaggtaatggtgtgtcaggggtattggtagaggccaatgcgaaaatgcaggaatgtcaaaggtggtgactgttagggcaagtgtgatgtggttttgcacgtcttgtgacagcttttattccagaatatatccgttcaagtgaacggccttggatgatagagatagtgtctccctccaggacagagggtaaacttgtttgttgtacaggaaatgaagataacacttccatccaggcagagcttgggaaggtttgcaagcaacccccaagactgtttgtcagatgcttgctagttttctttttttaaattagagatgaggtcttgatatgttgcccaggcttgccttgaactcctggcctcaagtgatcctcccaccttggcctcctgagtagctaggactatagcattcactgctgcacctggctacattggtggtctcttaggctcacagtttctcagctgtgactcatacccactgtggatgtggcatgcacctgggcccgtctccacatcacaccatgggatttggggggacaaggataaagggaatgagtgagaacaggaagcccctgctgcctcctgtgctgtgagtgataaagtcctttgtttttgagaaaaagagtgtcatcttatctgtattggttagggttccacagagaaatagaaccaataggacatagctagctagctggatggctgtctgtctgtctgtgtatctatctatctatctaatctatctatcttatccatccatccgtgcatccatccatctacatatccatccatccatccatccatccatccatccatccatccatccatccatgtatctatccatccatccatcctattatctatctatctatctatctatctatctatctatctatctatctatccatccatccatcctgtctatttatcatctcgatcatctattttatctatctatctatctatctatctatctatctatctatctatctggatatttaggaggagatttattatgaggtattgactcatgtgatgatagggtctgattactctcacaatctgccatctgcaagctggaggaccaggaaggccagtagcatttgaagttctgacagtgagagagccaatagtgtagactcgtgtctgggtctgagggcctgagaacccgaagtgccaagggtagaagcccagtgccctggctcagtcagtcaggcagcaccagtgtaacctccctccatccttctgttctgttcagtcttcaatggattagatgatcaggcagcaccaatgtaacctccctccatccttctgttctgttcagtctttaatggattagatgaggcccacccactttggggagggtcatctgcttttctcaaatgctaatctcttcctgaaacacactcatggacactcccagaaataatgtttagccagctacctgggcatcctgtggcccagtcaagttgacacatgaaagcaaacaccacattctttctctattctgcacctatagtcacagtgatgaatttggaaatgacacccacttccttctgtgcaccagaaaacatatgttttgcatttggcttataacaggcgctgtccatgtatctaggtggggcccccgccggcccagcaggaaccggcaaaaccgagaccaccaaggacctggcgaaagccttgggcttgctctgtgttgtcaccaactgtggcgaaggcatggattacagggtaaggcctggctgtcacctttggtactggctcattaggcagagagcttaaagcaggacatggcatttcacctcctagtctttgacatggcgacagtggaagaagctagtagaaaaccttccaccaccacagccccagaacctaagtgtgtctgcttaaagaccctgctttgttagcaggatgtagagcaagagtcccggattcactaccctagtagggtcaggttgataatgtacgtgagtaaagcggccagcagacaagagagtggtgggatctgtggctaactggagagcaaaagtccatctaaagagggtgcccgtccagctttggttcataatcaccatttgggaaagtggacccagcattgctagattttcccacatttcaagagaagagaagagaaatggagttttacacaaaaatctggatttgtaaaatcccaagtaggagccagcccatgaggggccttggaagtcctgccagaaaaatccactagtcaagtggctggtcacctgcttctctgccaatcagtgatctcattgtttgctttaatttagaaaatatatccataaatgtgttgcttgcagttttaaagatgaaaattgcccttgtcctgacatgtctttcttcctaggccgtggggaagattttctctggcctggcacagtgcggggcttggggctgctttgatgagtttaatcgaatcgatgcttctgtgctctccgtgatctcctcccagatccagacgatccgaaatgctctgatccatcagttaaccacgttccaggtgagacacatgaagcccccgggaccatgtccctaggatggaagtttgccaagtatggtaagcttcctctgtagcgtcagtttctgggccgttgacactccagaccaggcttcctgtagaagatctgttggtttttccaattgagatgattgggtttccaaaattatcatcattgatgataaggtttgtaatagtccaaggacttcacactgactccagacacagaaccaatagttatgaatgggcgtggggcagagttctcaaataagtgatgtgcagggtcccctagaaaggaaacaatattcttggcgacttcccaagtttgagaaaacctgacttagaaagcgaatgttccttgcaatcattatcacagtgaacaagaaattttgccttcataccttgtgaagttacggcatcataacaagcaggatttgcaaggttatcaaagtgagaaggcagaattttaaaacaattgttgagaattcaccaatttctctctgccaaagaatatgtttgcagacttgagtttgagaagtctgcattaaattacaccagattaagctggatccaaatttggagaaacatgatcttattatgtaatctaggtggcccagaaggggattctctgaaaacacaggaccagcgtgggtgggccatttccctacaccggggtcttctgggtcccttgctgtccttctgcctctgtcctcccccctccatgccctgcacacttgtcactaagccacttgctccacagtcataccatgccttgtgacaccacatgtgtccccatctgagtggaattgtcccttcttcccttcactggaaaactcctatacatcctttagagccccattccaggatgaaaattcagcttgagctggtggccctgtcatctcacatgcgtcctcctcagatcttggcagggctcactgttaagagattgtgtcagctggagactgttcaatattttcaggattccagtaaagggtctggatagatttccctttgatgagttcttttgagggatttttggggctgagctgactgctcccgagagagggaattaacctgcaatgtatatagatttccagaagctgtgtttctcagagccaggaggcagcagctatctgctcttccccctgggccatctgggccatctgggcctcttgtgggatactgaggctagggatggtctcagggccgacctatgagtcaaggcagtggccttgttttgggggaggctggctgtcttccgggctgccctctcgttggtgatgcagactgtgcctcctaacaacaaaaattttctgtcctctgcctggctggtggacaatcaaaaaaaataaaatagaaaacttcaccgagagacgaccggactcaaccttcagctaaaaaggctaagaatatagggatttccgtggtttgttggtacctggggcaaccagaggaatgaagactggtttcttgaggggtttgaggtgggattctttaggcaggagtgactgcatgaagtccaggcacccgcagaaggtgcaaagccaggtgagaggaatggaagccggcgctgtgtgaggtggtgggctgggcgctcccaacctgggctgtctcctttcatcgccacagccgtgccacgaggtgggttgcatttctgttgtgcagaaaaataaactgagactcagagaggttaagtgacctgctgagggtcacacagcttcttgtatcagccccagactctgtgcttcgccaacctgggccccttctccaaggtagtgccctgggttcaggtctgagtttggggttccactgagacctgccctccccaaggccttcagcgaggggggccctgcattgaacaccggggagggaaaaagagacaagtggtgttgtcagcctcataccatgaaaatgaatcgccacgcagctcgccgcaggccccctttccaaggggctggccggccgggccacctaactgcttctttctttcttccttcttgccctccagtttgaagggcaggagatttccctggactcccgcatgggcatcttcatcaccatgaaccccggctacgcaggccgcacggagctgcccgagtcggtgaaggcgctgttcaggcctgtggtcgtgatcgtgcccgacctgcagcagatctgtgagatcatgctcttctctgagggcttcctggaggccaaggtggggggccttggcagcgccaggtcgtgcagtgcagacttcacccgggtctgcttccagactggggacctaggacgcgttagctccgtgtggctcttccagacgggacctaggatgtgtcagctccatgtggctcttccagatgggacctaggatgtgttagctccgtgtggctcttccagacgggacctaggatgtgttagttccatgtgggtcttccagactggggacctaggatgtgttagctccatgtggctcttccagactggggacctaggatgtgtcagctccatgtggctcttccagactggggacctaggatgtgtcagctccgtgtggctctttgatttttgttttttttttctgctgtgtctctcttcttcctcccccacctctttttaaattataacttttaattttggaataatgtaagatgcacaagaggttgcaacaatagtagcacggactttccaggtgccccttccccatgagaacatctcacatagccacagtccattgcccaaaccagggagttggtgttggcacaagtgccattaactcaggtgtagacgttgtgtggatttcaccaggtttcacattctctctatggcgtgtgcgtgtagttagttctatgacgttttatcacatgtggatgggagtggccgtcaccacatcaggatacagaactattccatcaccacgaccacaaagaagagagacagggtcttactctgtcacccaggctggagtgcagtggtgggatcacagctcactgcagcctcaaactcctgggctcaagtgatcttcctgcctcagcctcctgagtatttgggaccacaggcagatgccatcacacctggctaatcttgcttattttttgtagagacagggtctctacagcccaggctggtctcgaacttctgggctccagtaatcctcccacctcagcctcccgagtagctgggactacaggttgtgccactgcacccagcctcatgttactgcttactagacacattctcccctcaaccctaactcctgcaacccctgatctattcttcagtcagtgtaattttgtcactttgagaatgttctctacctggagacatgtagtatggaaccctttgagacgggcttctttcactcagcacaatgcctttgagaatatgtagattcaaaaacaactttatggataacttttatcctcttttaagctatctataaaatgtacatacgtaagatctttccagaagctctggaaaagttacaaaatagagaatacttttaacatagagggttgtcacattgcgtttctgcaatatgtcttttattgaaagctcttggtgcctattaccgtgtcaggattttgagttggcacgatgagatctcttgttcctagttttcacgactaaaattgccacacttgccttagagacctgtgggttttgaacccttgccatagatgaggtggctgacttgtcctcaaagacatttacagccttttttttttttttgagatggaatcttgctctgtcacccaggttggagtgcagtggtgtgatctcagctcactgcaacctctgtctcccaggttcaagcggattctcctgcctcagcctcccaagtagctgggattataggcatgcgccaccacgcctggctaatttttatatttttagtagagacagggtttcaccatgttggctaggctggtcttgaactcttgacctcaggtgatccacccaccttggcgtcccaaagtgctgggattacaggcatgaacaactatgcttggcccagttacagccttaataataggtttaggtcaaaataaagaagcaatgtatttctggagtgtgattcctacagatggttctgttctttaaattaagatagtgaagattttggtaacacagatgtttcttcaaattagttcccaatttgccatatttaaaaatgaaggacccaccctggtatttctggaagttagagatggaatttgcttatttgtagagcagctgcactggaacacctgcccccgttttcttgcatttgtagaatgatgctccattgcttttgaatcattttcttttttctttttttttgtattattatcttctatcaaaaagactctggcgaaaaagatgacggttctgtataagctggcccgggagcagctgtccaagcagtatcactatgattttggactcagagccctgaaatcggtgctggtcatggctggtgagctgaagagaggctcctctgaccttagggaggtaggggccacgtgctggaacattctctggtttcagctgcttcaggcatttactacgtgccattggggaggtgatgggcacagtatggtatcacctgaaaggtttaagtcttagctgcctcttcaccccgcggtctggccttactttggcctcttacctgttgtatcgtttgcttgtaattacacttagtaccttaaggtcaagtgcaatgtcttcgctccaatagcaacatttatgatgcttccatagtaataatctgtagtctcaggatgggtgtggcggaagggtggggactaacaaaattctcatgaaagcatgaaggtgagttgttattttctctttgaaacaaaagaggggaacaattgtgttttttttacatggactttaaataaaaggtttagtcaatgttctgtgggcaacaggcttacctgtttctctagtgactgtactcaatgttgcacgcacacacgcacgcacacacacgcacacgcacggacacacgcacgcgcacacacacacggatacatgcacgcgcacacacgtacgcacgcacatgtacacatacgcacacgcacgcacacgcacacgcacacacacacacatttgggtagtaaaaaaaaaacagccgtgagtgcagtgatagaagcctgtttgtgtccataggaggagaggctgccacaaatcgcttcattcttttgggattttcacacatttgggttttttttttttttttttttggaggggtcgaaggaagagttatttatgctcttacaaaaaaggaagctgtaaaatgtaaaacactataaagtcagatggagctgcattcgtcatttgtacttcttttttcttaggagaaaggagttatatggaaacttctttcattttctcccctgctcctctatgtccaaagttgaagggcgatcatgctattgagtgggtcatatcttctgaactgaaaaaccaccgatgccactttcagtcttagcaacagggaaaacagtctcaagtgctatctaaggctctacgaagaagagtgaggccgtttgcagcagtctctcctcctagggcggtgaatatggtcccatcactgcactcactactggcttgttttcttttactgccttacactgaacccaagcatgcattcataggctcaactgctgcacaatctggtacttccttagaagaatgaaaacacattgcaaataccgaatatccaaggacttccgagaaagaggtaaaaaacagcctccttttctaggaggaaaatccctcttctcatccagcaatgtggacttacacatgtaaaactgtgtttgtacagagactgcgatggtttcttcacataggaaattaactttgctgtattgtctttgggcttctttatcacattaaaagtttgcaagcttggacctttgttcttattcagtaaatctatgtcacaggatgagtgaggatttagcatcttttgcttcaaattagaaccacatatttggaatttactgctgcagttctcagctgcgcttatcatgacagtggtggaaactggaggacattaaaaagcccatgaagtcagctgtacttgccatttatttagtcttgtttggaataaaaggtaaagaattcacaaataccaccacctcagcacctgtttcaaaggaaacatcaggcttcagcttgcaacatgatgtcgttacaattaagcaaatagcagaagcccccgtcagttgcttccttcttctggagaaggcggggaactgcaatccccggggctcctgtgttgagtctgggaggcagaacaaaaggaaaagtggccttttccactccacatcctggaggtaatgggtagagaagacatacccacatttccagatagtgaacgctgagtagagaagcaggactacctgtcctaggagacaacatagagacgcttgccaggtcctgagttcagaattttgtttttgagatttatataaaagcacctaaggctgggcgcagtggctcatgcctgtaatcctagcactttcggaggctgaggtgggaggattgcttgaggccagaagtttgagaccagcctaggcaacatggcaaaaccccatttctttccaaacaaatacccaaaactaaaaaatttagctggctgtggtggcacacttctatagtcccagctacttaggaggctgaagtaggaggattgcttgaacctgggaggtggaggctgcaatgagccgagatggcactattacactccagcctgggtgacagagcgagaccctgtctcaaaaaaaaaaaaaaaataataataaaaagtatatatatatatatgcgcacctaaaggtcaaagtaaatgttcttcctgtaataaggaacctttgctttagcgtagatggccatacccctctgtaaggtggggaggaggaagtttctgctccttccctctggccgagatctgttttcttctccttgcacggcccaccaggacactcagcctcctaggagcaggcccaccctggcctcactcctctgcctgtgctcctattttatattttatttaatttttacatttatatacaattttgtattgtatatttcacttttatatattttattttacatttttattttcatatgaaactttgaaaaatgcatatttacatttatattatttatatgatcattattaaatatgaaatatgaaatttcatatattcatattacacataatatcttatacatattttatactatataatatacataacattttatatacatttataaatttatataatttataaataatacaaatataattaatttatatgaatgatataaaatatataaattttataaaatttaatttatataaaattgtaatatatgtatataatttatatataattttatatttcattttaaattttatatttcatttaaatatatatgtatgtgtatatatatgtgtgtgtgtgtgtatatctatctatctatctatctttttttcgagacagagtttcactcttgtcacgccaggagtacgatggcgcaatctcagttcactgcaacctccacctcctgggttcaagcgattctcctgcctcagcctcccgagtagctgggattacaggcacctgccgccacacccagctaatttttgtgtttttagtagagatgtgatttcaccatgtcggccaggctgatctcgaactcctcaggttatccacccacctcagcctcccaaagtgctggaattacaggcatgagccactgcacccggccatatatgtgtatattatataatatgaagtacatattatatgaaatatatgaaatatatattttatattttatgtttaatctcatgtaaactattttatataatttatatttatttacatattaatataaaataaaaaataaaattatataatttctgtatataaaaatatataatacatatattcagaaattatataattttaaattaatttctgtaatttaaatttaaattaatttaaattaatttctgtaatttaaaattatgtaattttaaatgtgtataaaattgttaaaaataataaaatgtttatataaaaattatattttatatttcataagagtgttaccactgggttggaaacacagtccaaagcactgggttcctttggaaatctcttggaaacatgtgtttcatttcctgcaggacgtggtgctgatgagggccttgcgagacatgaacttgcccaaatttgtgtttgaagatgttcctcttttccttggtttgatttcggatctgtttcctgggctggactgccctcgcgtccgctaccctgacttcaacgatgcggtagagcaggtcctggaggagaacggctacgcggtcctacccatccaggtaaagccaggaaaatgacctcactgtggccgtgcatcctttccattggctttttgtttttgcagttctttaaaaatatatgtacagtaaaatacgcataagtttcaccatcttaaccatttttccccatttttaaatcacagtaaaatacacataacaatatttaccatcttacctacttttaaatgtagagtttgttaggccgggcacagtggcttacgcctgtaatcccagcacttcgggaggctgaggcgggtggatcacgaggtcaagagattgagatcatcctggccaacgtggagaaaccccatctctactaaaaatacaaaaattagccgggcgtggtggcgctcgcctgtagtctcagcttcttgggaggctgaggcgagagaattgctggaacgcgcgaggtggaggttgcagtgagccaagatcgtgccactgcactccagcctggtgagagagcgagactccgtctcaaaaaataaaagaaaaaagaaaaaatgtagagtttgttggtgctaagtacattcacattactgtgcaaccatcagcattatccatctctggaacgttttcatattgcaaaactaaaaccctacacccgttaacagcttaccttctcccctccctccgctggcaacctctgctcgacttcctgtctctacaaatttgactactctaggtacctcctgtaagtagaatcatgtaatttttgtccttttgtgtctggcttatttcactaacagtgttttcaacatttatccatgttgtggcatgtgtcagaatttcttcctttttaaggctaaattttatatatatagttttttttcacacaatgtgatcaggtgactcaaatattttgttttgaggcatcaaccatcagaggttctttcctcacctcaccttttttttctcctgagtcacacttaaaaaaaaattaaattagatattgcagggataggatttggatcctctgaagcctgtaagttgtatatgttgtcattaagccaaacacgtattgattggcagagtcctgctgagagtgtaaatgcccagagcctccagacctggggggttgcctcgggtcgggcagcttcagggtgtcaggctaccccggagacctcaggcctgggcagtgggcaccgggtaccggccgtggacgagagctttctgtgcttttcctgaccctgattttctctggagttggttgttgaaaaagatgtgttttctggaaggaatataaaatggtgcagccactttggaaaacagcctggcagttcctcaacaggttaaaccgagagttaccataagacccagcaatttcactgctggggatctacccaagaatgaggacgaacgtccgctcagaattgttcatgaatgtccggagcagcattattcataatagccaaaaagtgggaacaacccaacatccatcagttgatggatccactgctgaaacagaatgtggtctgtccatcccatgggatatattttggccatagaaaggaatgcagcacgcgtgctacaacatggatgagctttgaaaacatgctaagcgaaagaagccagatgtgagagatcacacattctaggatcccatttccatgaaatgcccagaatacgcaaatccgtagagacaggaagtagatgagtggttgccaggggctgggggaaaggggattgggagagatgggtacagggttttttgtggggaggggtgataaaaatgttctaaaattgctcatggggatggttgcacaactctgtgaatatactggaaaccattgacttgtaccctttcaaaggtaaattgtatggcgtgtgtgttgtatcgcaataaaactgcgtcagaaaaaagataatgttttagcccagctgccattgtttgtcccgcaggtggataaagtggttcaaatgttcgagaccatgttaacccgccacacgacgatggtggtggggcccaccagagggggcaagtccgtcgtcattaacactctgtgtcaggcccagaccaagtgagtatgacctccgtagggagggcctggctgccacaggggctcacagtatatgtttggtgccagtattaccaagtcccactttgctctctgatttcctgggagggtaaatttgtaatacacacccctttcgactcagcgtgtttttactgactttattgcagacttagttaagatattttagaatgcaaaatagcaacccgcttgtgcatcagatggtgaataggttcatttgtgaaatgagaatttcacaaactatcttataaggatattttgaaaatgaatgtaagtcatagtttcttggggtccaaattgcttccttaaagtaagtcaggattcaccttatgcagtactgctgtggtttcgcagtggccagaaaacgaatgtcacctccccgggtgccttataatcgctagcccttcgggggcaattcttcacgaaggaaaaagtgatcgtacactcccacattgaagatcgtaaaggagccaggcatggtggctcacgcctgtaatcccagcactttgggaggcctgggtgggaggatcccatagtccaggattttgagaacagcctgggcaacataatgagactccgtctccacattaaaaaaaaattagctgggtgtggtgatgtgcacctgtagtacagctactcaggaggctaaggagggaggattgcttgagcccaagaatttgaggctgcagtgggctaggattgtgccactgcacaccagcctgggcaacagagtgagaccttctctctaaaaaaaaaaaaaaaggagagtatgtcataaaagcctgcagtgaattgaaagccttctactgaaagtggattcctgactcctcacttctcttctaagcaataactagattccagaaagacctccgtggatgctgatagcccggcaaaaatctaaatcaagccaaagtttctgtgacttaaacatttctaggcagtctataaaatctaaagagtaagtgtctgtcatatgttcccattatttcttcatatgtttcatatgagaaaaccagtcgacagtggcttactgactctaagtgggctgtgccgtggccatctgcatttcattctttaattcattcattgtaagtttatagaactatcacacagttgtatgcatgtgtaatatagcatgtacattatgatttactgattcgttggttgtgaactgtggagtgtgtgaagttttgttctctatagatgaattaatcctatagttagtgctgcagggatttacaggcactgtggtgagaaatgccctgtctgcttgattcatgaagtcaacagagcagctgttgttctgtagataaggaggattgaacattagtagtccaaagccttgttattatcgtggatgactgagtgtggtctcctatacgcccttaattctgagatatttacttaaatgtcatatatatgaatatgtaatatgcataaatatgaaatatacatgaaagttagcttcttggtgccctccagaggcaaagctgtgcttctagttcagacttcatttgtgctgtggccacatttttggtgaaatgtggttgctttatatttagaagaaagcactaacagtgaagggaagcccagtgaagagtttgcatgggttgcattttcaattttggattaaagtcaaaacatctaattcctcatagagggaacccagactgttttcctcatgcatttagttgtcttgaaccatggctaaagcctctcttgatttaggcttgggctgacgacaaagttgtacatcctgaaccccaaagccgtgagtgtcatagaactctacggcatcctggacccaaccacccgagactggacagatggggtgttgtcaaacatcttcagggaaatcaacaagccaacagacaagaaggagcgaaagtgagtatctttgtaggtaggaaagagcctgggttagttaatgttaattagctcaacattaaaaacggtggcaggactatacattgtagcttcatgcttggatttcaacagacttagagtccagtcttggaggctgtgcttcggaagtgcgcagtccaatcttagtgctttttatgtgtgacctcagttgtcttagtgatgcaatgtggtaggtaccgggattgttcccagcttaccacagaggaaactgaggcctagaaaaggtcagaaatgtggcccaaggccagggatttggccctgatctgtgtgactctaagttctcaaacacagccgccatcaagctgcctgatcaccacgttctatggcaaggtaagtcaaggaaaggtagcaaagggccatggaaagtgcaggaatgccctcctgagccacggctttccatctgtagacgtggttgatggtgccctgatgacatcaccacatgccatggcaaaggccaagtgaggccaagtacagaaatgctctgagggtgtgtaaggtaaaaagcttttagttggtcctataatatctctttgctaaactcaggaatggttctgattttatgttctaatcaaatcccattaataataaataaaatccttaaataacaagagtccaaagtcccaactcatggcttttaaaacagcttcttagcgcttttcccctgattctggatgaacccaggattccacgctgaattccgttgtcttgtttttggcattctttaattttgagcagttcgtcaggatttctttatcttttatgaccttcctgttctggaggattccaggccaaccgttttagagaatggtctcggtttgggtttgtccgctgcttcttcataattagattcaggccatggctgtttgacaggaaggctgcaggagtgatgctgtgtccttctccgcatctcatcacgggcacatggtgttggttgccctattatgggtggtgttaatcttgattattgggttaaggtgccattttcctctttgcagttgatatgcaactctagggagataacttatgactaagtaaatatcccatttctcatccaaccttcacccattcacccaatggtttggagcatctgttgatggttacttgaatctggtcatcctcctcctcctcctcctccttctccttcttcttctcctcctcctcttcctcttcttgttcttctttcttcttttctttttttttgagaggggtcgtgctctgttgcccaggctaagttcagtcacatgatcacggctcactgcagcctcaaactcctgggctcaagcaatcctcccacctcagccttccaggtggctgggactgcaggtgcatgtcaccatgcccagctaatttttgcttttttttgtagagacagagtctccctgtactgcccaggcttgtcttgaactcctgggcccaaggaatcctcctgcctcagccaactacagtgctgagattacaggtgtgagccaccatgcctggccgttgagtccttttatagtgaatataaatggagactttctatagggacaactggtgaaatttgaatgtggactatacattagataatagtattgtatcaatattacatttcctgagtttgataattctgctgtggttgtgtaagagaaggtgcttattcttaggaaatacttgcttaagtatttaggggaagggggcattttatctgcaattgactctcaaatgattcagagagagagaataagagagagtgcgaatgtggcaaaaaaacgtaacaattggggaatctgactgaaaggcatatgggagttcttcatactgttttattctcataactctgtaagtttgaaattatttaaaaataaaaagctaaaaggaaaaaaatacaggaaggaaataaaccaaaatgttaatcctggaaaaaaaagatctaactgcttatatcagtgagttaaatggaggcactatcaaaccaccatttcagcacagtagaatagcctctgtcctgtggagatgggctttgctgcatgagatgtcacccattatagccacaaaatggaaccatcctgaagcttgaatacctgaggccttggacgtagacgtgctgccaggacacatggtgtgtaacccagggcttgtgaactcagatgctcccagggacccagcaggtagcacaaatgagtgaagtggagcaaattacatggtggtgttagtttcctagggctgccataacaaataactgggtggcttgaaacaacagagatttattatctcatagttctggaggccaaaagtctaaaaagaggtgtgagcaggactgcactccctccgaaggctctagggcaaatcctcacctcttctgcttctggtggttccaggtgttccttggcttgtgaccacatcatttcaaactttgcctctttcttggccttcccctctgtgtgtcttatgtctcctcctgcttttctcttataaggacatttgtcattagattaggactcatctgtataatccagaatggtcacatcttgagatccttaattgcgtttgcaaaggcctttctccaaacaaggtcacagtcacagcttctgggtgaacacatcttttggtggggggtgggtaccattcgacccactacacatggacatccaaaatactttctttattcttgactgtaccacaggaaaccaggggttaaaaccagtgataaatagcaattgatactcagcctcagatgtaagagaagaatgaggtaggagttgtggcaggggcagggactatgacactttctgtcttcatgggcagccactactcagcatcagctgattgttcccacgaaggaatccaggtctgtgtgctcagaacttccagcttgcccaagaagtgagaaattcagatttttgtgtgaagttccctcattcttaaatattggcaaagaactcaaacttttttttcttttttttttttttttttttgagacggggtcttgcactgttgcctgggtgggagtgcaatagtgctatcttggctcactgcaacctgtgcctcctgggttcatgcgattctcctgcctcagcctcctgagtagctgggattacaggcacacaccactatgcctggctaattttttgtatttttagtagagacggggtttcactatgttggccagactggtctcgaactcctgacctcgcgatccgcccaccttggcctcccaaagtgctgggattacagttttttatgtaccatttcagtcaaacctctgggccaactagggtgctctgtctcagatactgggtagaaaaccctgggaaaaagacattcaacatgaatgggcaggttataccaagttccataattggaagctctctaggacccatggctctcctttctttggttgctgcaggtatattttatttgatggtgatgtggatgctctatgggtggaaaacatgaattctgtgatggatgacaacaggttgttgacattggccaacggggaacgcatccggctccaagcacactgtgccctgctctttgaggcaagtagtgattaaaagtaaatttgaacataaatctttcttgtaattaaaaatgcaaatgtttgttaaagtagtagtaaatgtagatgattatttaaaaacaaacaatgcataagggtttataatgaatacaactctttgttctttactcctctcatccctctttatcccagaagtgactacttttactttttatgaattgtttcttctgatgattaccctagtgtctataagtaacaggcttagcatgatattcttcctttatacattttatagtttatacattatctgttgactgactgctacaaaagtgagaattcatctcttataccactaacgtcagaatagtatattgctaagttggttaacagtagataatgtttacattataatgaagatagaaataatttactgaagaaccaactaatatactacgattacatttactttcttttagagccatttcctttgtctagagtttgtaattgccttcctttttttccctcacactatttgcctttattttaatctcatttttttttttaaactttctatcatatcaagtattctgtcgagcccctttatttcctggaggctattctccaaagccctctatctcttaggatatggactgctcgtttcataggtgtggccctgggacttgctttcactctagcttagtattaatgccatttctaactgtaaaatttgtcagtgcatgaaatatttgtacatattattatctgattagctgactgaactatattttttttgtagagagagctaggtttgttaatatatctggtttagctttgtacttatgaagttttatactgcctgatctcaactatgttaaaaaaataataaagaaaaaagattgactggaaaacactccaaaacaacatttgtttctgggtggtgggatttggataacttattttcttctttatatttttctattttttgtcagatattctacaacgtattaattttcacattaattttataatagaaaaaccaaaaagatgttacatcagaagtgtgtaatcttctcatcaaaatcccaggtgttcagttaaaaagctcatggaagctgtgttgattttggtattatttggatttcatgcagttgtaaaaactttccataagagaaggtccttaaacatctagtttatcttgtgtatagctatagccatgattgattttctttatttatccaggttggagatttacagtatgcctcccctgcaactgtctctcgatgtggaatggtttatgtggatcctaaaaacttgaaatatcgaccatactggaaaaaatgggttaatcaaataccaaacaaggtgaaatttttttctaaaatgaacttaaatttattagtattgatggctagttggataacatagtccagagggatgtttgtagttgaaggcgatgactttgtccttgacctgcccatgtccctgagcacaaaataagtgaaaacatggcagacacactttttttttttttttttttttttttttttttggagacggagtctcgctctgtcacccaggctggagtgcagtggcgcaatctcggctcactgcaagctccgcctcccaggttcatgccattctcctgcctcagcctcccgagtagctgggactacaggcgcccgccaccacgaccggctaattttttgtatttttagtagaggcggggtttcaccgtgttagccaggatggtctcgatctcttgagctcgtgatctgcccgcctcagcctcccaaagtgctgggattacaggcgtgagccaccgacacaccgacacacttatttaatttcagatagtttatagccagtgggataggtaatgattggattggttggtctagaccagaggttgacaaactttttctgtagaggggtagatagtaaatgtctgaggctttgtgtgggcaatatgatttctttcacagctactcaactctgctgttgtggcatgaaaacagccagaaatttgtatacaaatgggcatggctgtgtaccaataaacctttatttacaaaacagatgacaggccagagtgtgtgttgtcttaacaaaaggcttctgtgaaaagtgcagagatggatgtgacagtcacgtgcgggttgtggctcaaccacacctaggacgctacgaccaccttctcaaaggaacacaggtgttctgggtgtgtctctagtagggctactaggttggaggtgaatggaaaccaggacataattatgccagaaaagagcagaacaaaggaagaacaaaggaagcatgacagaaccatctgaggcactgtcctgtgggagacagctgtctcaggacccttgcaatccctggtggtgattggtgctttgatagggaggggaccttcactgctttacagtcttttctggatgactgtggtcacttgaactctaagatgatcagcctctttcctgtcaaatgggacctgttatcttccctttttcttccccaagggcatggtagactctgtggcagcgaaatgaaacacttcatgatgagatgaaagcatattgcagaggacaaatctctctgcaaatatagggcactattatcaggatttcctcacctgccaaatgtatcattcatcagaagatgttgctcaaccctctttgggcaagaaaagctttccactaacttccatttaaataaacaaacccttgaaatgctttggaatgctacttttttataggtggagcaatacaatttgaatagtctctttgagaagtatgtgccctatctcatggatgtgatagtggaaggaattgtggatggaagacaagcagaaaagctgaagacaatagttcctcagacagacctcaatatggtaagaaatgatccctgctgttagcaaaaagaaattctttcctaaagacaagctcacggtagggttttaaagggagtgaagatgccagacagggtgaacagtagcattgttggtcagtgccaaggcgggcgccgtgcttgcttttgtgcaagtcaagatactgggttccatctgtctgaaccaacatgttgggtcttatgctcccatcgctctgggacctgggatcccaggatttatgactggaatggactctgtgggggtggactatgtgggctgaaccagatattttcctgtgaaccaggtaacccagttagccaagatgttggatgcgttgctagaaggagaaatagaagaccttgacctgctggagtgctacttcctggaggctttgtactgctctctgggagcctccctgcttgaggatggaaggatgaaatttgacgaatatatcaaacgccttgcttctttgtctactgttgacacagaaggagtttgggccaaccctggggaactgccaggtgggaaccgagtgtcgcctgtttccctgctctgagtgcctttggttaaatttctagaggaagtgaatgagcttttccatatttctgtctgtatgagttttccagattgtttgcttctttagagaaacatgcaatggtcagagcacatggcggaacacccaggagcggttcacatgcattgactgctgtgacagaagcccaggccctctgggtggtctttctggatgagagtcaacttctcttgcctcagcttaggcacttgcttcctttgctctttaaacttttcacattctgcatgactttgagtttcttcttctgtgggcttccctatctgtctttttaatttttatttttaaccatctatctccattttcaccatatcattcatctgctgtattcctgagtatttgcacagtagacaatcaagtgtggatttgtaaatcgttcataggaaatcatacaattaacattttatgtttttgcacaaaaatgtgcatcttcaatgaatcatacatgatgaaaaagatgcattctccaaggtctatatgcaatggtaggacccttctttatccatctcttattgctattcgagcatggcttggaatgtagatggcttttgaagttgtattttatactccttacctggtggtctttttaaagtttaaaatgaaatggcctccggtctttctaatggacagtcatggagcaaatcaaagatgtttttcaggtccctgctttattcggtgggagtctgagtgcacttttccagaactgaaatctccctttggggagtgcttttcagctccgccagccacgctggctgtgcgttgctgccatctgcaattccctcactcggagacaatgttggcctgcttccctggcttgtctccctcatttgccctcatcttgggggcctgaatggccctgtgggcatcccatttccagacacctgctcacagcttcagccctgcaggccctcgagcatacgcttgacggtgatctctggcactgtcatgtctgcatcacaaatcctgctctccacctactctgcctctgagactcgggccacatgtgtttctgtttggcctcatggggatggacactgtgtcgccccagtgtctgctgttgcctcgagcacccatacttgccccttccctgcatcctcacttccttggctggtggccttcacttcagccactcttgcctgagacctccgcatgccttgcctaattgctctgctgaatccctccgagaaaactccaagtctgtcttctctgcctgtctaagggctgacagggagaagaccatgcagccacaaagacagatgtctccataaatcccagtccccagctggcacactcactcctggctccaaaggagcattgggccttttccccaaatatctaccctgccctttccgcgctctccgcagctgatctttctccctgcttcaacaggaacaacggaagctgtctgataggaatctctccttccagctgaaaagcctatagctcctgtctctgactttctccttttacagtggaagaggccacccccactgcaccccagccaaggccaacccagccccttcctccttctcaggctcctcgctccatctgagtttatctctctctctcatgttcagtctccgcctctctaccatcctgtcagctcttagacatgctcaagtaaagccttgcatggcctgagcggaggcgatggtgattactcgggcacctgcagcttccatctctcccctgccccgcctgggttgctgccttcccgcattgtccgttgttcctgcccctctcctgctgcagcacttatggctccacactgaaatggccacttcttgcctgtatctgtcccccacctggccctcgaacaactgcaagggtagggaccagggctctctgcttcactgttgtattcccagggaagtgtatgtccagtgaaagggaagtgttagttgaaaatactcagaaagtgcctgacaagtgcacaagtcacattagtgactgtcccgtgaactagaagcataagctccaaatacttggcatctgtccagtgatgagtagcattagttcaaggtactcggtatctgtccagtgaaggagcagcattgaagtactcactatggcctccgtgcagtacaagcaacattagttcatttcaagcatgtgccagaactgcttttgtatttccgtgtttatgattcaagtgaaatcaaccatgatttcctgcaggtcaacttccaaccttgtatgactttcattttgataacaaacggaatcaatgggtcccatggagtaaattagttccagagtatattcatgcccccgagaggaaattcatcaacatcctgggtaagtcagagtcaaatccttgttcctgggtttaggagtgtgtgatactcgctctaggaggaggcaaagaagatcccatggcttctctggtactctaagtcccacgcagagagctggtagagaagaattgaagagggtgagctgtgggccctcctgggcatggagggtggccgctttggtatttttgtcagctgctggctctgagcatcttccgtggctctgcctctcagctctttccccagcaggccgatccccacaggcagatgagatgccgtttcgcctcccctggcctttccctgggctctcttcagtccacagagctggctgggtggggactagacggcaacgaacgaggcagtgttttataaagggcgctggcttgaaaagctgtgtgccatgggcgtttacctactgaaccacacttagaatgcacccctctggctgttcagataaaatataggctggctattcaggtaaaatatgggctgaataatttcacaaagcatgtgtctgactttggtccattgagcttacggagtgagacatccctgttttctcgggagcccatcagggttgaaacctgccagtgcaagagggagccagacccgatgctgtggcttcactgtctcttcggaggaaggtgttgctcaggaagttaaatcccgcaggggtctgagtgatgtcagcaacaaagaagctgagtttttgatatcctggcataagtcagaattgcatctcaaaaccggcttgggcgttctaaccctggactgtggtgatggtcgcgccgctgcagaactgtgccaaagtcaatcagttatacacttcaatgggtgaatgtttctgaggtcatgtcttggcctttgctcctgttttttatgggatttgtggggttctaggacaactccatgttgcccccagtgctcaccctattggagttgctgagatgcccctgttcctaatgtctactttagttcacacagtggataccactcggactacctggatattggaacaaatggttaaaattaagcaacctgttatttttgttggtgaatctggcacttctaagacagccactacccagaatttcctcaaaaatctgagtgaagaaactaacgtaagtcattattcatatgaattatctattgctgtgtaacaaattattccagtgcatagcagcttcataccacaagcactgtgatctcacagtttccgtgggtcgagaatgtgggagtgacttacctgggagcttctagctcaggctctcatgggattgcagtcaagctgttggccagggctgtagatacctggaggcctgggtagagctggaggatcctcatttgagatgacgtttcacatggctggaggctggaggcctcagttcctcaccatgtggctctctccatggatggcttgggtgtgctcaacatggtagagtgagtgcttaagatagatggcaaagcagatgctatgatgtcttttatgacctggccttggaagtcacataccctcccttctgccctaatctatgggtgagatagaagccaccctgtacaccctgatatagtgtgggagggacctgcaccagggcatggacacctggaggtgagtatgatctggggcccttttggaggctggctgtcacattattcaccatcatttttgggtttctaaaactttgcaagtgtttcctttccttcctccagccagctatgtgtccaatgtgtcgggggtcggatatgtacctggcatagaattcgcagggtgcacaggacaagtgatagtgaacaagctgtcaagatctgttctgtagggatttgcaggcagtggggggataaacatggagatgtgcacagggagcatggcagtgtttacagccagagggacctgcaggtttgtggagtcaggcactaggaagccgcatttgggagcctccttcacaacacccctaccccaggactctgcagctggtgctcatcagcccagccaggtacacctgaacacagtggctttagcaaggtacacattcagcttcaacacgttcagctcatgtgcacctgcactttgggtgccctacgtggagagagttatggaaggcagaggttcgttctcaaagtgtggtccccagaccggcagccttggcatcactggaaacttgttaaaaaaataccctagaccaccaggaatggtggtttgtgcctggtagtcccagctactcaagagactgaggaagaagggtcacttgaggctggtaattcaaggctgcagtgagctatgattgtgcaccactgcactccaacctgggcaacagagcaagaccctgtctcctaaaaatagcaaaacaaaaacaccctgatctaccaaattggaaactctggggaatggagcccagcaaggtgtgtggcacaaaccctgcaggtggagctgatgcataattagttaagtgtgagaaccactaatcaaggagctctcgccagcctaagcatggcaggagggcctgaggacacatgcatgagcatccagggggcttccctcacccttcctgccggcagttagtcccaaagcctgaaccacttgttcatgctctctttgacctatttagatacagccagcatgatagtgatttatgtttgaatattgtcatattgaaaatactgttggatattgcatctcatacgatgcaatagctctatgaagtagtcctaagagatgccattacgatcgtcttacaagtgagaaaaacgaggctctgaaaggttgaatgactttttggaagtcgccttgctagaactgtgcagaaacaagaccctcagtctactttcttgtatgccacattgtccccaaggctcacatgcgacaattcgctattgactcatacaatctgctgaaaggaaagaggaactcttactttagcacttagaaaataatgaagcacagtctcacactgggttattaaaaagttagttcagaggccaatggatttgcaaaatagttgctagcttatttgcaaatgtttactgctgctaccctggggaaaaagctggcttttcacatcatctctttctgcttcagattgtgttaatggtcaacttctcctcccgcaccacgtccatggatatccaaagaaatttagaagcaaatgtggaaaagcgaaccaaagatacttacggcccacccatgggaaaacgcctgctggtgttcatggatgacatgaatatgccaagggtagtttgacgctcaagcaggtggagggatgggtcaagacagtgcttgtgtttgcatgggtgtgtgtgtgtgttagaagtgagtatgagaacattgatctttacctctgtgcaatgtctgcagggtacaggctgcggggagccagcctaaggcagaatgtacctgggatgctcttcttacacagagggacctttccctgactgatcatgttccttagtttcttagaggagggaagcaggcagccagcagcctttgaactaaattcagcatgtatttgaggaagtggtttccaaaggagctcttatttagataataatactgttgttggccccgtgtacatgggaggcatcaggacagacccttcccaagaattccgctggactcttcaaggaagagaaacttcagctgcattatgagtatgtttctgggatctgagcctgagaagtgcaaagttttcttggcatactagaatttaaatttatattatttcattgaaccatttttttctgaaagtctatttccagaaggactgtatgcaaagccagagtccgtccgtccatccatccatccatccatccatccatccatccatccatccatatgttcattcatctatcagtctgttcttccattcatccatccatgtgtctgtttttttcatccacccatctgctatttacctacctatctgttcacccatccaaccatccatctgtccattcattcatagatttgttcatctatccatctattcttctttttgcccatctgtctgtttttccatctacctgtccatttatccatctacccgtccatttatccatctacccatctgttcattcacctgtccatccatctacccatccacccatccatccatccatccatccatctacccatccatccatccatccatccatccatccattcaatggatggtccaatctgtctgtcattatcaatgtatgaattaattacccaatgtctttgcttatgttaaatgaagaaaggacaaatgcttgtcttaaagcttgatgctttgtaagcccctgagttgaaacaggtgaaaccaagagaagcagaagtgtcgatgtgtggacaggcatatcacaccccctgggtggcactgcattgttgaattcttgtctgtccatctgtctgtccatctgcccatccatcaatttgtccattcgtccatctgtccatccatccatccgttcattaattgaattaacatatatttattcagctcttcctatgggactggtgctgtgtagtcaacacctatgcagttcctgccctcatgaagctgtagtatcgtaagggagacaaacttcaaaaaacacaatcacaaatggatatatacagttgcaacctttgagaagccccatgaaactgaaaccgaggtgccctggagagtaacgggaaaaatgagcttgagctgggatggtcagccaacgcctctctgactcctactttgcgatactactgttctcttttcttttttaaaaaaaatcaaggtggatgaatatggcacgcagcagcccattgccttgctgaagctgctgttggaaaaaggctacttatatgaccgtgggaaggagctgaactgtaaaagcattcgagaccttggctttattgctgcaatgggaaaggctggaggaggccgcaatgaagttgacccaagatttatttcgctattcagtgtcttcaatgtgccatttccttcagaggagtctctgcatttaatttattcctccatcctgaaaggccacacctcggtaacttgattttaactagaagtctaaaccggaagaccttgtgttggggggaaacatacacagggctgacttatccatgtaggcacagcagggttagggccctcaatacttttaagggcctatgaaaatgttttaatttcttgcaaaatcagaagaaaaaaatcatctttatacgatgccattataaaatgtaattgtaatgtatttttatggaggaagaggtccatggaggtaaaagtgccttgggcccgtgggagtcctgatgtggccctgaggtgctcatgccacattgagtgacagcgaagaatcaactagcaggctggggccctggagtcagtccccttctgctccgggagcaggtctcttgaactctcctaacctcattctcatttggagcggggagatcatgatggtccccacctcactgggttttgggaggatgaaaggagagaaatgcgtgtaaagggtgcctagtgcacactgcctagtgcatagcagctactcattggttactagttactgctgttattattatgatttacttggctcctccaaatggaacccattcatttaaacaaccatcttctgatctggcgtttccctgctaaagcggagtctgcacactcggaggctccaggggccaggtgggtaagataaaggtgtggagtggccaggcctgatcagtaggaactatgagcacctggcccgttcatgccctacctgaaggcatttgctttcaaaacggtgaggtccgtgctggtcaaataaaactcccaccgagggctggttggggtctttggtttcacatcatgttgacttcacagttaatgtgaaaatctagagcaatacaaaaaaatcaggcccggtgcagtggctcacgcctgtaatcccagcactttgggaggttgaggcaggtggatcacttgaggtcaggagttcaagactagcctggtcaacatagcaaaacctcatctctactaaaaatacaaaaattagccgggtgtggtggcaggcacctgtagtcccagctacttgggaggatgaggcaggaaaattgcttgaacctgggaggtgaaggctttagtgagccaagatcatgccactgcactccagcatgggcaacagagtctcaatctaaaatacataaaaaaataaaaaaattaaaaataagtagtaaaattcacataatggctgggcatggtggctcacacctgtatcccagcacttcgggaggctgaggagagcggatcactcgagcccagcagttcaagaccagcctgggcaatgtggtgaaaccctgtctctacaaaaaatatgaaacattagccaggtatgatggtgtcctgtagtcccagctacaaaggaggctgaggtgggaggatcacttgagcccaagaggtcgaggctgcagtaagccctgatcatgcccctgcactccagtctgggaaacagagcaagaccccatctcaaaaaaaattcacataacacaaaattcgttattatagccattttaaagtatacaattcagtggcacttagtccattcacagcgttgtgcaaccatcagcaacgtctaaccccagaacattttcatcaccctggaaggaaacccacacacattagcacttactcccatcccacctctcattcccaggaaccgtgactctaccttctgtctccatggagttttccatgttgggtatttcatataaatagagtcataaagcacgtggctttctgtgcctggcttgcttcactcctcatcatgttctcaagggtcatccgtgctggagcttgtgtctgtcagtgcttcattcctggtttgttttattttgttttgagatggagtctccctctgtcacccaggctggagtgcaatggcgtgatctcggttcactgcaacctccgcctcctgggttcaggcgattctcctgcctcagcctcctgagtagcaggaattacaggtgcgcaccaccatgcccagctaatgtttatattttattttaatagagatggggtttcaccgtgttggtcaggctggtcttcaactcctgacctcaggtgatctgcccaccttggcctcccaaagtgctgggattacaggcatgagccaccgtgactggccaacttcattcctttctatagcttagtaatagtccattgtacggctctgccacattttgtttattcactcatctactgaaggacatttgtgtgttggggggggtgtctttgcatttttcagacgtttcatgagagcattgtggctgtgagtggcaagctgacattctgcacgctagcactttacaaaaatattgtgcaagacctacctcccactccgtcaaagttccattacatcttcaaccttcgagatctctcacgggtttttaatggtcttgtcctcactaacccggagcggtgagtttgatttatcttactaaaatatgccccacaggtatgatagttttcttattcttttaagacagagggcttatcagtggatttgatgaatcgttgtatgaattaattacccaatgtctttgcttatgttgaagaagagagaccaacacttggcttaaggcttgatgctttgtaagcctttgcattgaaacaggcaaaaccaagagaagcagaagtggggacaagcctatcacaccccttgggcaggctgtgttgttgacttctcgttttcagttctgaagttggaatttgcctgcatggagccttttgctcacataactcagtcgttgccggttggttataggatgtgtgtctttatgagaagtaagcagaggacagaaaggatttaagtcacgatatagggaaattcccgattaaaactaggcttatacctttacatgaatgtctactttagtctatgtggatttgcaagcatagtccaattatgtggattcatattatgaatccagaagatactgaaaaatgaattgagaattttccatgtatcctgcttttgagtgccttgaaacatacagactgtcaggggcggtcaggagagggcagctccaggtgtttcaggtggagtgacggttctttgctagaatgcagggaaagttctggaattggggccagattgagttggctcttagaaaaaggagctgtcggccaggcacagtggctaatgcctatagtctcagcactttgggaggccaagggaggaggatcacttgagcccaggagttttagaccagcatgggcagcatagtgagactccatctctacaaaaaaatttaaaaaattagctgagtgtggtggtatgtacctgtagtcccagccacttgggaggctgaggtgggaggatcacttaagcccaggaatttgaggtggcagtgagctatgattgtgccaatgcaccagcctgggtaacaaagcgagaccccacctcttaaaaaaagaaaaaagagagaaaaagaagttgccagtgaccctgatgctgattttaaattcatgtattccaacaagtagggatgatgtcaggtacttattttacgtcatttatagacaacgctctttttttctttcctacagtaagataagctacggatgatgactttagggggtttacattactttcttagcttctgttggattctctggttagatttcattaacgtgagactaggggggcacgactggagaaatgttgggcctttattgcgctctgtgtgtctgtctgtctgaatgtcacagccgtcagccctggtatccttcaggtgacttcctggctgatttttgtcccttccattctgcagattccagacggtggcccagatggtgagagtctggaggaatgagtgtctgagagtcttccacgaccggctgatcagtgaaacagacaagcagctggtcagtacatccaatgcttcttctcaggaaattcttctcaggaaaataaacaagcgccaaaagtgttttttatattaggacgcgaattgtggaaaaataggcacgaaaggtcaatggggcaaaggagggtgggtgggttattaagcgtcttgcagcaactgaaaaaaaatagaacgcaaattattttagataatagtacgtatcctctgctcctagcaagtttcaggccgtgtactgttgttgagtttgggtccttaagtgggcttctgtttcaaggtacaacagcacataggcagcttggttgtggaacattttaaagatgacgtggaggtggtgatgagggatcccatattgtttggagacttccagatggctctgcacgaaggagaaccacgcatttatgaagacatccaggactacgaggcggccaaggctctgttccaggtggggatgagccccaccctgtccatgggctcactttctcctgagcatgggccaagcgggagctgagcatcgcgcgggtgcccgggagcctatcacctggggctctgtctgagggcttgaaatacgggcttgtgtctggtccggtggttcccacatccagcatgcttgggagtgacgttaggaaattgttagactcctggggccaccccgtgagatttgctgcgctgggcccatggagggtccccagattctggtgcacagccaggtttgggaaccacttgtttgactccctaatattcattttcatttaaattcatgagatgagccttgttaccggctttgggtcgctgctggccaatcaaagcccagcagatggaaatctcgattgtgaaagctagattagtcctggagacccaagcagtttaattattttaactactatagatgttcagaaaaatctctcttccattcttaatctcctctggacaaaaggagggagtctgtctcttaaaatccagtgatcctttaagacattatttatttatttatttattttgagacagggtctctctctgtcacccaggccacagtgcagtggtacgatcacggctctctgcagcctcaacctcctgggctcaagtgatcttcctgcctcagcctctggagtagccgggactatgggcacacatcaccgtgcccagctgatttttttgtttttatttttgtagagacgtagtcttgctctgtggcccaggttggtctcgaactcctgggctcaagtgatcctccctcctcagcctcccaaagtgctgggattataggcatgagccactgtgctgggttttaaattctctttttttttttaatgctttaaattctagggtacatgtgcacaacatgcaggtttgttacatacgtatacatgtgccatgttggtgtagtgcacccattaactcgtcatttacattaggtgtatctcctaatgctatccctcccccctccccccaccccacaacaggccctggtgtgtgatgttccccttcctgtgtccatgtgttctcattgttcaattcccacctatgagtgagaacatgcggtgtttggttttctgtccttgcagtagtttgctgagaatgatggtttccagcttcatccatgtccctacaaaggacatgaactcatcctttttaatggatgcatagtattccatggtgtatatgtgccacattttcttaatccagtctatcattgatgggcatttgggttggttccaagtctttgctattgtgagtagtgccgcaataaacatacgtgtgcatgtgtctttatagcagcatgatttgtaatcctttaggtatatgcccagtaacgggatggctgggtcaaacactatttctagttctagatccttgaggaatcgccacactgacttccacaatggttgaactagtttacagtctcaccaactgtgtaaaactgttcctatttctccacatcctctccagcacctgttgtttcctgactttttaatgattgccattctaagtggtgtgagatggtatctcattgtggttttgatttgcatttctctgatggccagtgatgatgagcattttttcatgtgtcttttggctgcataaatgtcttcttttgagaagtgtctgttcgtatccttcgcccactttttgatgaagttgtttgattttttctcgtaaatttgtttaagttctttgtagattctggatattagccctttgtcagatgggtagattgtaaaacccaccatgctgggttttgaattctttttttttttttaaatgcaggaaattcttgaagagtataatgaaagcaacaccaaaatgaacttggttctcttcgacgatgctctggagcatttaacccgggtgcaccgtatcatccgcatggaccgcggccacgccctgctggtcggggtagggggctcagggaagcagtctctttcgaggctggctgccttcacagccagctgtgaggtcagtccacgtaccctcccagaaataggtttacgatgccagtttctgcagttggtagttcgtgtacatattggaacaatccacagcagatcatagcatgatgttttcatagagtatcgaggtgggtgttttggtttgttttattttttcttgtttttggcttgatattactatattttaactgaatagccagagcatctaagtacaggtgttctttggcttaggatagggttacatcctgataaaataatcataagtcaaaaatattgtcagttgaaaatacatttaatatcccaattaacccatcataaagttgaaaaatcctaagtggaaccatcaaagccggggaccatctgtattgctttgtttttaggatggagaatgtcagatcaagttagaaagtcaaatacaagcacatcctgtgaacggtgatgtgtgttcatatggggagggcttggcccaaacctcagtgcacccatagtatggggctggcaatttgctggctgccatatctgcacagcctgcacacacagatctgggttaatcttagaatcttgtatttttaaacagctttactgagattgaattcaagaccatacaatccacacattcaaagcatacaagccagtgcttgttggcacattcacagatctgtgcaaccagaccacagtctactttagaacacttctgtggcttcggccgggcgtggtggctcataccagtaatcccagcactttgggaggccaaggcgggtggatcacctgaggtcaggagttcatcatcacccttgccaacatggtgaaaccccgtctctactaaaaataaaaaaatgatccaggcatggtggcacgcacctgtaatcccagctactcggaggctgaggcaggagaatcacttgaacctgggaggcagaggttgcagtgagctgaggtcatgccgcagcactccagcctgggagacagagtaagactctgtcaaaaaaaaaaaaaaaaaaaaaaaaaagaacattttgtggtttcaaaaagaaaaagaaatcccatgccctttagtgatcaccaccctgacctctgcaccctcccctcatcaagccctgagcaactaacggactaatctgctttctgtctctatagtcttcctattctagactttcatgtgaatagtgtgtgtgtctattttgtgtctggtatctttcttttagcacagtgctttcaaagttcatgttgtagcatacatcggtacttcattttttttttgccaaataggaggccctcgtgtggctatgccacgtttcctttatccactgctgggcgtgtttgttgtttccacctgttggcttttgtggacagtgctgctgtgagctttcatgcacaagtttctgtgtggacatgtgtttgcattgctcttgagtatgctcctacaagtggaattgcgggatcctatgataactctatgtttaattgtttgaggaacctccagggtgtggctgcaccgttttccattcctaccagcagcgtctgagggttcctgtttgtccacaccattcttagaatcatacaggtacctcctgcaggttccacaggtaactcacctgcaaggggcctctcgaagtggagcagacactatgcattgagatgtaatttgaagaagagtcatgtccctcattcacccttttctccccgactcttcattagttctctggtatctgacttctttcactattagggtctcccgttatccaaaatgcctctgtttttgcctctggttgcatgatacacatgcatgcttataatattttcaatttacaatggatttattgagacgtagccccatcttaagctgaaaagtgtaccctaaaatgcaactagtacctaacagcggctatctttaggtgatgaaattacaaatgatctttattttctttagacgtttctgcattgcttgaattgttgcaatgaggattattccatttagagagagagagaaatgagtgagtccataacaatagtgattcttattccatgcaatggactgaagttttgtccgtgcctgttctgggtgtgtggtgcaggacgggatctgtattcagcctcagttcttctcagatgctcagccacccctcatgtctacctcagaaccttttgataagtccacctttagagaagacacttcttgcagaagggtcattttcatgactcttctcctcctggcaagcaagaggtgttctttttcttcgcccccgagatggagtttcgctctgttgcccaggctggagtgcaatgacgtgatctcggctcactgcaacctctgcctccccgggttcaagcgattctcctgcctcagcctcctgagtagctgggattacaggcatgtgccaccacgcccggctaacttttgtatttttactagagacggggtttcgccatgttggccaggatggtcttgaactcctgacctaagaggtgttcttttgcacagactttcttctttgtcttcagtgtgttttctggaatcagatttaactcagcatcattgccattaccacagagagtcttaggcagttcaggctgttataacaaagtgcgatagactggctggctcgtggacagcaggtgttcgtttctcaccattctggaggctgggaattccaagatcagggtgccagcatggtcgggctccagagagggccctctcccgggctgcagatggctggcttctcatggcattcttacatggatggatgacagcacgaaaagtctttggggtcccttttataagggcactaatcccattcgtgagggctccaccctcatcacctaatcacctcctaaaagcccaacctccaaataccatcacattgggggttatgatttcaacaaaggaattttgtgtgtgtgtgtggggagaacaaacattcagtctattgcacggagtaagaatcactattgttatggactcactcatttctctccctctaaatggaataatcctcactgcaacaattcaaatgatgcagaagcgtctaaaaaaataaggatcacttgtaatttcatcacctaaagattgccactgttaggtaccagtagccttttagtgtatacttttctttttttaaattatttttctgttattttcatttttggtctgggaaccaacggaataatgtacacttttcaacttacaatagggctgtctcaataaacccatcataagttgaaaatattataagctgaaaatgcacttttgatttatatattcaacttacaatgggtttatctggatgtgaccccatcgttaagttgaggagtgtgctgaaagtgtagcacttttgcgccatggcaaagtcaaaaagttctaagttgaaccagaggaagtcagggaccatatgtgcattcatacacaaacgtatttccttcttaccagcaatgggttaaagttatatgtaacttatgtcatttttccccactgtgtcactgcgtctttccaagtcaataaatacatatttacattgtctttggaagcgttggacagtattctattgtttggatatgccacacataacccatttccaatggcgggcatttagctttgtccttgttttcttattactaacagtgcagtgatgaacacctttgtttatgtatctttgaatattgttcatttttttttccctataggatcactttctttagagattggtaagttggcaggttaaagggtatatgctcttttacagctttggttgcctggcaccagatttcgcactgggaaggttggatctaaactcatatggagtttgcctctttggagtggaaaggacctggggatgcaggacagaaggaaaggaaaaaagtgtccttattaacaaccaatcaccccaccacaaaggattatgctaatttatgcaactggcagtgtctgttttcacatattcttgccaatactagatattgtcatgctgatatttgtcaagattataggtggaaaatattgcagtttaaatgatcctttctccaattaatagtaaagtttgaatatccttttatacattttttggacatttaccttttctcttttgtgtattgcccctttatatacttattgagttgtgagaactctttatataggagagcaatcacagttcattcaatgaatccagcttccaaaatttcacaaatattggccttttgtttgaggtatttgtaaaaaagggaaaaactaatatgcttgatctagctttaaatctgatgaaatacataattgaaatcattcattgttaaaatataactgtttgcaattgttttccacatttttctataggacaaggcattccccactggaaagttttattattttttttctgttgatttgtccaggtaaatctgaggcattttcccctaaagtagcgcctcgaggaacagcagagaggatgttgagggacagagatctggaggaggttgaggacacacagggctgtgtctgggccctaggaagtggcgagggttgggtagtggggtcagaacaggtgttcagagagtagtgccaggagctgctggggaggggaggcggctgcactcgggaggggtgaggaaggtttgcaggcgacaggcagaactggagaccagagtctattggccagaaggcatcctggttgcgttgcgcgcgcgcgcgtgtgtgtgcacacgtgtgtgtgtgtgtgtgagcatgtgttctagtgcatgccagggtgcaagtgagtgtgtggctgagtgtgaacatgtgggaatgactgtgtgagtgtgacagtgtgagtgaagcgtgtgtgtcaatgcatagggttgagggaggtagggaacagagagagatctctcagttcctggaaatctgccatgtttctgacagtcgctggttgcaatgaaagttttaatttctgcttctgagctaaaagaaacacttgagcagaaaaagcgtgctttaaacttatgtccttattcacatttacatcgatttcgtgtgtacattgatttcctgtcacgaagttaaagtgcctgcttatttctccctgtgtgcgtcttcccacagggtctgattttctgtaaactgcagtatgtggctggcgttcaccttggggtacattcttcccccctttcctctgttgctgggctcatggggcttccccctcctctgtttcatgacagggagtcccttccagacttttctttcctgacctacttcctcgagcttggacagacccacgccctctgcactctcctccagcgtccccaccccggagcccgcagggaagggaggctggtggtggtgacgcccatgtgctctgtgtctgcatcgcaggtgtttgagatcctgctgagccgaggctactcggagaacagtttccgggaagacctgaagagcctctatttgaaacttgggattgagaacaaagcgatgatctttctgttcacggatgcccatgtggctgaggagggcttcctggagctcatcaacaacatgctgacctcaggtacagccaaggctggcgcccgctgtggccaacaccccgctcagctcttaagggagttcactttcttcagcagttaccacctccagacactgtgggtagccctgtgcgggtgtacctgttcctccctcacggcggcccctgagataggtctcattatcttccttggctcctcctgtcctggagtctcccgagtgtgcccccttctctccgtctgcgatgatggcagtatccttgcagtaagaacaggtggtgtctgggcatctggccgtgccccgggctgtgctaagtgtgcatcatacattcccgtctccacaaaaacttgatgagaggccaggtgtggtgcctcctgcctgtgatcccagcactctgggaggccaaggagggaggatagcttgagcccaggagtttgagaccccgtctttacaaattttttttttcttttttttttttagatagagtctcgttctgtcttccaggctggagtgcagtggcgtgatcttggctcactgcaagctccgcctcctgggttcacaccattctcctgcctcagcctcccgagtagctgggactacaggcacccaccaccatgcccggctaattttttgtattttcagtagagacggggtttcaccgtgttagccaagatggtctcgatctcctgaccttgtgatccacccgcatcggcctcccaaagtgctgggattacaggcgtgagccaccgtgcctggcacaaaaatatttttaagaagttagccaggcatgatggcgtgagcctgtagttccagctactcaggaggggcaggaggattgcttgagcctgggaggttgaggctgcggtaagtcatgatcatgttatggcactccagcctgggcaacagagtgagaccctgtctccaaaaagaaaaaaaaacaaaagcaactgaaaaacaatcaaacctaatagggaaggtaccattaacatcctcatttcacagctgaggaaactgaggcccctgtagagggctgaatggcggccctctaaaagacacatcctaaacccctggatcttgagaacgagacctttgtaagaaaaagagtctttgcagatgtaattaaattaaagatcttgaagtgccttcctggatttagggtgggtcctaaatccagtgacagctgtccttataagagaaggcagagggagatttgagacacagagaataaggtcccataaagattcccacaagtcacgggacacctggagccaccagaagccagaggaggcaaagaaggatttttcccttggagctgttggcaggttaccctgagaccttgatttcaggcctccagaactgcaagagagtcggtgtctgtatttcttgtctgaagccactcgctttggggtaattagtcatggctgccccagaaatctactagagatgccacctaccttatccaagggcaccttgctgggaaggcactgaggtgagactcgaacccaggatttttagcatcttagccacgctcacaaccactttaccgtgttgttatcttgtctaccctggggccctgcaaagatccgtgctgacttcgtctggcctaatggcttacagggacctcctttctttcccagggacctatttcatcgattgcttgtttgtttcagcacctgaccatattcattattgtattgctgtgttattcattgagccccagcctcccagcatttactataaaaaatttctaacataacagtgaggctgaaagaattttttctgtgaacatctgccggcatgccatctagatccctcctttctcgccttgctgcacttgctctgccatgcgtgtaaacagctttccctccctccctgcttccgcccttctcgtttttagatgcgtttcagagtcaattgcaacatcactgctctccccgctaaatgcttctgcgtgccactatctagagttcaagttttgtttagtgttttcttttgatgtaaaatttacatacagggaaacgcacaacattttaagtgtatatttgctgcattttgatcattgcgttttaagttgcgtctgtttcagtgggttgtcggctccttgagaggggggatcgggtcatccacctggatttattccacagtgtttattccagacactgggtttggtagggaataagatggtcatgacctctgccctccttggagcatacatttcagcgtgtgagtggactggttaacgacaacaacaactacacaaagagatacagcaattgcagattgtggtaagtgccgtgagtgcaaaggggagttgctgtgagagagagtgtgggcaggagcatctcagggcagacagggaaggcgtcactgtagagacttttcagctgaggcctgagagatgctgtgtgatcacactccctatggctgctgtagcaaatttccccaaacagcacggatttattcccctatgcgcctggaggtcagaaatcagaaaagggtcttaaggggttaagatcagggtgttggtggggctggttccttccagagcttcctggggacactctgtttccctgtctcttccaactgcttcaggccacccgtttcttggctctttagctcgctggctctcatccttccagtctctacttctgtcatcctgatgcaaactcagctgcttctctcttgtggggacccctgtgatcgtctccagcccacctgggtaattgagagcacgcgctccatcccaccatccttggctgcgtcacatccacagagtcctttttgcaggaaacataaagaaacccattggccggttcctgggcttaggatgccatggacacctttagagggctgttgtgcagggatcaggacgaggtggaggggttctatggcgtggaaccttgtaggtcatttataggagataagattttattctcagtgcaatgacgtagtccagatttatgggttttttaattttttagatttaattaattaattatttcagagacagggtcttactctgttgcccaggccagaatgcagcggcatgatcatagctcattgtagcttccaactcctgggcttacacaatcttcctgtcccagcctttcgagtagctgggactacagatgcatctcaccacaaccagctgattaaaaaaaaaaaaacacacttttttttttaagaggtggagtcttcctgcattgcccaggctggtcttgaactcctgggctctagtgtttttcctgcctcaccttcccaaggtgttgagattacaggcgtgagccactgcacccagccaagatttatgtttctaaaagatccctccagtgcgccgtggggacgagattagaggggaacaggagtgggagaggggcatccagtttggagctacccctgcagtgtaggcaggaagtgacagcgattggaggagggtagggcactggggacagagagaagtgggtggattcacgaggtattcaggaggcagagccaacgggacttcgatcgatttggctgtgggttgggggaggggtatcaagggtgactcccaggtttctggtggagcgagtgatcagtgcttccatttgctgagatgaggaagaccagttctgggcttgtggcattaggagcgtgttgagtttgctgcactagatgagaatctgaatgtgatgtcatatagtgtattagtttgctggggctgccgtcacaaaatgccacaaactgggtggcttaaaacaatagaaatctactctcacagttctggaggccaggagcccaagatcacggtgtcggcagagcccgttccttctgagctctgggtgggggaatctgtgttgctggtggctgctgacagtctttggtgttccttggcttgtaggcacagaactccagtccctgtcttcgttgtcacgtggccttccccttgtgtgctgtctgtctctgtgtccaaatttccctcctttataagggtacctgtcatattgcattagggcccatctcaatgacctcatttcaacttgattatctctgtaaagacaatttccaaataaagtcacaatctgagctactttggggacttcagtatatctttttcagggcgacatgcaacttcaaccgtaatacataggcagtgtgtacatgagtctggttctcagaataggagcctagggtggggacgtcaatttcagagtcactgacatgtggtgggacccgagtgaaccatccagggagagcccagcactgagttcaggtggaagaggaacgagcagagactgagagggcaggcggagcacggggagcgagagactgagagggcaggcagagccccgggaggaagagactgagagggcaggcagagcacagggagcaagttcctctttgtcttttgggagtcttgggctccctgccaagggagggatccctctcccttgttgaatatccccaagaccatccccggctccgtgacttgctaggaggactcgcaggactcagcatgtggtcctgctcatggctgtgagtcattacagcaaaaggacacagagcaacatcagcagagggaaaaagtgcatgggggaccctagggaagaccagtctcaagtctcagagtcctctctccggggagccacacaggacatgcttaatcccccaacattgagttgtggcaactcgtgtgaagtactgcccaccaggggagctagttggagactcagtgctccgggatttccttggggctgctcatgtaggcacctctacctggcatgtgccaaaatcccggatgcccggagggagagcgggtagtcagcatagaatacgttgcatacccaagcagtgtgggcacaatgttaggctgttcttgcattgctataaagaaataccttagactggttttttataaagaaaagaggttcatgtggctcacagtgccgcaagctgtacaggaagcatggtgctgatttctggggaggcctcaggaaacttacagtcatggcagaaggtgaagggggagcaggcgcgtcccatggccagagtgggagcaaggttgggggaggggccacacactttcaaacaaccagatctcacgagaactcactcgcgctcacaagaacagcactaagaggatggtgctaaaccatccatgagagatctgcccccatcatccagtcacctcccaccgggccccacctgtaacactggggatcacaattcaacctgagatttggtgcggacgcagatccaaaccacatcccatattgggccactcttatcagtgaatcggggaggaagctcttaaggaaactaagttcccaggtgcctttcagaggtgagcagccgtggcctgccacgttaactcttccctgcacaggagaacgtcagagatggcataaaatgtattgcataatttgaaacggcgtagatataggaaaaaagaagtccacgtagccagggtttctcgactgcgtgccgttgacatttggggctgggctgttctttgttgtggtggggctctcctgggcactgtgggaggttcagcagcatccctggccttgacctattagatgccagtagcaacctcccttgcaacaagcagaaatatctccagacatggcccagtgtttcctgggggcaaatcccagctgagaatccctgcttcggagttacaggcaagtgaggcctcctcatgctctgcatgctccctgtgatgctcacggtcatcctcccaggcgagctggcggcatctaggatccccgtttgacagacaggagctggaggctctaagggcttgccacgaggtggcagggagcctcgggtctcaggtcaggcccacacgctgctctctggactcagcacctgctgatctttccacaccttccatcactcagtcagcacttagagcggtcatgaccctgggactcagagagatcaccagcatgtcttccttttccaggaattgtacctgcgcttttttctgaagaggagaaagagtctatcctgagtcagattggacaggaagctctgaagcaaggcatggggccggccaaggagtctgtgtggcagtacttcgtgaacaaaagtgcaaataacctgcacattgtcctgggcatgtcgccagtgggggacaccctgaggacctggtgcagaaacttcccaggtacccgcggtggagcctgtgaacccatttcccctgctttggcagagtgtgtggctgagggtctgtccacacctctccaggttcccccagcaaagcaaaacaagacacggccattaggtggaaatgtgggctctgcactgtagcttggggctcactgccccttctaggtgccagtgggcgtgagtgatgtccctctgacaggaggatgtacccatgctcctccatgcgaggcccgcagtgcatggacggtggctccccgcttccttccatttgggaaaattccaccagcctcatgccagcctttagagcagaggttcctaatgggcggggcaggggcgggggaggttgtgttctaggggactcttggcaatgcctggagacatttttggtcatcacagccccggggagcatgcagtgtagtactggcatctagtgggtagaagccagggatgctgtgaagcatcctacagtgcacagccagctgctgccacaaaggattagagcccagatgtcaatagcgccaagggtgagaaactctgcttttgatgaactagatttggacacatctggctcattcaccaacttgttggctattgaagatggcatccatgttcttgagtgtctcagggttgcagaatgagcatccttttttttttttttttttttttttttgagacagaatctcgctctgtcgcccagattagagtgcagtggcaccatcataggtcactgcagcctcgacctcctgggctcaaatgagcctctcacctcagcctccctagtggctgggactataggcgcacaccaccacgctgcctggctgattttttttttctttgagacagggtctcactctgttgcccagactggagtgcagtggtgtgatcttggctcaccacaacctccacctctcgggttcaagcgattctctcacctcagcctcctgagtagctgggattacaggtgtgcaccactactgcccggctaatttttgtatttttagtagagatggagttttgccatgttgtccaggctggtcttgaactcctgacctcaaatgatccacccgccttggcctcccaaagtgctgggattacaggtgtgagccaccacacccggccctgatttttgtattttttgtagagacagggtctcgccacattgcccaggctgggagcatctttttaatctctctttcctttcaaggtatggtaaataacactggtattgactggttcatgccctggcctccccaagccctccatgcggtcgcaaagtcctttctaggtaagtcacagctgttatgggaactgcattattgataaaacaaagcaatttattttcccttttctgactttgaattctggtcttgtagatttcttcactggaaaaccctatggtaacaaatggctttcaattttgttagtatgtttttggtttatatttggtgttttagtccaaagacatttcaggagacttagcaaggacaatttaggataaaaattgattaggtgttctccacagcagcagttggcaaaaccatggtctgctgtctagttggccccttacttgttttagtaaataaagttttattggtacacagactcactcattaattaacatattgtctctggctgcttttatgctacaaccgcaaagctgaataattgcaacagagaccgtatgagtactgttcggctctttgtagaaaacatgtgctggcctctatccaaagaatgctccaaggacaattcagcaaacattctgcattctcattgaatttctagcgtttcaaacacctaaggccttggatattaattttaatgtttgaataagaaaggaagtctgtcttcagggaacatctttttcttttgacctaacttgagcagatttatgatgaatgacactgggtaaccttgaaaatagtttcaaccttctaaatctgtactcaataataaataaataaatgttcctatatgtaagaagaaatcataactttaatcataatgcagttttgggggaaaaggggccaagagaatgactcttttctgatgatatatctcaggtccagatggtaaatatttacagctttttcgcaactactcaattctgccattttatcatgaaagcagtcatagacaatacgtaaatgaatcgctatggctgtgatccaataacactttatttacaaaaacagggggcgggctggatttgtcctttggcccgtagttggccagccccaatatagatgtccccttgttctcagaggcgtatttgccgtttccatgtgtgaagtgcttgtgtttgctttcagtattcagtgattcagcatcataaataatgctgcctagaatttgcttagaacttttttgtccttagaatatactccctggaggccaggcgcagtggctcacacctgtaatcccagcactttgggaggctgaggcgggtggatcacttgagcccaggagttcgagaccagcctgggcaaaatggtgaaaccctgtatttactaaaaatacaaaaattagctgggtgtggtggtgggcacctgtaatcccagctactcaggaggctgagccatgagaattgcttgagcccaggaggcagaggttgcagtgagccgagtttgtgccactgctctccatcctgggaggcacagtgagactttatctcacacacacacacacacacacacacacacacacacacagagagagagagagagagagagagagagagagagagagagagagagaatatattccctggaattgagatgactatgcccaaaggcacagatatttgtgaggcaccgtttttcctgcacactgtaaaatgggccctggggctgtgttttgctaaccccggagtaactcaggaccagctctgcagaatctggattaatcggtactttcaatctgtctttccttcctccattttaatatgagacattctctgctttgagctgaatgcatttaacaacctatcagataatccaggtgatgtgatcttgacactggaagccatcattcattctttcagcgggtgtataggaaggcccacctttgccgatatgtgctgggtgtcatccagcggtgggtaaccgaataagcccacccagtcctcgggcgggcgaggggagcaacagggcagagttagacgtggtgatcgcttctgaaaacccaaggcccttctgccacggtgtcttggcctttagggaagacagggcttcctaacagtagggaaggaattaggtaacagagtgagaccctgtctcaagaaaaaaaaaaaaaaaaaagaaggattagcacggatcactgctgtggccctgaaaagccaccaataagtgatagccattcttttcttgtcctattaaaaactttaacatcatttttttattgtagtaaaatatatgtaacataacattttccattttaagcattttgaaatgtacatgtggcactaatcacattcgtaatgttgtgaaaccaacaccactgtctgttgccaaaacttttcatcatcccaaactgaaactccatacccgttaaacacgaactccccatcgcccctccctccagcccctggcaacctcgaatctgtgttctgtctgtatgaatttgcctgttctagagagggttcgtataagtggaatcatgcaatgtttgtcctttggtgtctggcgtctttcacttagcatcatgtttttgaggctcatccgtgtttcagcatcggaacttcattcctttttacaagtgaatactatccccggtatagataggacacattttgttcatccattcctccgttgctggacgcttgggtctttccaccttttgcttattgtgatagtctacagtaaacattggcatacaagaattcatttgagtccctgcttttcagttctttggggtatatacctaggagtggaattgttgagtcatataatagttctatatttaactctttgaagaatccctgttttcctttcttaacaagcatggctgggtgcggtgagtcacgcctgtaatcccagcactttgtggggctgaggtggaccgattgccttagctcaggagttaagaccagcctgggcaacatgggtgaaacctcacctctacaaaataatacaaaaaattacccaggcatggtggcccatcctgtagtcccagctacttgggaggctgaggtgggaggatcacctgtgcccaggagatggaggctgcagtgagccatgatcacgccactgcactccagcctgggcaacagagtgagaccctgtgtcgaaaaagaaaaagaaagaaaacattttttattccttcctcttcagggtataatccaatgatcccggcagaaaatatagaaaatgtggtgaagcatgttgtcttggttcaccaatccgtggaccactacagccaacagtttctacagaaattgaggcgcagcaactatgtcactcccaagaactaccttgattttattaacacctattcaaaattgctggatgagaaaactcagtgtaatataggtaagccttggggatggggtggttgacaaaagtcattattatttatgggtaaggattcgagcgctgatcttttctttagtaagatggggcatcttcagtattgaggccaaacgaagcacatcttggattttgtgtcttggagcgattctttcatgtgggcaggaccctggcatgtccttatttttgttctcagtgttgagtcttagactttgaagctttacattttgatcacattagcaatttttaaattttattttttatcttagggatagggtctctgtttcccaggctggagtgcagtggtgcaaccatggctcactgcagcctcgacctcctgggttcacgtgctcctcccgcctcagcctcctgagtagctgggaccacaggtgcagccaccatgcctggcgcacattagagacaactatctgctgcagcagcatgcactgccggacagggctttttaaaaagtgctctggctgttggccaagggaagcactgtcttcagaaatacattcattttggctgatgctgtcccaagtatggcagtggaggtactgaaagacatgtgccatcttgtaaaaatgttttgttttgtttttgataagctgaagttaggcaaatctcagtgattgtgttgcgaacagtggccacctcgacgatgaacataggtgccctctttcctcagctcagtgcaagcgtctggatgggggactggacaagctgaaggaggccaccatccagctggacgagctgaaccagaagctggccgagcagaagatcgtgctggcggagaagtccgccgcctgcgaggccttgctggaggagatcgccgtcaacaccgctgtaggtgagtgagggcggggccagggcagcccatccccaacacccaatacccaccgtaggtgagtgagggcggggccagggcagcccatcccgagcaggacagggctctgccaggccgtccctgtgaaactgcttgtaggcactgagcgtgccatctttgaccctgcaattcctgttttctttctgaattcgtgtccagccagtcttgtcccctttcataagcactgagaagctaccatatgtaggcccctgcgctggtagcctgaggatgttcaggggagtggaaaagtcactcgaccctctatgggctggtgaactaagtccgtggggttgaaatgacctaagccttggcaccatcgacgcgggactttcttggttcttgaagctgtttcaaggttctttcttgggccccttccctcggtcttcttggccgagcctctgtgtcacctgcactgtcctgctcttgacgactctaccctctcgcgatgcctggcacaggacggctcctgcagcccacagctctgtgcctggcctctaagcctcctctctaggtctttgggccagtggcttctgatgtgtaccctccccagcttgttcccagattcctgcagatgccgctcaacctgcctgcctcttccttctcctgctggtccgtgttcgtgttgctgctaagtgtcatctcggttcagttcctttgtcattgcacccggccctgtgcacaggatccatttgtcatcactctggcaacagcaccttaacttggtgttggcaaactgcctctccccgactcccagtgcctgccatcaggatgggcttattctaaccctgacagaccaattagatgttctctgggactgcacattttgaatcagccaatataaagactgaagattatttgtgttcattcattgcacagcagcgccgtgaagagactgcattcagtgcccgagcccagatccctgaggcgcctctagtttatgtgtttcagcatcttccatgtctgtgagctaccatatcttcttaaaacaatttcacgtttttcttaactcgaccatcattagcttctgttgcttgcaaccaaagcaacttaatcgatagatatcctttcccaggaatttgtggcatatccctgctgcctgttttgatgctgagtcctcactgtggccgtgaagggtcccatcaatccctctatgtcatcttgcctacctaatttctcatgacaccctgtcgcctgctcacagcatcacttcttcatgcctgtgtgagtcctgcagtaacttgctctttctctccctttggtctgctaagaatatccgtaccacttctttcttcctgtccatgtttctccttccagaactttgatcaaatgcctcattcccacatagctgcactttgctttgatctgtcttttaaaaactatatatttctggccccctaaatgtaaaaaactatatattcctggccccctagatgtaaaactagactggaagtgtcttgaaggatgctggtattccacgtattcatctgtccagtcagcagatactgacttcagcttcatggcagccaccgtggtagggagagtgggggctagaaaccgaatgagactcaacccctgcctcgaagaagctcacaaccaagagagcccctcccccggtgcccaggccacagtttgtactgaggaccgcctatttgccacacctgtgtttagtgcctctcctacctgtgcttgtttttctttccccattgccatcatccttgtccagggtcaccttgctcccacttggaattttggaggaagcttcatctaggaactctgtttccagggttgcaaatggtagaaactgagctcaaagtggcttaatccaaagtggaaacgcattgattccagaggcatgctggcttcaggcacagctggatctaggattcaaatgtatcagtgggaatctttccttccctttcttggctctgctgtcttccgtttgggcttcatctcaggcagccggctctgtccatgctgagactttgggagcctccagcatgaggttggcatcctattagctcagcatccccaggggagagagggctcttctttcccatacattccctcaaagctcccagagttggctgtgattggacagatttgggtcacatgcccatgccgaaaccaatcctggtggccataggaatgggatacattgacacgtcccacagagggtagggtggagtgcaaacaatcctctctcctgagggtggctcttcagcacctgccccagcctccagcccatgcttctgcctggctgaaagagcccacaattttgctcctcagcatgactcaagcacctggcttcgccagccccctttgcaggctgctccccacactgaggttcctgaggcctgtaccagccctcttccttcccagccagctctggtggtgtcctgttacctctgcactccgttcctgctggcaccaccccccacccccgcgcctcagcacgctcacagcttagacagcttcctttctgcttttctgttccgaaggttccacactcgtgatcttgctacccttttctgatgcattcatccccctgctgccccagggacaagtagtgcctgggctggggaccctttacagtgtcaaggcccgtgcacggctttgcacgctgcaagtgccagtgctggcttgttagctgtggagatgggttccgagagaccttatcatgggggaggcagagcctctgcagccagcatctgtttgtagaaggcctgctgcattcatctcccggggctgctctaacaaagcaccatgatctgggggctgaaaacaacagacatttatttttttaaattaattaattaatttatttttttgagacagagtctcgctctgtcacctaggctggagtgcagtggcgcgatctcggctcactgcaacctctgcctcctgggtttaagcgattctcctgcctcagcctcctgagtagctgggattacaggtgcccgtcaccacgcctagctaatttttgtatttttagtagagacggggtttcgccatgttggccaggctgatcccgaactcccaaccttaggtgatctacctgcctcggcctcccaaagtgctgggattacaggtgtgagccaccatgcctggccaacaacagaaatttattctctcacagttctggaggccaaagtctgacatcaaggtgccaggaccatgctccctctgaaagctctaggggaagcctcttccagcttcttggggttgttggcagcccttggtattccttagcttagcttataaatgcaccactccagcgtctgtctccattgccacacgcccctcttccctgtgtgtctgcacatggccttctgatagggaccccaggcattggatttagggcccaccctcaccccgtatgacctaatcttaactaattccatctacaaagacccacttccaaataaggtcacatcctgaggtcccagtgggcacgaatcttggtggggtgacactgttcaaaccactgtgagccaagccctgctctaggttttggggttccggccctcggggaggtgctgacatcctagtgagtgagggcacccaggcagtgaatcagccagtggtgaaatgaaacttccgattgcgattggtgtcatgaagcaagtcagcaaggaagggagagagaggacgacagaggggcaggctccttagagggtggctctggctgggcccgagtgagcgtaggaagaggcgatgagaggcagaaggaggagatcgcagggagccggtaagcaggagggggaccccagcatcctcactgaacaccggcgaggcagggctgggggctatcaggagccatgggatttgtcctggatggagtgggtgggacacaggtgggccagttgaggaaggtcagagtcagggtggctgcctagtgctggaggccccacgcatggtgaggttttctgtcccaccaggatcactgaggctgccacattggccagagccccttagatccccgctagggctcaagccaacctttgaggactgcactctgctcagagccggggccgcgagtgcatctcctctgagcccaagctttactcaccccctgtcctaccctgcagccgaggagaagaagaaactggcagaggaaaaggccatggagatagaggagcagaacaaagtcattgccatggagaaggccgaggccgagacgaccctggcagaggtcatgcccatcctggaggccgccaagctggaactgcagaagctggacaagtcggacgtgactgagattaggtaatgcacctgagccaccattctgggcttccattccacctctgcaagccagtagtctccatgatcgtggcaaccaggagcttacaaaggagccgatgccacatgctgccactgtgcctggctctctccatggtggagactgttgttgccctcattttcggatggggaaaatgaggcccagggagatgaggtgggcgccccaggcatccagatcccccagctagtaggaagcagggcctgctgaccttgaacccaggccaagggaaggatggagtggggtaaaacagtgctcttcacggaacatgcgggggcaagtgtccgccctaagcaggggcaggatgctcaccatggggctgagccctgctgaaaacagctctgcagagatgtgtgcacaccacggccggactggcgatgcctgaatccatttccagccaaggaagctttcaaggagggtgagagtaggtcactattgaggcccccatacatcttgcaaatcaatctgtaagatgaccctgtcccccacaccagagggctcatctgctgtcagcgagggtaacgtggtgtggcgtgggctaacaagctttctcctcgcatggcttggcctccccagggcactgttcctgggctctgatggtcagttgagtcttgtgagtaaagccctgggagggaacactgtcctggtgccagcctccgcccactgcctctgcccctgtgctgcctggccccgcacagacccctcggcgtgggagcctcagctctctccttccccactcttcatccagaaggagatcagtcttcctggccccacacacgggtctcgcagccgagaggctccgttcctgggtcagtaatgggcttccattctgggctcccgctggagcggtgcatgttccctgtgcttcctatttctctgcctctgtgctgcctgtgaaggctgagcagcgctccttgtccaagtccgtgcccttgttttcttattggtgaaacatttgtgaatttgagcatggaattcagctcactccaggacagaatgacctcccggttcattcttgggaggtcacttggaggtgctgctgtggtcagcaagaagtcattagttcagtgttgaggatggtgtcaaggagggtataaggatcgatgtattaaaacttcagcactaggcgttggaagtttaggctgaggtaccaggacacagtggaagtgcacacccagcggaggggtaggagacacggtcagcacacacatcctccagggaaatttctagctaccggtgataggatttgggccactgctcccaggtcagcagcataaaaacatcgtgaaagcagagactaggaaggatttttgaaggggatttatttgaagagaaggaacggtgagtcccttccatcaatccaaggtggaggagtgggggggagcttccatggggccaaatagagggcgtggcatgtgtcccctgcagtgagacaggcattgcagacaggtgccccgctcacccctgagaaagcctaagtacaaaaggaataatttttacacattcatacatggctctgcctctttgctgtgtgacgtttagcaagtcatctaacctctctttgctccagtttcttcatttgtaaaatgtggataagaattgtctcggctgcatcagggtcttcatgaggatcatatgagcctatatgtgaagaactgggctgggcacatggtcagagccatgtaagcattagctgtgattatggctccagcatccaaaaggtatgctgggaaaagcccacggccactgtgtcctctatcagctgtggtcaccttcccacactgcaacaggtagtatgggtatatcatttctcatatacacttcctgaggattttcatgcatgaccaaggcaaccaggtacacaagggtctcttctcttcctgacttcaggttctgagggtttggagagcaggggatgcctgcaaatccttttttccttcttttatatacaaattataacaccctatgcatatctttctgcatcttttctgcttagcagtatattttggagagcttttgcatgttgatgtatgatgaacttccccgatattttagaacattccttcacattccattgtgtggctgtgccgtaatttatttaacaaggccttactgatgagtttgttaaataaattgattgtgtctccagtcttttgcctttacaaacagcgtggcaaagaataaatctgaccatagttcattgtgcacgtgggcgagtccacctgcaggatacatttctggaagtggaattgctgggtcccagggtgtaggcatttatagtgttcatagctgttgcctaatccccgccgtggggatggaacctatttatcctcaccaacaatccaaacgagtagtacctgctttttcctagacttaccaacagggggcgcgatcacatgttgggatttttgcatattttgtagatgagtggtacttgtgtagttttaatttgcatttctcttagtgtgagtgaagctggccttttttttttttcctatgagaaaagtgtgtctaagagttatgtgtatttccttttctgtgaacttggtttgcgtatctattgggtcgtggttattgttgctttttatttcaaaaccatttccaggggctttttatataatggggagctcagctttttatccataaggtgagttgcaaatcttttcctggtttgtcatgggctatttgactttgtttatgaggtttatgtgtgtgtttgtttttgccatctatgtttatttttatgtggcaggttttagcaatattttattttgtggcttttttttttgagacagagtcttgctcagtcacccaggctggagtgcagtggcacgatctcggctcactgcaacctccgcctcccgggttcacgccattctcctgcctcagcctcctgagtagctccagcctcctgagtacctccagacgcccgccacgacgcctggctaatttttttttgtatttttagtggagatggggtttcaccatgttagccaggatggtctcgatctcctgaccttgtgatccacccgcctcggcctcccaaagtgctgggattacaggagtgagccactgcgcccggcctttgtggctttttttaaatttattttttgagacagagtctcattctgtcacctaggctggagtgcagtggcgcgatctcggctcactgcaacccctgccttccaggttcaaacgattctcctgcctcagcctcacaagtagctggggttatagacacccaccaccatgcccggctaatgtttgtatttttagtagagatgggctttcaccatgttggccaagctggtctcaaactcctgacctcaggtgatccacccacctcagcctcccaaagtgttgggattacaggcatgagccaccgcacccgacctattttgtggcttttggatattgtgtcctagttaaaaggcctgatcacactgcaagattgtaaaataatttccccatgatttcttttggtactcttatgttttaattttttatatttaaatcttttatctattgaggatttttttcctggggttctgtgtgagtttggatccaatttgagtttttccagatgagtaaaatctggcttttctcaggtcatttggatgttaagcgcaatgagccggcacttacatcttgacaattttataatcttttaagtccttaaaaagcgcttccttcttatcatactcaatcctctttgtagaaatcattaaatgttaaggcaggaagatgaagagtcatgaagattagaagtagatgtttctctaactataaaactataaaagcctccctttgttgctggctcttgagtttcacttttcttcctttcattcattcagtagtcagtgggtgtctgtcccccaccccacccctgccctgagcaggcactggggcccatcagcagtgaggcaggcagggtcttcactgcgtggcgctgacactctgttttcctataggaatcccatgtgcatggggaaattatgtaggattaggttaggaaggaaaggtccttgctgctctgacagtggatgttgggacctgacctagtcatggtcatggagggcggagggggcaccttctctgagattgcaaggagctcggctggagaaaaagcagagacagctggtgtgtcaggggtagagtactgggaggtggggagtggggtttataaggattattttcctctagggagggtagcatatcattctccctttctcattcctgagtttgttttgtgatagaagaaaggaatcaaattaaacagacatctccctttctcttgacttgcaccctccacatttcacacaccttggtcatccggcattgtggaaagtggtatgttctggataagtgagatcccagagcgtggcctgcaacccaacagcagaaaacgtcactttggtagactcagaggatttgggaactggaaggttccagttctgcgtctctacttcacagatggggaaactgacgccctggctggttcctaacttgcccaagggctcaggaccccgccgcaggcctgggctccttctgtcttgaatctgaaaacatctgccccattctttccccacctgcttgttcacagagcggtggccggggcctggtttccatccaccctgaagggaccttttaaagacacttgacagccccgccgctttcctaagcagccaacaccagcgtgatcgagccttttcccggggactcagggcctttctttcatcactgggctttgtgctgaagtgtgggcgccctccctcctggctgttgccctggcttgtccgtacactatggggccttctctcctctgctgtctgtgtgggagtgtgtgagggttccggggtcaggaggggtgggggatttgctcactgcagaaagcctccaggttgctgtctgctcaggctgtctcctccctgtctctctgtctcctccctgtctccctgtctcctccctgtctctctgtctcctccctgtctctctgtctcctccctgtctccctgtctcctccctgtctctctgtctcctccctgtctctctgtcccctccctgtctcctccctgtcttcctgtctcctccctgtctctctgtctcctccctgtctccctgtctctgttcttgtgcatgtgtctccccctctgtccctccatccccctctttcttctctggctcaccccagcctcctaccagagcacaaatgcctgggcccctgcctggccgcccccacactgcatccatgccctccgggacctctgtctcctgctcttctctcctgcttttccttcctctcctgctttgccttgtctgtgctgttctcttccacttctgtctttccatggcgtggtctgggagactcctgtggctttcactgaccttgcctggcagtgggatgccccggtgagatgggttcggttccttctctggcctttgtaccagcgctgctgttctgtctcctgttccgttggcagttctggttctccagaggaacaagggcagtggacatctgcgttctggaggagcagagtgatgatctagtcttatcaaagccacagaacacaattacggggcaacatagcctggaaagagcccaggatgcggggaccccaggcttcccaggcggtgtcagcacagccagtcatgcaagctcccaggaccctgtttgtccatctagtaaatggggagagataatggttggtggtgatggtgatggtgatgatgatgatgataatgacaataatgacggcagccaccatttagagtctgaggaatcagccgagggtgtaattaaaacataggtgctcaggctgccccctaaccactgatccagacgctccggggacggcctgggtttgtattttaatgctgcccccgcaccattccaggcgcctggtctggaacctgagagggggacccggccctgcccttagggacgctcccgcccaggagtgcggtttgtgttgggacctggcttctttcgtttgcttgcagcagtagctccagggactgtcttttggttgagctcgtttttctggagctctctttcaggccagatcctggccacatcccggggttgtgacccacgtgccttggtttcttgccaggtcgtttgctaagcccccgaagcaggtgcagacggtctgcgaatgcatcctcatcatgaaagggtacaaagagctgaactggaaaacagccaagggcgtgatgtccgacccgaatttcctgcggtctctgatggagattgattttgattcgattacccagagccaagtgaaaaacatcaaaggtgagtgtagccacgtgtgggaatcgccagggtggatctcggtctggcatctcaggctctgggacagggatggagggcaaggaggcttgtcgtgggcaggccctccccttctggtcagatggtatcggatggaacaggcaactgatggtcaccagaggaaaacagcagccccatgacgtgacccagggagagtggctggggatgcgcggcggcagccgtgcccactgagggttcgattcggcactagtcctagctctccgtgtcaggaaacaggatcttctcattggaacctagcccagccttgtcttctgtgcatctcacccagtgctgttcagtgcacatgcagaagcccagagctagtctgaccttgacttcccccctttctcctcttgtcagtgtcaagtcttctggaggtccctggggagtgggcatgggggtgggcagcatcactgatggccagcctctcctccatctttggttataggactgagttccccttgagctcagttcctgaccctgcccagtgctcagccaggcggtgatagtgtaatggtgttagtctttgcgaaaagcaatacaagttaacgctgtgtttgatggtttatttagactcttatcaaatgctttttcttagccccttaaaaacaaaagcaatctcaacacaaatgaccccaaccactacaaaaacccaaggcactccctctgtctgaatcttcattggatggacttccgtttatgtgaaattactcctggggtgagggtgcgggtgaaggtaacaggtgacctgtagtggcctgtgaattccagttagccacctgggtgcccagttgggagtctccgttacgccctgggtctcctgtgtgacacctgcgtcctgggtggcagtaaaccatgtcccttgcccacatctgaaacatccgtttatgcagaacccatcttggtttgacaccacgctgttggccgtaggagagctttgtgcattctgctcacagggccactgaagaataagaaactagttatgcttattttgtctattttatgctcccaagatgaagcttgccactcataaaaattattgcatgtttcacgttaggcctcttgaagactcttaataccacaactgaagaaatggaagctgtcagcaaagccgggctggggatgctgaaatttgttgaagctgtaatgggctactgtgatgttttcagagaaatcaagcccaaaagagagaaggtattgcccgaatgtaagactgccacaccactgccaagggacccattcagagtcagaattcacatgtacatacctttgctgaaaaacttctcccgaggttctgacttcaagctgcataaactttccctccaccacccaataaatggcaatcctgaaacaccactatcacttaggcatagtgtgggtggtggacaagaccgaggtctgaaagagtttcaaacttcctgtgaaagtgtagtataaagatgttcagaccaggcgtggtagctcatgcctgtaatccagcactttggaaggcccagatgggaggatcacttgagcccaggagtttgaaaccagcttgggcaacatagtgagaccctgtctctacaaaaaaaaagttttttaattagccgagcatggtggcacacacctgtactgccagctacttgggaggctgcagtgagctgtgattgtaccactgcactccagcctaggtgacagagtgagaccctgtctcaaaaaaaaaaaaatgacgtaaagatgtttaaagttgtttctctagggtcaaagcagagtttctcagctgcagctgaatgtggcctggtggtggtggggggtctgtcctgggggatctgtcctggggggtctgtcctggggggggtctgtcctggggggtctgtcctggggggggtctgtcctggggggtctgtcctgggtgggtctgtcctgggggagtctgtcctgggggggtctgtcctggggggtctgtcccggggggggtctgtcctgggggggtctgtcccggggggggtctttcccgggggggatctgtcctgggggagtctgtcctaggggggtctgtcctggggggtctgtcctggggggactgtcctgggaggggtctgtcctgggggggtctgtcctggggggggtctgtcctgggggggggtctgtcctggggggtctgtcctggggggggtctgtcctggggggtctgtcctggggggggtctgtcctgggggggggtctgtcctggggggtctgtcctggggggggtctgtcctggggggtctgtcctgggggggggtctgtcctggggggtctgtgctggggggtctgtcctgggggggggtctgtcctggggggtctgtcctgggggggggtctgtcctggggggtctgtcctgggggcatctgtcctgggcggtgtctgtccttggggggggtctgtcccggggggactgtcccggggggtctgtcccggggggtctgtcctggggggggtctgtcctggggggtctgtcctgggggatctgtcccggggggtctgtcctgggggggggtctgtcctgggggggtctgtcctggggggtctgtcctgggggggtctgtcctgggggggtctgtcctgggggggggtctgtcctggggggtctgtcctgggggggggtctgtcctgggggggtctgtcccgggggggtctgtcctggggggggtctgtcctggggggggtctgtcctggggggtctgtcctggggggggtctgtcctgggtgggtctgtcctgggtgggtctgtcctgggggagtctgtcctggggcggtctgtcctggggggggtctgtcccgggggggtctgtcctggggggggtctgtcctggggggtctgtcctgggtgggtctgtcctgggggagtctgtcctgggggggtctgtcctggggggtctgtcccgggggggtctgtcctggggggggtctgtcccggggggggtctttcccgcagggggtctgtcctggggggtctgtcctggggggtctgtcctgggggggggtctgtcctgggggggtctgtcctgggcactataggatgtttagcagcatcttcagcctcaccccactggatgccagcagcaccctccctccaagctgtgacatccagaaatgtctccagacagtaccaaacgtcccctgggggacaaaacctaccgcagttgagagcagcggggccaaagtcacatgaagatcacaaaatacaaagagaataaggttaatttgatcattttgagtcatattgtgaccttgcgctatagctcggaattgtattattcagaaagcttggaaccaatagaaatactgttactgtctatggtatattcttctgagtttttgacttagaaccacagtgtcatcttacggagacctcagtacatgaaagtaaaaccatttgataacttgggtgctgtgtcttctaatgggacatggagtttttgcagcaaacagtcgaagaagaaactaagaagccacgtgtctcaacatagcatatagaggctctgaaaagcacagacaccattagagcagtttagacatgtggcctggtttgaggccatgggatcgcggccccaccacggtccttttccccatctttttgcaaattgtcttcacttaggtggccaggctggagcggaatttttacctcactaaacgggaactggaaaggatccagaatgagttggcagcaattcagaaagagctggaaacattgggtgccaaatatgaggccgccatactggaaaagcagaagctgcaggaagaagccgagatcatggagaggcggctgattgccgcagacaaactcatctcgggtctggggtcagaaaacatcaggttagcgctgctcacgagcccacctgttgcggtttgtaaacggacgtcacccacagagtttctcgccatgttgattctttatctcacgttgtgtttttatgtgaaaaccatgtgaccaggtcttatgttcctattatcatgtttatggcagctaatggctattttataggctcttgtttgtattaggcactgagtgttatttattaattactaagggtcaaggaggcagtgcagctgtggagacgggggaatccataccatttagcagggtgctctaggtttgggaagtgttcacttcttggtgacctctaacccctgggtcttttctagaagagtctgtgggagaagcccatctctgtcaccgcacagatgccttctaagggtcccagtggcttgttcaatcctgggcttcagtcttaagtgatggggctgtttgatatttatgggcaagaccgcttggccacagcttattcaccaaatagggcaacaattttgaatctagcatctgtaagtgtggtgtagaaaacactgaaaaatgttgtttgcgtgtgggaaacaattttcagtatttcttaaacctaagtcttggggcatttactgaaagaggacaaatgaaacagacgctttcttttatcttgggtggaattctgtcattgagtgaggccagaacttgttagctctgccgggctgatttatatgtctttgattaaggcttcagaaacaacgtgattactacttaatatgatccacgcaatgtgattactgcttaataaagaccacaggcctttactgagccccctgcttgatgctggctccaaataccaggttcactagggtgggaagttgcaagataagctgttggtctctgttcctcacaaggaaagaatatctcaaaacatgtttccatctggctagccctgttagcaaggtatcaagctggttcttctggaatgttccttttggttgtggccagaaggtaaactcacggcagcctccctctcctcccgtgccaggtggctgaacgacctggatgagctgatgcaccggcgcgtgaagctgctgggggactgcctgctctgcgcggctttcctcagctacgagggagccttcacctgggagttccgtgacgagatggtcaatcggatttggcaaaatgacatcctggagcgggagatccccctgagccagcctttccggctggaaagcctgctcacggatgatgttgagatcagcaggtgtgtggcaccctgagccagcaggagggaggggacaccttagcacagggggtctacgtgggtgtcaccctggggggaggcaatggcctggggggcatcaccaggaccacagttggctcgactgcatggaagtggccgggcaagctgcaaacccagcacggagcccttctccctggcctctgaggaggcttgtgtggcctggggatgggtagattgttctggaaggccagtcctaccacccttagcccttggctcacaaattggtgagaaaaattcatttcccaatggctgtttcttccagatggggatcccagggccttccccccgatgagctctccgttcagaatggcatcctcaccacccgggccagccgcttccctctgtgtatcgacccccagcagcaggccctcaactggatcaagagaaaagaggagaagaacaatctgcgggtatggtggctcctcccagggcgtcttctgccccctattcctgttctctggagaatgcccctcccgcctcctgtacgtggcagtccctagcctcagcgaggctgggctgaaatgcttccatcctgacccccatgcggagccctcccccggctccgcctccgcctccaccccgtgggtctgccagggcagctcaaaccgccatgaactctgcctctcccctcgcaggctgtgagcaaccttagcttcgtgttcctctgtccagtacggggttcgtggtctgggtgctcagtcactattttttggagctgaggtgggggatggggatgcaggggaggagaggggagagtaatggcttgattgagatgtaattcacataccacacctttcccccactgaaaacatacaattcagtttgagttttagtatatttacagagttgtataccaatcaccagagtcagtcttagaacatttttattatccctggaagaaatgctacatcctttagccatcacccctccagtccttccgtttctccctccccgagcccctggcagccactcatctgctttccgtctgtgaatgtgcctcctctggacatttcttaggaatggactcagacgctgtgtggccttttgtgtctggcgcctttcactcagcctgatgttttcaaggtccgtccttgctgtagtgcatcagggcgtcattccttccttgggctgaatgatattccggtgtatgaacagacacattgtgttcatccatccatttgctgagggacagttgggttgtcctactttttggctgtttgaagaatgccgctgtgaatgttggtgcacacgtttctatgtggccatgtgttttcagttctcttggggcgatacctaggaatggaattgccggggcggcccaatcactttttgctgagctaatgaacaaattaattattttcaatttagcttttcctcatttttttctggtccttgatctcaggtatttgcctgctgttagaggaagcccatttgtactccaaggtcaggggaacagtctgcctccaaaatgcacatggagctatcagggagcaaatactatgagggcaggaacttttctagactccctcttccctcagcctgccagggagcactgaaattgtcagcctacccctagtccaattccaacatctaccctctctcttaaagaggaggggttctagcttacgggagaggggctgaggaatccccttcctttcctctctaccctgtttgagcaagatcctgccctgagcctggacctcatggtgtatatgcgttataccccttgcttctctcttcttttcacctctggccccctccaagttcctggcccatccacttcccacttccaagccattctccccttatatttggcagggccacagttaaacgtgggctttcagcatctgcctcccttctcttccaggtcgcttcctttaatgaccctgacttcctcaagcagctagagatgtccataaagtacgggacccctttcctgttccgcgatgttgatgaatacatcgatcctgtgattgacaacgtcttagaaaaaaatataaaagtctcccaaggacggcagtttattatcctgggagacaaggaagtggactatgattcaaatttcagactgtacctgaacaccaagctggccaatcccagatattccccatccgtgtttgggaaagctatggtgatcaattacactggtaagaatgtgtagaacctccactgctaattcagatggttatgagggagaccgcaacctcagatcaaggcattcatgggacatcatttcactcagtgaccccagatcattctctcataggcacatctggactagtcagctcttaccaattaggtaccacttagaaggtgtgaggccatgagtcacctgtcatgagtcacgctgagacggggccgtgggcttatgtgttcacacatggggtgggatgggacctctgactgtgggggcaggaagttactctatattcgtgtatttaaaatacatgttgtgatgttgaattttttttttcttcctctcagttgaattctgatagaaatgggatgttatctcttacattctctagggctgtcatgctcctgcttaaataggctaatttgatttggatgtactttcttttcttttttctttttctttttttgtacagatggggtttgtctgtgttgtctgggctcaaacttctgggctcaagtgatcctcctgcctctgcctcccaaagtgctgggattacaggcatgagccactgcgcccagtctgggtatactttaaactatggcaccccagtccgtggaagcctgggttttatttcagtgtgttttttcctttttatctgccactctgcaccacagcatcgctgttttgctcctgcctgccaccttgctgctctagagtgactttggtgggcagtgaatcctcgtgcctctggcctgctggctgagacccgcgctaagcttgtcccgtcacagcagggcagcgggagagactgttgttgggggccgcaggtggtgagggcctctcactgtcccccacagtcacgctgaagggcctggaggaccagctgctgagcgtgctggtggcttacgagaggcgggagctggaggagcagcgggagcacctcatccaggagaccagcgagaacaagaacctgctcaaggacctggaagattccctccttcgggagctggccacgtccacggggaacatgctggacaatgtggacctggtgcacaccctggaggagaccaaatccaaggcaacagaggtagcaaccacagtggaagaggccgtgagtcaggcggggcctgcatgcgccgttggagcgtccatttctctgtctgctcaatgagaaaatggggctctgtgatctcagggctaaaaacccacctctattgggatgtgctgtggggaggggagccctaaaggtgttcccagggacccttgggcatcaggtcagtctctttaaatcgagagtgatagaaaatccagccctgcctggcttaagtcaaaagggaagttatcagctgagaaagcagaaaagttcagagatggcctcaggtggggctggatccaggacttcaaaaataccaggaggacctggtttctgtccatttctgggctgggccttctactgggttggcgtcattctctgccagctccccacatggtcataagactggtctggcctcacgtcctctcgggtccaaacccaaaggggtaagtgagaatcttcctgttcctaccgtgaaggtcctgagagtcacttaggtcacgtttctaccccaaagcagccctgggagcttggggatgctaggctcaggttagctggccctgggtcacatctcctggagtcggggtggaaccccatatgggaagaaaagggagagggcagtaccggagacttacaagcagtgttactaggggaaggggccatgggtgcaggggcgtcagccacaaatattcaccccttcctacaagagggtgggtgccctcgctcccctgcagtccctggatactttcaaagccctgaagcattgtacatacctctctgctgtccccctgcccctcctgccctctgcccacatctcagtcttcctgtttccagggtcacctgtgcttttcttcaggtctcagagaaactcaagctggcggagaagacagccttggacatcgacaggctgcgggatggctaccggccagcagccaggaggggggccatcctgttcttcgtcctgtctgagatggccctggtgaactccatgtaccagtactccctgattgccttcttagaggtcttcaggctgtcactgaagaagtcgctgcctgattccatcctcatgaaacgcctgaggaacatcatggacacgctgaccttcagcatctataaccacggctgcacaggtgagctctccccacagaggaggacatgttagtgtagtttggtgtgccagacgtggctttaaggaaacgtgatctgtgaaaatggaaagttaccaaatagcattttttcttttttctttctttctttctttttcttttttttttgagatagggtcttgctccatcacccaggctggaatgcagtggtgcgatcacggctcactgcaacctccacctcccaggctcaggtgatcctcctacctcagcctccagagtagctgggactaaaggcacgccaccacacccagctaagtttttgtatattttgtagagatggggtttcactatgttgcccaggctggtctcgaactcctgagctcaaacgatccacccaccttggcctcctgaagtgctgggattacgaggtgtgagccatcatgcccagctccgaatggcattcttgagtctggcgattcatgttacaagaggaatgtttaaagcactgaattttaagatagcagctttattgagacacaatttacataccataaattcgtcctttaaaaatataccattcggtggtgattcatagcatatacatagagttgtgcagctatcactactctctggctccggaacgtttccaccagccccgaaatgaaatcccatacccattagcagtcaccccctggccccccactcctagtccctggcagtcaccgctctgccttccatctgtaaggatttacttgctctgaacacttcatgtcaatggcatcatacggtgtgtgacttcatgactggtatctttcactccactccgtgacctcacggttcatccgtgttgctgcgtgtgtcagcgcttcattcctgcctgtggctgagtcacattccatgtatggacagaccgcactgtgtttatccacccgtcacctgatgggcatttgggttgtttcgcttgttttgctattaaggcaatgctcctgtgaacatttgtgtgcaggtttttgtgtgaatgtgtgtttttaattctcttgggggtatatctagaaagggaactgctgggtcatagggtaattctatgtctaacttttgaggaactgccaaactgttttccaaagtgactacagtatatttaaacccctaaatcattgattttttcaaaagactttttattatggaaaacatatgcaaaagagaatagtgtcgtgatcgtctgcacagccctcacctggcaatgattagctctggatttgtttatatgtaacacggttccccatcaacccagattatgttgaaaatttgcttcatattcagatcacttatctgtaagtatgttagtttgtatctctaaaacagaggtcagcaaactttttctggaaagggtcagatagtaagtgttttaggctttgaaggctaagtgatttctgccacaactactcacttctgcagttgtgtgccacaggccccactgggcatggtggcaattgtagcacaaaagcagccattggatgatatggaagtgaatggccatggctgtgttccaataaaacttttttagcaaaaacaggcagcaggctggatttggccccttgcttgtggtttgcccatccctgctataaaatagaaggattctatctcaaaacatagacataaggccattatcatatccccaaattaataattcctgaatatcatcatattcaggttttcaaatgttcccaattgtcttatatgtcatgtttcacattattttaaatcaggacctcattaaggtctatacattataattggttgtgtcacttaatttctctcttttcccccttgcatttatttttatttttgtttgtttatttttggagacagggtctggctctgatgcccaggctagggtgcaatggcacaatcacagcttactgcaacctccacctcccaggctcaagtgatcctctcacttcagcctcctcagtagctgggactacaggtgcatgccaccatgcctggctaatttttaaaaaaaatttgtagagatggtggtctcgccatgttgcccaggctgatcttgaactcctgggcttaagggatcctcctgcctcggcctcccaaagtgctgggattagaagcataagccaccgtgtctgccccaccccttgcatttatctgtggaagaaacctacctgattgctgggttgtttcccgtcgtctgaattttgtgctcgcctctctgtagtgtgtcattggaggaactctcaaatgccaatacatgtagttcttttctcatgagactttaggattccccagtgaagagtcttcagccttttcctagagtatgtaatcctggctgccagccttcgtggaaccaagtgagaaaagaaggctgtcgatttcagcattcgtcgtgaaaacgttcactgaaagccatattttcagtacggtttaccctcaactatgcctggtgttcccccgtccagagaccctgctttatcttttccaaagttcacttgggtggggcaggcagttgcctggcagcatggagtgagaggggatctgggatctgacggcttgtcaaacaagctgtccacccatcttcctgtttttagcccatattcacccacacttccaaaggatctggtactgccagttcctgagcttttgatgtgttctgtggtttgcatctcagctttatctcctcctcatgtgagagtcaactttctcagctctgctaaatcagttatcacttgtccatctgtctgtagcttgcagttttttttttttttttttttttttttttttttttttttttgagacagaatgtcactctgttgcccaggctggagtgcagtggtgcgatcttagctcactgcaaccttcgcctcctgggttcaagtgattctcctgcctcagcctcccaagtagctgggattacaggcacctaccaccacactcagctaatttttagtatttttagtagagacagggttttgccatgttggccaggctggtctcgaactcttgatctcaagtgatctgcccaccccggcctcccaaagtgctaggattacagatgtgagccaccacacctggcctagcttgcaaaattttattgctattgtcttttctccaattttctgggagcttatacctttttaaaaaactaaccattaggccaggcgcggtggctcactcctgtaatcccagcactttgggccgccagggcgggcggatcatgaggtcaagagatggagaccatcctggccaacctggtgaaaccccgtctctactaaaaatacaaaaattagctgggcgtgttggcaggcacctgtagtcccagctactgggggggaggctgaggcaggagaatggcttgaacccgggaggcggaggttgcagtgagccgagatcgcgccactgcacaaaaacaacaaacaaacaaaaaaactcaccatttcagttggtttttgaaaaggagttgggataaactcagaatggccatttttaaccaggggcctgtagagtgacctttaggaagcagagggtgggtaggacacactcgtgtccctttccagtcctcttctgctgagacactgtactgacagtgatattttccatgcaccagcgtttggtgtattagtttgccatgcctgccataacaaaataccaccgactgggtggcttaagcaacagaaatttattttctcatagttttggaggtcagaagtccaaaatcaaggttttggtaggtttcgtttctccttaggatgctccccttggcttgtaggaggctgtcttcctgctctgtccacacaaggtctttcttctctgcgtgtgaatccctggtgtctctgtgtgtccaaatttcctcctcttataaggacaccagtgaggttggactgggcccaccttaatggcctcatttgaacttaatcacctatttaaagaccctgtctccaaatactgtcatattctcaggtactggaagttggggcttcaacataggaagtttggagaaatataatttagcccttaacagttgggcagaaaagagattgtttctatagggctcacttaagtagccaaccctcctaacacatataaagtagaattcaaattacaaattttgacttaaacaatttttttttccaggaacacatgtcttctgttaaaaagcaaaaaagaagaacgctggtattttgcatccattaataaagagtctgttgatggagtgtgtgtcctctgcaatagaggttggcaaccccctagccagcatccaaatctggcccactgcctgcttttgtaaataaagttttattggaacagggccatatccatttgtatacatattgtctatggttgcttttgcactacaatggcggagttgagtggttatgacagagaccatctagcttccaaagccaaaaatatttactatctggccctttgtagaaagtttgccaacacctcttctagactctaatggacacaaatgccatggagtcaggcaaacaacctgccttcagtggagagggctgcccctgctgtactgcccctcactggcttttcctcttcccaggttggtgtgattttacctcctgtagacatggccatttccgttacatacaggagcatgtcactacagactggggcatgacctaggaactgagctcatctctcttgaacttagatattcatggacattaggtgcaaagaggggtaaatgcagccatacagttcgagtgtttcatttatcttacgtttaagcacagtgtgcataagaaactcagttttttaaaaatgaattttaagaaatcaatactcatctgatgtttccctccagggctgtttgagaggcacaagctactcttttcttttaatatgaccatcaagatagaacaagcagaagggagagtccctcaagaagaactagatttctttttaaaaggtaatgaatttgcctagcttcattcctcccatctccttgcccacatgatacatgtatataagtttgtctgttgaaacaaacaataacaaaaattctccttaaaacttggcttccaacagcactgcatttttcactattccagttgatcattccagcctcagaaatggctctggttgaaatcggagcagccagcctctgtctcggggccatcctgaggctggaagctggatgctgcactgagcgcctggttggtgtcactggcggtgacgagggcaagcctgggccacttcctgtttccagtctccttcttgaaaagtggacttttcccaaaagtgggagaagtcgaagcagagttgcttgctttgtgttagtggtacaatggctgcttgcttctcttctgttgtgattaggaaacatttccctggagaaaagcaaaagaaaaaagccctgcgcttggttgtctgaccaaggatgggaagatatcattcttttatcagaaatgttttcagacaactttgggcaacttcctgatgatgttgagaataatcagactgtctggcaggaggtgagcccacgttccctttctcctcctctccttccccacatgtcaacaatctccaaacctcaactgtggcccaaccccttaagagaagacactcctttgagtaacccattcagtgtgtaactgatgccctgtaactccctgattggaattctcctttggctaattcagctagttgtatgggagatccaaccatctacctgtccgtccgtccatccatccatccacctacccacccacccatccatccatttacccaccgacccattcatctacccatctgcccacccacccatctactcatccatccatccatccatccatgcacccactcatccatccacctacacacccgtccatccaagaaatagttgttgggcatctgccatgtaccatgtcccttgatgggcactggggactcagtgaataagactcagttgctcctttctcaatgtcatagcctttgggggtagagaatgacagatctgaccaggtggccttcagttagtacacctatggattctcgtccctttccagtggcttttgccaccttcacacataaatggggacctatgtcatttctgagttgacgcacaatgaatattctttgcttttcccagtggtatgacctggattcactggagcagtttcccgtccccttgggttacgataacaacatcacccctttccagaagttgcttattttgcgctgtttccgtgtggatcgggtctatcgggccgtgactgactatgtgactgtaacaatgggagagaagtaagtgtgtcgttttgttgatttgccactttccgtggggtggaatctctagcgtcctcccaccttggactcaaagaaagcagaggctgaccagctcccgagacagctgtcgccaccctgctgtacaatattcgatagccgatattctagaattcttcaatattctagaacagtgctagtcataagaaattcagtgtgagccacatatgcagtttcgaaagttctagtagctacattagaaaagaaatgggcgcaattaattgtaataacattttatttaaatgaatatattaaaattatcatttgaatgtataatcaatatgaacatgattgagacattttacatgcttttttctggtattaagtctacaaaatcctgtgtgaattcacacttacagcacatctcaattggggctagccacattttaagtgctgtgcctcacggccatcgcactggacaatgtagctctagcatggggtacgaagccaggcggagcgtgtggggctgcagctcagatgtgcccttgtagccagcaggccatggcagtgagtgatgaggctgggtggggtcctggtccctgggcagctgcccttagctcctgctgactgataccaggtgccattgggaacccacagtggctggatcctctgactctgaaagaagctaggacttcagattttttcctgaaatatcccaatatctttgtgtttgcaatgaattttaaaacgcacatctgggtcaggtgcggtggctcacacctgtaatcccagcacttcaggaagctgatgtgggaggatcgcttgaggccaggagttcgagacccagcctgggcaacatagtgagatactgcctctaaaaaataaaaaataaaaaagaattagccaggcgtggtggtgcacacctgtagtcaagctactaaggaagctgaggtgggaggattgcttgagcccaagagtttgaggctgcagtgagctgtgatagtaccactgtactccagcctgggcaacagagtgagattatatatttcaatttaaaaaaaaaaaaaaaaaagaaaaagaaaaaacccacacacaaaacacaaaactcaaaactcaagatgtggaccattcaggacacgcctgtggaacctcagggttttgtgccatgggcaggcccacctagagggcaagctgaggtgcccagctcagcacaaaccaactgaatcgagtgtgagggggtacagagaagtccctgccactcaggagttccccatcagggtgggagacgtgcatagaaactagaatctaaaacagggaagactgcaacgagctatcccagaggagtggtcagaaggttctggacaccggaggaggcagcgctgatcagacagaccagcccctggtctggagctgtcctcgcgggagagttttctgactgtgtttctttcaccaggtatgtgcagcccccaatgatcagctttgaagctatttttgagcagagcactccacattcgcccattgtgtttatcctgagtcctggctccgaccctgccactgatcttatgaaattagcagagcgaagtggttttggaggaaatcgcctcaaattccttgcaatgggtcaaggtcaagaaaaggtaatttgtggctgaaaggaacaagctctacgtttaggggaggtccctggtgtctgctaagaaggagctaacctgggtttaagctgagtgccacgccacaaatcagttggatgcatttccgagctaagaagcagtaatgaaacactgggaagatgacaataatagttatgatttcacaacctcatgttgtgatcatggtgctgtgctgttttctttttttttcctttttcttttctttttgagacagggtctcactctgtcacccaggctggagtgcagtggtgcgaacatagctcactgcagcctcgacctcctgattgtgaagtgatcgtcctgcctcagcctccccagtagcagctgagactacaggcatgcgtcaccatgcctggctaatttttttggtattttctgtagagaaaaatacaaacacgtcaccatgttgccctggctggtcttgaactcctgggctcaagcgatccttccacttcggcctcccaaagtgttgggatcacaggcatgagacacgatgctcaggctgtgctgttttcaaagccctttcacacacagtccttaccttccttagtccctgaacagcctcattgtggatcaggattattatggccccaattgcatggccaagggagtgggtggagagaggctgagcccaggaccattcaggacagaactgtggtgcaaatcctcctacctttctgagccagtgagctttctttgctgaggtcttgcctctctgcatcacagtgctccctgctagaacttgctacacaagttcagtacaatgtgggacaaagcttgcaggaaaagtctgtgcgtcagtaagtgtgatggttgcaggcatgcgtgttggggtcagagggagctgactgccagtcctggctttgctatgaactgtgaggctttgggtaagcccctctactgctgaaagcccctgggtgagatgaggatggcaatacccatgctggatggcccaggaggcaagccctgggcaccagcaaggcgggccagctctctcaaccacaacactgaaataagctattgtaacgccagcactcatgtgttttaagccatttcagaaagcaaggcttgatttgggtgtttagcttgtttgtgctttgaattacatttgggaggggacatggtgattgttttccaggcctagggccctgaagatcttacagtggccaggacagtcccgacttcctggtgggctttagctggtctcttgcagccctgctcaggagtcctcaggggacaggagcgactgtgtgggaggagctgggacttccagggccagggaggcagatgagtgcaaaatgctcacccatcttccaggctgggtgtgaccagctcagtgcacccacggggcccatggggtttctcaaagatggtttatttgaaggctccacctgtagctcctggatcctcggcttgcttttggcttctgctggagctgccatcgcccttctgtgggtgtggagtgggtctctggagagcacggggttgggtttggatgccaacccctctcctcttccctctcccccggcgcaggtggccctgcagctgctggagacggcggtggctcgggggcagtggctgatgctgcagaactgccacctcctggtcaagtggctgaaagatctggagaagtccctggagaggatcaccaagccccacccagacttccgcctgtggctcaccacggaccccaccaagggcttccccattgggattctgcagaagtccctaaaggtctggcttcaggatggacatcaacatgccagcacgcagcttctcagaacacctgcatgctgctctggggccggggtgtgcctttgtctgtgtagaaataaaccttaggctgcaggtgaaaccttgcggttgaaacccttctcaatcccacctctctctttagagggagccgctgtcctgggttgggtgtttgtgactcccaggcctatctctaccaattctgcatgtgtccctaacaatatctacgctacttttcataaacttcacggcccccccccccacacacagcctgcagttcgctagtgctgactgcaggagtttcgcgtggtttacatgccccatttaatttattctccgggaaattcttttggaaaggttttgtcattctctgtctctctctctctctctggggaggtggagggaagactttactttcattttatatatagtaaaggatctcatggttcagaggaaggtcaaagactcttgacccttgaccctgagagccagaacatctagtcctttaacttctcagcctgggccctggacaagagactttagctattggaggtctcagacagatggctccgtagagaggaaggaaagcgcagtgcctgcattgtgcacactcttccaagcttgtgggcctgcggtctccatcactgtgtgttttcttctcttctgaaggttgtcaccgagccacccaatgggctgaaactcaacatgagggcaacttacttcaagatctctcacgaaatgctggaccagtgcccgcaccctgccttcaagccgctggtctacgtgctggcgttctttcatgctgtggtgcaggagagaaggaagtttgggaagattggctggaacgtgtactatgacttcaatgagtctgacttccaggtgacagtggctgcttctccttggaaatggcttccttaggcggcccacttcctcccgactttcctccgggttcaaccacagcagggttgcaccgttcccagcagccttttcagaaaagtatcagaatgtgaacagcttggtgggtttcagtataactgagcgtgttctcttctttcaaggtctgcatggaaattctgaacacgtacttaacgaaagccttccagcaacgggacccaaggatcccgtggggcagcctcaagtacctaattggagaggtaggggtgaccggggatccttccgcaggtgcctctggggctacagagctgtggcctcgtgcccctattttcctctgagccctcagaaccagcctcttctgcccctgtgttccccttgggtttctgtgacaattctctctgctctcacctggttgttctttgtcctaagtgagctctgttcacatggaggttccctgagctggatccatggctggggatccaggcaaggcatcctctagccccttgcctcagctgttgctgtatacagagctcacaggaagcatccccggtggtctgcacacggctcaggcagtgacatcaattccaaagacagaagcagctgctggcttcttcagctgtttgtttgatgtgtttgggggactttgcctgctgcacaggagctcccaacacttcctgagggcttcttactgctttgggccctatcccttgggaagccagcaaagccacagatcaattgtgtgaacagtggcccgaaaggttatgcaagtcaacaggttcaagccttgcagcagccaggctgctggagtctcttgaccctgggtgagcctctggccccgggcccccagggtgcacacagtaggttctgagctcctggctggctctcaggccctctaatttcaggtcatgtatggaggacgggccatcgacagctttgatcgccgcatcctgaccatctacatggatgagtacctgggggacttcatttttgatactttccagccattccacttcttccggaacaaggaagtggactacaaaatccctgttggtgatgaaaaggagaaatttgttggtgagatttctcagacatgaaaagatgttttcaaggctttttctaagggagaccatacatttcaaccggctcctctcctggtgggggctcctcggctggtcaggtgtggtctgttaagcctgttaggtggctcggcagacgcttcctggctgcagagctgactgatagagttcagatttcccatcctggaatgatggtaaataaatcaggttccacctggaagggcagaatggccacagtgaagctcactgagccattttcgtaaaagatgaacatacggctggactgggtgtggtagtgtagaatttttacattaaaaacatgtcattggctggtcatggtggctcgcacctgtaatcccttctttggaaggccaagaagggcagatcgcttgagcccagaagttcaagaccagcctgggcaaccaagcaagatcccatctctacaaaaaataaacaaaaaatcaaaacaaaaaaacaaaaaacaaaaatattagctgagtgtggtggtgaatacctgtagtaccagctacttgggaggctgagatgggagaagagcttgagcccaggaggtcgaggctgtagtgatcaatgaccatgtcagtgcacttcagcctgggtgactaagaccctgtctcaaaaaaaaaaaaagtcaccctctaaacagtggaaattagtcttgcatgtcttggagactttgaggctgtgggccctgagaaagcacaggtggctggacagtgccacctccgttgttctctgtgattgcagaagccatcgaggccctcccgcttgccaacacgccagaagtgtttggtctccaccccaacgctgagattggctattacacgcaggcggctcgagacatgtgggctcacctgctggagctgcagcctcagacaggtaaactctactcaggaggacttcattagtttgattggggttttacgattgcttcttgtagccctcccacgttgctgatgcctttcccagaactggaaggctcaggaggctccggttctgcacgtggatgccttgctttctctgaaaagtgtcctggttttaggggaatccagcagtggtatcagccgcgatgattatattggccaagtggccaaagaaatagaaaacaagatgcccaaagtctttgacttggaccaggtgaggaagcgcctcggaacaggactctcccccacttcggtggtgctcctgcaggaactggaacgcttcaacaagcttgtggtccggatgacgaagtctctggctgaacttcaaagggtgagcctgtctctcatgtgcagattactgcctagatacgtggcacctggggttctgatagagtcctgcccgattgctcttgattctaaataggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtgggtaagtggcacgtcaccgcctcctctctgccgattcaggtgtcagcctagactcctcaaaccacctcccaatcccctctttccattgcccagcagtaacctctgttaaagtttattgggtgctctggaaatggtctgagattcttacaagcctatctgtatcttttgtttttccttttcttttgaagactttgaagcatactcttacatacccgattattttatctaagtgtatatcttggcacttgttccatattagtacacagctagctcgttcttttttagagtatgccattgtacaaatgtttcatatcctttctcctccttctgtatcctaaaaatatggtaactgcctacatttcggtggttaccattttttttttttttttgctaatacaaataacattctggtgcacatgtatatgaatatgcataggggtatattccatgggtaaattctgacagtggaagagttggatcaaagagcttgtgcattttaaattttgatagctcttgttggatggttcttagaaaggctgaaaccacagtctatgagagtgcttctttcctcactccgctgcaatgctgcgttcttaacattttggatcactgtctccctgataggtgaaaataatatctcattgttttgcatgtctttaattatggtgagtctgagcgtattttgcatgctttacagacattttgtgtttgtttttctgtgaattgtccttttgtatctggatttcatttttagtgaggtctccatctttctcattgatgtttaagagctctttgcaaatcaaagaaattagcccttggtctgccagtgttgcaggtatttctccaagcttgtcataagtcttgactttgcttacggtattttttccacagaaaagctttacatttttccgtagtcaaacctacaaggcttttcttttttatcctgggctttgtatttcctactccacgatatgaaagcattcattggagatgtggcccagtacttttgtggttttatttatttttatatctaaatctttgatctacctggaatgtggcagtccagattgtttttctcagacaggcggccagttgtgccaacgccatcttttgccacttaggtgaaatatgtcttttatcataaactaaacttccaggccagctttgacctggcattggatggcagccccaggctcccagcacttgtcctctcttctctccaggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggtaccgtcagctcgttagggatccacagcctctcacttaggatttctctccctgaaccacctccaactcaaagggacaggcatagcgtgggcctaaatgggccaggccatgtttgaaagccagcctgctgcaaatatttcctgtgtctctgcactgcccatgtcttaacacctctgagggtggatacggaagtttctcttccactttctccgttgagacctggggtctatggcaggggagacctgaaccatgttcactctgctagctcatggcaagtgggctcctaggtcagaattagctcttgcaaaaaccatcaggtggctttcttgtaacccctgacggggccaggggcatgggagccacagagcagcatggactaacttggttggaactctttgattatgccagaacttcaggtcccttagacattggttactgactgtgcaaatgagagctggaaactgctgtttccccgggtccatgttgtcttagagttcttttaactgcaaggaacaaaagctcttttgagatggcttaaggactggggacttacggtaaagatgcagggactctccaggtctcagtggcaggggaggtggcaggtgtccgggccaccactctctctggggccacaggagtgtgttcctctctttgcacatctgctgggtcctcctccccggagaccactttctctgtgaggcttcgacttcctgctccccagccacttcggctcacagggtagctggggttgccatggtgcccattctgactctgggaccatgcatctttctagcctgggggcccagggtggtctaagtccgtgggccttgatgccccaggaatgaggattcctgggggagaggccaccgccccacacccatttctctgggccatggggcagggccacagggtctcctgtctgggctgctcctccacagagggaaggtgggcaggacagaaatgctggagaagggcctgggctgtccccaatgcgctggggaggaggccagccagtggcctgtgtgtcgctgtgtgtgcgcctgatagagccactccgtggcaggctgtgcatgctccagttgtatccagtctctgccttgtgtccctaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcaggtgaaggtcccagcccctcctctctgacaccagggcccttcctcttctgactgtagttatggctgaggtggtttccaacagtcctactttttaaaacaggggtgcctaagctttatgggctggggagagtcttggagccgtgataaaagctacggatagctgcttcctggaaaaggcgcggctgtatgtgtgtgtggatgccggtccttccagaggtgtcaggctcaagctgtgatcctgtggtctagactaaccaaggggagactccctcccttcttgcaaaatgctgcagacattgcctgagtcataaagtggttcccgctggtgtggacagcagatgtcttctgctctgcctgggccaggacccacttttaaccagggtgtcagtgtgaagccaggtccccgtgaagctggcggagggtggccctgagcagccccagccttgtgcgtgttctcaggtgcagtcttgcacaggggcccctgcctgtcaagacttacactgcacctctgcctttatccctctgcaccctctctccgtgggggcatctcacctgcctttcccttgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagtattttaa

SEQ ID NO: 2481 - DNA, 202346 bp, Homo sapiens
acttggttttataatgtatatattttaagtaggacaggtttttttttttttaaacttttggatgttttataaatttgtccaatttagtcatccaactgacaaagcaaagcaaccccgcgcttgatccagtgccgagtaggttggtctgtttttaacaacattgcaatgacaaagttagtagaatgtcccgtagtggaaagagttcctttacgttcacttgtcttgtagaggggacagacataggcatccgactttataatccgagatttttgagcttgaaaaaaaaaaagaaatatattcacttgataaagggaaaaacagccattggtacgaaaagaactatttatcttgtaataaaatggccagaactaaatctaagatcataattgtgatatatgaaggttttacagcatatatatttttttacagtacatatagtattacggttgtgaaacaaggcaagtatttcttttcttttctttttttttttttttttggagactgagtctcactctgtcacctaggctggagtacagtggcacaatctcggctcactgcaacctctgcctcccaggttcaagcgattctcttgtctcagcctcctgagtaggtgggactacaggtgcctgccaccatgccttgctaatttttgtatttttagtagagacggggtttcactatgttggccaggctggtcttgaacccctgacctcgtgatctgcccgcctcagcctcccaaagtgctgggattacaggcgtgagccactgcgcccagcccaaggcaagtatttcgtatggtgcatgattctaggtgtggaagacaggaatagactttaaagttctgaccgcttagcaggcatgagaaaactcaagaggatttgggaggggagaatgagaagggagggaagaaggaataaaatacagtataggtagtgggggagactcaaaagaagaaatacaactgcttagagctctaatccaagaaacccacacattagaagaagctgacgtttctatttgtttttagcaggtaaataataagaaaaacatgtcaactcttaccaattcatgaaaagaaactatatacaatccccaaaaagccagatataagatattaagagtctttccaaactaaggtcacgtttctcatagttataactgaaccacattcgtaatgagaatatttgataggttggatggtgattctgggtgatcagtaaatattttaagaaattgttgttatttaagaattaaaaagttagggaagagaaaacaaaagaatgagacttttttttccagacttgtagaaagatgatgatggcagaagcaggggaggagcaagcagtttcctaaatggggcaaaattggcccccaccccatgtggctagcaacatctatgccttgggggacctggctggctcctaggcctagcagtttcttatagccagaaaatgctagtcactagcgggagactgtgtcaagctaatttgtgcctctgagcaatgtgtaaagggaattcagaatcaaaatatggatgggcagctgttcaatctgtgaacccccttgtagaagtggggggaggggctgaaaagaatgacatatcccataggctacgataaaaaagcagcatggtattcccaaaataatataaatgccatacacacaaagagataataataatttctaatgtaaatgttctattaatgtttattataattgagctagatcctaaaaggtttgagcaaaaacttattttggggagcagtgtataatatccatccttattctccctaaacttcaaataaattttgttgagagaatatttacttggttttatccatatgatgggcatcaggtcaaacagaagtttgggatattgttcagcaagcaatccactgtaacgagaaattgacagaaattattagaaataacatgaaattcacttctgagaacagattgctacttagatattggcttttactaaaagaaaggactagaggcatagagaaaaagaaatgtaaaaaaagaaaatgagaaaatggcaatgaagaattgagagaaacaaaagacaatgatggaaaggcaaagggtaaacagtggacacatatgaatgtctgccaatttttaatgattgtccatgtggccagggctccaagggaaactttgtctccttttctctatcccatatattttaaacaggaatagtattgcttaatttcctgagtgaagcaggaaattcagtatttattgtaaatatttatttattatctcatcaaaatgcaagaaaaggtttcccattcactaacagaaaggtgaacttcattataactaactgtaaaccatttaaaagtgaggtggtcctacacattacaaaatagaaggaaactgttataaaatggaataggcaggaaaataatttcagctaacttttctactaataagactactgaaatattgactaaaaattattcaagacctaaaaataacaactcatcagttgccccagcttgactaataatttatgtgagagttctgatgttattattacttgccttaaaagaggactttttttttaagcaacagattgcttatcttatctatgattcagctacaaatgaagaggtcctggcagctgaatccactgacctttctcggtcccagcgtgcgccatcgagatacagtccgtggatataaacaccatcttctggtgatgtgtcagatgtatcagatgggataacctgaagggataggcacacactagcagtgatcctctccagacaacttcatctcataaagaacacattagcgaaatattcagaacacattcagggaaactctattgtataatagcttgttaaactatacattttttcagccgtagtttgtaaaaaagtataaaagtacttctttttgaagtattttatcagattgtactgtacctcataatttttgctaaagtagaagaacagcgttggattatttaaatcaaatattgcaatatataaaagttctaagggatagcaagacaaatattcttacaacacaaagaatgaagtaaaattgcttacaatgggttacaatacataaactcggtttaaatacatgacttaatgtaatgatatactgttgactttaaggagttactatacctcaaattcatatcctagcaaatcaataggggtggtatattttctggcataattctgcatagctccagttaaaaaggcctgagtgaaaaagaaacctgacagccaaaacacacaaggttttcctgaattataccagtcctacaaagggaaaacaaaacacattatgtcagtttttaaagttatacaagtgccacctgatgtacaattcctgattctggtttttgcttatgttgcccacattttccatcacgaggccctcttccctgacgtcaaacacacagcctaccttggccctctcacctctttccccttctactcttcttggaaaactcagaacaatttgagcattaacgtgaatgaaacatagtttgaagagtcaaatcttctgcaaaagccaaatgtaaattatttgatgctttattatatcatcccactcaaaagcaaccatcattagacatcttacacattgtctaattatagacctcatttgttgattccagttccttaaccctattttttttttttttgagatgaaatcgcgcaccattacccaggctggagtgcagtggcatgatcttagctcactgcagcctctgcctcctgggttcgagtgattctcctgtctcagcctcctgagtagctgggattacaggcgtgcaccaccatgcctggctagtttttgtatttctagtagagatggggtttcagcatgttggccaggctggtctggaactcctgacttcaagtgatctgcctaccttggcctcccaaagtcctgggatcacaggtgtgagccaccgcgcccggcccccagttccttaaccctcttaaaccccttgtctctgtgtccactgccctcactccagttcagctattcatggtcttctttctgtaccagtgcatgttgtcttcttgcttcttccctttctgctcaatctatccagaagaattgccagaatataactcaccgtgcagaatttggatcagacgtagcatcttgcatcagtgtagcatcagtgacctaccaaattgttcagtgatgcaccaaattaaagcttaagcctcttggtctcctattcaagatacttcacacaaacaaacaaaccaaaaacatagatacttcacaatccatccccaatgtattttcagttctattatatctcttttacttcctttcaggcatcctgcattctaatctggactggactaaagggactggactatttgctggtctctttgtgctgggtggacatttgttgttttcctgcctatcttgaagtgataccatccttctcagtccaagcttctcagtccaggcacctctggtggtagaactccacctagccatgcagggtaggctggtgactcacacctggccagtcatacttccagcctgagtgactgattcagaaatggacatgtgacccaatcaaagccagagatgcagaaactcttgctgggactttcggagaaaagactcactctcaactcctcaaagttgggtggatgtgaggccagagttgctgttgctatcttgctaccatcagatgacagcctgagaatggagtttacccaaagggaatggagacaacagatgaagtgcaagaagccaggacaagatatccatgtttgcaccctggtcaaatgttacctgaagccactttagctcctggagtttgcagttacatgagggaacaaacttcatttttgcttatgtcagaatttttgttacttataatggaatcaatccaaagtggtacagtgctttttatcccataagctacatagtgatctctttttcctttctttgcagtatctaaaccattcattctttaaatcccacttaaatgctacctcatccatgaaacaatctctgctttcttgtgccataagaactctctcccttctttgaaatcccagagcattttacatgttggtctcttatggaacatcccttactatagtgtactaattttctttagatacatggcttgtcccctgtaagctcttggcagcttcagggcaggacttttgttgtgattatctttttatcacaggacacacaaggtgctttgaataaaatgaggtctcaattcatatttatggaatgaacagatgaatcaatgaaatggactttgtctctgagcaggcaatacactctgggaagaagccagttttgctccataggaggaagagaacaaactgctgctggagatgctgcaacagtacaagctgtcaggtcaagaagaggcagagaaagagatgaagtctgacaagggtaaaaccagggagagcgagcaccaagcacaagaaagctgtaaagacccacaaggcaaacatttagaaaacccactcgcccgtggcttcctttatcccagagtgtcattagtgtctgtggtcagctacttgtactacctctgaattagctaccatttactaagtgcttagtacatgccaggcactgtgctaaacatttcatatgcattgcctcatttactctataaaataacagtgagttgaatattatttctgtcattttacagatgaagaaactggggtacagaaagatgagtaacttgctaaaagtcacaaagatagttaagtgttagatcaggatttatgctgggattttaggcagtgtgcaaaaagttttttttttaaaaaaaaggcacaggaaggagagaatgtgaagatgctatggactgaatgtttgttttcctccaaaattcatagattgaaaccctcatctccaaggtgatggtatttggagatggagcctttgggaggtaattaggtcataagggtggagccctcatgataggattagcacccttataagaagaaacagaagagacatttttctctttttctctcatcgtgaaccaggagagctgtcaccagtaacctgaccatgatggcatcttgatctcagactttccagcctccagagcttgagaaataaatgtctgttctttaagttatctagtctattttgcttttttatagcagcctgaactgactaaaaaggagatcgatagggtgaacagtgagagagaaatgaggaaagtgtagagtcctgtaacaatgaggaaagggccccacgtgggggagaacaattgttctgaaaaatgtctaattacagacaatccactagcacatcttgtttccaaataccttgctgtgcctgtagcccgagcagcaccaccttgttctgcatagcccctctagtaccaccctacaaaacttccctccagcccctggttctttgcagatagcctcttctctgctgtgctgcccactgcactgtttcaatgtattttcatactttctctaataaatctgcctttctttacctacgattgtcttggtaaattgttttactgaccatgacgctggccccagtcagttgcacccaagacagaaataatagaaaattcagatgactcatttgcttaacttgttaactctaagaaccattaggaggtaaagaagagtccaagagaaagaaagataatgagagaactatagcttctataagggtaagagaacaatggaggaaaccctttcaatattctgttttgtattattccttttgttaaacatataatctacatgaaaagctcctatcaattaataaataatacaaaagaaaaatgggcctaggatatgaattgacagtacacacacacacccacacacaccacaaatggaaatcacacatactaaagaagcataggctcactagtcattaaagaaagtcgaatggaaacagcaagatatggttgacctatcagattggcaaaaattttaaagcgatataggagaaagtctgtctctctacattcttacaagcactggttattttatgattagcttatacagtgaaagaaagcttttgtgcaataaaaaggcaactgaacactgaaagatcatatacctttgagaatttccaaaaaaaaaatagttttgggattctccccaccccatactccttcataaacatcaaccatagaatgggggcaggcagtggagttgagaaggaaaagcagtgttctgtctgatgtttatgctggggggagggcagagggggcattcaaaatacttatcttttccctggttttctgagataagaggcactgatttaaagacaatggccaattattgataaacccaagcctctggcctgtaatcccagtgctttgggaggccaaggtgggaggattgcttgaggtcaggagtgaggcaccagcgtggggtacttggtgagactccatctctacaaaaagtaaaattagccacgtatggtggcacatgcctgtagttccagttattcaagaggatcccaggattttgagattacagtgagctaagatcacaccactgcactccagcctggatgacagagcaagaccctgtctcaaaaaaaaaaaaaaaaaaaaaaaaaaaaaaaaaaaaatccaagcctcaggatttttgacttaccatcagtattaaaatcacaagacaactttaaactgtggtcttacaggaccacaaacttagaatcttggtctcagaaaaccacaaacttcgaattttgaaaaatataaatgtcacatattacattggtttggctgaagtataattttaattttccactcagtactttgaaatgtgtatatttttcaatattctaaaattttcatcagactatcacaaagctactcatcacatttcattcaactcagagacactcaagtgaccacagccaacaactaatatctccccagttaacccaaaaaataaaattttacatgtgtctgtatattttacatatttatacatgtattttacacacacacacacacacacacacacacacacacacacacacacacacacattttacctgtaaaaagttcaaccgggctaggaaatctgtgatgtaacttcccaggggcttaaggcttgggtatgaacgtttggcccatatttctggaacctttccaacaagtaagctaccggagagtgcctccaatgcagaatccatcacaaccacacccttaatagctttttcaaggtcccgtagagtgttacgtatagttataattaaactgcaatgaaagaaattatgtcatcaacatatatgatgatatcaacatacggtctttccagaagaagaacagcaggaatttcattcccagctttatgggattgcttcccaaaatgtgtcacctcccatgtggtggtacgtgagctaatgttaagtgatacatgtatgaacatttttcattttaatcattacatacatattttaaaatatagaaagtaatacaactagcatatcaaaatttttgctttctggctatttttgcttaggacctggctaatttaagcagacaatgatttaaggaaaaatattaggtaagtaatatttcaggtgacaggcaaatatgaaaaagctgtaatgatgtcgtgcaatggctgaaacaaacactgcatgaaaacataaattgtatattcatttatacacttgcaaatactttacttgcacttaggcccaacttgttaagaataccataaatatacttgtagtgagagtttttaggctagaagcctgagcagctgagagatactgtgttattatatatacataaatataacttttgtataagaaatgctgaattaactaaggcatcaggtgtatatatatatatatatatatatatatatatatatgtattttttttttttttttttttttttttgagacagagtttcattctgttgcccaggctggagtgcagcggcatgatctcggctcactgcaacctccccctcccaggttcaagcaattctcctgcctcagcctcctgcgtaactgagattgcaggcatgcaccaccacacccagctaatttctgtatttttagtagagaaggggtttcaccatgttggccaggctggtctcgaactcctgacctcaggtgattcacctgcctcggcctcccaaagtgctgggattacaggcgtgagccactgcgcctggccaggtagcagaaaaatgacaaaagatgtgactacacataggtctagctaatgtttattctgtctctaattcctaagaagaatagttaacagatggatgagaagttatgattaatgaatatttttaaccagtaataacagatctcttttcatcatcatttttacattttaaaaaatacccactcaactgggcgtggtggctcacgcctgtaatcccagcacttggagaggccgacgcgggtgcatcacgaggtcaggagatcgagaccatcctggctaacatggtgaaaccccatctctactaaaaatacaaaaaattagccagtcgtggtggtgggcgcctgtagtcccagctactcaggaggctgagtcaggagaatggcgtgaacccaggaggcagagcttgcagtgagcccagatcttgccactgcactccagcctgggcgacagagcaaagacgccagctcaaaaaaaaaaaaaaaaaaaagataccctctcttctgagacagaagatatggaactttttctttcttttctttttctttttttttttttttgagacaaggtctcactgtgtaacacaggctggagtgcagtgccacgatctctgttcactgcagcctccatctcccaggctcaagcgattctcccaccttggcctcccaagtagctgagactacaggtgcccgctaccacgcctggataatttttaaatttttgttgacggggttttgccatgtttccgaagctgggatttcagggctcaagcgatcctcctgcctcggccttataaagtgttggggttatagtatgagtcactgagcctggccagaactttttaaaaggggaaaattccaatgaaatgacaggatttaatagtcttttcagctcaataccattgtgtgtttttattgactttggatggttgctgtcaggactctgagcccaagctaagccatcatatcccctgtgacctgcacgtatacatccagatggcctgaagtaactgaagaatcacaaaagaagtgaaatttaaatggcctgttcctgccttaactgatgccattccaccccaaaagaagtgaaaatggctggtccatgccttaactgatgacattaccttgtgaaattccttttcctggctcatcctggctcaaaaatctcccccactgagcaccttgtgaccccccactcctgcccgccagagaacaacccccctttgactgtaattttcctttacctacccaaatcttataaaacggccccaccccatctcccttcactgacaaaacctctcttttcggactcagcctgcgtgcacccaggtgattaaaagctttattgctcacagaaagcctgtttggtggtctctccacatggaagcgagtgaaatttggtgccatgactcggatcgggggacctcccttgggagatcactcccctgtcctcctgctctttgctcggtgagaaagatccacctatgacctcgggtcctcagaccgaccagcccaaggaatatctcaccaattttaaatcaggtaagcagccttttttttactctcttctccaacctctcttactatccctcaacctctttctcctttcaatcttggcgccaaacttcaatctctctcttctctcaatttcagttcctttccttttctggtagagacaaaggagatgcattttatccgtgaacccaaaactccggcgctgaacatggacttgggaagacagtcttcccttggtttttaatcacgcaggggacacctgcctgattattcacccacgtttcagaggtgtctgaccacacagggatgcctgccttggtccttcacccttagcagcaagtaccgcttttctggagggccagaaccccccgaccccttttctccgtgtctctacaccttttctgcttttctggagggcaagaactctctgaccccttctctccatgtctctaccccttctccactttcctggggggcaagcaccccccaccccttctcttcgtgtctctactctcttttctctgggcttgcctccttcaccatgggcagccttccaccctccattcctcctttttctcccttagcctgtgttctgaagaacttaaaacctcttcaactcacacctgacctaaacctaaatgcctcattttcttctgcaatgccgcttgaccccaatacaaactcgacagtggttccaaatagccagaaaacggcactttcgatttttccatcctacaagatctaaataattcttattgtaaaataggcaaacagtctgaggtgcctgacgtccaggcattcttttacacattgttccctccctagtctctgttcccgatgcgactcatcccaaaccctccttctttccctctcacctctcccctcaatcccaaccccaagcgtcgctgagtctttctaatcttccttttctacagacccatctgacctctcccctcctccccaggctgctcctcgccaggccgagctaggtcccaattcttcctcagcctccgctcctccaccctataatctttttatcacctcccctcctcacacccggtccagcttacagtttcattccgcgactagccctccccctcctgcccagcaatttactcttaaaaaggtggctggagctaaagacatagtcaaggttaatgctcctttttctttatcccacttctcccaaatcagttagtgtttaggctctttttcatcaaatatgaaaaacccagccagttcatgactcatttggcggcaaccctgagacgctttacagccctagaccctaaaaggtcaaaaggccgtcttattctcaatatacattttattacccaatccgcttctgactttaaataaagctccaaaaattaaattccggccctcaaaccccacaacaggacttaattaaccttgccttcaaggtgtatgataatagaaaaaagttgcaattccttgcctccactgtgagacaaaccccagccacgtctccagcacacaagaacttcaaaacgcctgaaccgcagcaccgaggctttcctccagaacctcctcccccaggagcttgctacaagtgccagaaatctggccactgggccaagaaatgcccgcagcccgggattcctcataagccacgtcccatctgtgcgggaccccactgaaaatcggaccgttcaactcacctggcagccactcccagagcccctggaactctggcccaaggctctctgactgactccttcccagatcttctccgcttagcggctgaagactgacactgcccgatcgcctcagaagcccctaaaccatcacggatgccaagcttcgggtaactctcacagtggaaggtaagtccgtccccttcttaatcaatacagaggctacccacttcacattaccttcttttcaagggtctgtttcccttgccgccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctgggctacagccacacctcattgccgccttttcccccagttcaaagcctgcttcacatcctccccttgtatctccccaccttaacccacaagtataggacactgctactccctccttagcgaccgatcatgcaccccttaccatcccattaaaacctaatcacccttaccccgcataatgccaatatcccatcccacagcacactttaagaggattaaagtctgttatcactcgcctgccacagcatggccttttaaagcctataaactccccttacaattcccccattttacctgtcctaaaaccagacaaggcttacaggttagttcaggatctgtgccttatcaaccaaattgttttgcctatccaccccgtggtgccaaacccatatactctcctatcctcaatacctccctacacaacccattattctgttctggatcttaaacatgctttctttactattctttgcacccttcatcccagcctctcttcgctttcacttggactgaccctgacacccatcaggctcagcaaactacctgggctgtactgccacaaggcttcagacagcccccatttcttcagtcacgcccaaatttcttcctcatctgttacctatctcggcataattctcataaaaacacatgtgctctccctgccgatcgtgtccgactgatctctcaaaccccagcacctacaaaacaacaactcctttccttcctaggcatggttagatacgactttagatacctggttttgccaaaaaacattatataaactcacaaaaggaaacctagctgaccccatagatcctaaatcctttccccactcctctttccattccttgaagacagctttagagactgcccccaccctagctctccctgactcatcccaacccttttcattacccacagcccaaatacggggctgtgcagtcagaattcttacacaagaactgcgactgcgccctgtagcctttttatccaaacaacttgaccttactgttttgcctagccctcaagtctgcgtgcagtggccgccaccaccctaatacttttagaggcccttaaaatcacaaactatgctcaactcactctctatagttctcataatttccaaaatctattttcttcctcacacctgacacatacactttctgctccctggctccttcagctgtactcactctttgttgagtctcccacaattaccattgttcctggcagggactacaatctggcctcccacattattcctgataccacacctgacccccataactgtatctctctgatccacctgacattcaccccattttcccatatttccttctttcctgttcctcaccctgatcacacttggtttactgatggcagttccaccaggcctaattgccacacaccagcaaaggcaggctatgctatagtacaagccactaacctgcctcttagaacctctcatttcctttccatcgtggaactctatcctcaaggaaataacttctcagtgttccatctgctattctactactcttcagggattattcaggccccctcccttccctacacatcaagctcagggatttgcccccgcccaggactggcaaattggctttacttgacatgccctgagtcaggaaactaaaatacctcttggtctgggtagacactttcactggataggtagaggcctttcccacagggtctaagaaggccaccatggtcacttcttcccttctgtcagacataattcctctctctggccttcccacctctatacagtcctataatggaccggactttattagtcaaatcacccaagcagttcctcaggctcttagtattcagtgaactaatggtcttttaaaaacacacctcgccaagctcagccaccaacttaaaaatgactggacaatacttttaccacttgcccttctcagaattcaggcctgtcctcagaatgctacaaggtacagcccatttaagctcctgtatagacactcctttttattaggccccagtctcattccagacaccagatcaacttggactgtgccccaaaaaacttgtcatccctgctatcttgtctagtcatactcctattcaccattctcaactactcataaatgccctgctcttgtttacactgccggtttacactgttttccaagccatcacagctgatatctcctggtgctatccccaaaccgccactcttaactcttaaagtaaataaataatctttgctggcaaggctacgctgaacctcctcaggcactctctaattagatgtcctaggtcctcccaattcttagtcctttaatacctgtttttcttcttctcttattccatttaattttttaattcatacaaaaccgtatccaggccatcaccaataattctgtaagacaaatgtttcttctaacaaccctacaatatcaccccttaccacaaaatctgccttcagcttaatctctcccactctaggttcccacaccgcccctaatcccgcttgaagcagccctgagaaacatcgcccattctctcttcataccaccctcaaaattttcgccgccccaacacttcaacactattttatttttcttattaatataagaagacagttgccttctgaatcactggggatatagatccttacttgttaaatctttccatttcttgtactaacacagtattcatgctttcttcatatctcacaggatacttccgtagtgccatttcaatgtcgaaatcactagggagctaaaagaatagattttgaagatcacaaattattctcagaatggataattagcttaattcagccattatataataatagctaatactagggtgtatatgtacattagctcataacgtacagtaatgtatataagtcctatgtaccttagctcatccacaaccacagttactaagaacttactatatgccaggcattttataagccactttaaattcatgatgtctttaatgttctcaaaaaacttaaaaaaattggtagtattatcaccatttaacggatttggaggctaatgcttagagaggcaaagttcttgctcaagatcataatgctagtacatggagttttcagattgtcatttcagtatcatttttatttatattataagtaacatattttaagctgaacattaccttgttgaggatatctttggtaatttctaacagaatctgatcagtacttcctgaggctcctgtctgtttggagcctccctgggtgaggagcaaggactcaaagagggtttttgtttgttgaagatccttggagatgtcaacgttttcatgtaatccaaatatctcagggtgttgagtaaatggaagtttctaccagaaaacaaattaagcatgcatcatattttccctggatactgaaagggatgatcaggatacgctactccaaaatatgctactttggcataggggttatgtgagttgaagccaattaataattaacagatacagaaagaggtctctgccctccccttatctgtctaaaagtagggcatcaatttccatttttgacttgtagcatacatttcctctttcttgtaccaggatgaagagaatgacccttctcactggagacagaactggcactgagatgagtctgtataaacagacctcagtcaaaataatccttatcttccactagtttcccccatatgtttcctaatcactttcccacaatgtattgcccctagaactctaaaccccctttcctttatctagtcatgtctctacaatttatcaccctctgttaaaatggtaaatatgcccaagtacaactgcatcgtttggttttcactccttttctgcaaagctcatgtgcacagaaaaatgttaatatccatacaaactatactgcctcttctcctgctaatttgttttttgtcagtttgattggcaggcccctggcactgagcctaagagggtaaagtttttcctttcctacaatacatgaattcataaggcagacatgtgcagaccaaaaaagggttaaaaatcaacatcaaataatggaatactcaaacttttctaattttcagtaattactagaaaaagattattaaaagttgattaaaaccataatatttgtctaaacctatacattagagaagaacatttcaccatttgctgttagaaaaatcacacattaatctaaccttatttttggtgacatcattaccttaatgaattcaatgtagtcctcataagtgcctttaggaggtgcaaaatagtttccactgggagaaaacttataatgagggttttcaactatgtacagattataaaagtcagccagcatggttaatagaagacgtctgtcccaatcgtctgtcactcttcctccataattacactccccagtcaggtaagatatagcttcaaatggaattgtatcatattcattgataaataactgaagcaaaggaaaaatgaaacaagaaaaaccttaaagtatttcacttcatttccattttaagtatgtatctatctatctagaaagggggttgaaagaattatcatgagttgtctttcggtagctgagattgttagtttttttttggacagtctcgctctgtcgcccaggctggagtgcagaggcatgatttcagctcactgcaacctccgcctcccaggttcaagcgattctcctgcctcagcctcccaggtagctgggattacaggagtgtgccaccacgcccagctaattttttgtatttttagtagagacagggtttcaccatgttggccagactggtcttgaactcctgacctcaggtgatccacccaactcagcctcccaaagtgctgggattacaggcgtgagccactgcagctggctgatagtattttatcttaaattgcttgtctgtgtctctaattttttctgaaataaagacatattgcttctgtaatgagaaaaacatttaataaaaaaagacgacatggaaattaccaagtatttttcatatgaatgtggataaaccttgttttatggcactagctatcaactggggttttgtcccccaggttacatttggcaatgtctggagataacttagatggtcacaactgtggtgggggctggggtgttactggcatctattgggtagaagcctgggctgctgctagacaatacacaggagagctgcccacagcaaagaactatctggcccaaaatgccaatcatgctaaggctgagaaccaggtgcctggtttaggagacttttcacaatgtgattaaaaacaaagcaatttcaaactttagtgcaacagcataaatcacacactatgacacagttccactggcaatacatatcatttctagtttccttattattgttgtaataatagtaataaaaactatcatttgcatagtttttatattgtcttattcgcctctcaataactctgcagagtaggaaacagtctagtaaatgtgaagtaatatgaaggcctgaatttatttcttccagttccagatcccatacttgttctaatatacaggaatttttgatagtatgtgtattgggatggtataagttgtgggttgagagcttttcctgcccctgaagtttacttaattatgcacagttgagaaaaaaataattctaaattctctagaaccaagttgaaagaaggcttaatcctttaagactcccacgttttgaagaggaagagaggcgtcaagagatatgaaaggggactgagaaagagggaaggtcgtcgttttgggaaatgaattatttgcaaaaagagtaaagtttttccatgtctcttctttgggggaggggaagggtgtgttcaactgggttccttcccctcccaaagctgaaggaagagacttcacgagaatgtaatgttaaatttgtggcatatgcaagaagtggagaccaacagctcattctctggctgtctttccacttagccccatcagttttctgatttgccttttggagagaggcagcctgctcataccaggtgaagatggcttaaggattaatcctcaatcatctttccagtttctgaagaaatgaaacacggatccagccaatgctggcagtttccaatgttggggctagaaaggttgatgacatcagaagctgtaggctggggcttggccagaagatgattgattatatgcagtatgatggttttggcaaaatgttctccaagcttaggctgtaccaactaaattggtctcgaaaaccaatgtttaaaatcaacgtcatttcatcatgcagttacaattccataggcaccaatctcaacaactgttacaaggattttcaaatggacatatttattccagttaaggtttctgccctgatattttttaaagactcgataaaatatcaactatttctatacaaattatgtgttaacaatttttattttaaaggttggtgtaaatatgattaaatgcttatagccttacaaaaacctacctgactgaaatctaatagcaccaattaattagactttatcaatgcttctcttttcacttcattaggtcctatttcaaaaaggcccctcagaacagcaaaagagcagaaaaatattaatattctgtgtttgtgtgaaaggccagctactcactttcccaagctcccttacagctaaagcctacgcctgtgacctgggcttggctactcagatgcgtccaccttaaactaagtaggggattaatgtacagagaagcaagaacagaccacctatggtggctcatgcctgtaacccagcttgagaccaggagtttgacaccagcctggacaacgtagcaagaccctgtctctacaaaatacgtttaaaaaaaacaacaacaaacttacaaggggccgggcatagtggctcacacctgtaatctcagcattttgggaggtgaggcaggtggattgcctgagctcaggagtttgagacaagcctgaacaacaaggtaaaaccccatttctactaaaaaatacaaaaagttagccaagcacagtggcacacaactgtagtccaagctacttgggaggctgaggcataagaatagcttgaactgggaggcacagcttgcagtaagcagagatcatgccactgcactccagcctgggtgacagagtgaaactctgtttccaaacttatctgggcatggtggcatgtgcctgtagtcccagttactccagaggctgaggcaggaggattgcttgaactcaggagttcaaggctgtagtgagctatgattgcatcactgcactgtagcctgggcaacacagcgagaccccatctcaaaaaaaattagtaacagcaaagaatctctttgaatgtggtcacgacagcagaggcctgcaatagactagagtctatgtggcagccatacaagctctggggtctaatattcaacaagggtagagatgctgccttatcagacacagagtgattttggatttgactctggatgcctcttctctgagcttgactctccagctgtcttggtgatactttgagctacccaatatcctttcaataaattatttttctgctgaaagtagacaagctgtttctgttgattgatagagctaagctgtagacttgaccaagtggaggaaagtagaggatagtggggacatatgttaagccaacactgacaatggcactgcacaaagacaaagaaccagggtcctcgatgacaacactgtgatgttgccgaatcaaccaaacccagagtgtgtccttctgcacctctttattatgtgagtaatgagtttcattgtggtttaagccagtttgaatcagatttcccattacttgcagcacaaagaatccagatggagatagtgcttcataagccatagttattaccatctacccacctgttagtgttgggagaagtgaatcagctattccaagcaaaagacttgcctagggcctgataaatagtgatccttcatgaatgttaatttcttgttaattttacctgcagttgtcggatactgatgcgcaagtcagattcattaaatccatatggaatattccaaccaagaggaccaaatttctttctctcttgcacaagggcatgaaaaaaacaaactccaaacagtaacttctcccaggcctttaatataaaaagtacataacaagaaaaaaaattccggtcagattccatcagtaaaatgagaggaatagataaatgatctttctcacaagattctgtgatcacgtatctctacaaacttctattttaaaaaaatcctatctaaaataatacttactataaatagtattcatcttatgatttaattcaaatctccaaatctggacaaaccatagtaatattaagccttgttaaaatgcaaaaacgttatcattttaccaaagtattgactaataatactttggtattactcgcagagatttacaacttcaatacttaaatgttattctgtaaacttgctggcatatgcttgagactgtaagtgcaggggaatgattaaccattatgatatgaataaatcccaatatgtcattcatgactttgtgactttccatttgaaaatcatttttgaaaccattgtttatttgatctgctttgtggcatccccgtgtctgtgatatgcatgtcacatgggcttctcaagaaatctgtgtcagtgttccagaggatggtcgcccaagtctttaaggtcccccccaagtaaatttcaagtatgatacacagcatgtattttaatttagaatatttcaaacatagctccaaatccagtgaaaatccatccagctattttcatataatgcagtagtagacattattcttcaatattaaaatgcaagtacactatgctttactgagtagatacgtttttgaaatgttctaagtacatcaaagcatattttaaacatactagatgaatgctgtggtgaaacatttcataggggaagaacctttagcaataagagcaatgatctaatttacatgtattttctacatatttttaaatagtgggttttcttaaggcaggaaccatccttaaaattctggaaaactgaatgatcacatttgtttctgtctttggactctatctagactgggttcctccaaaagtagaccttgagagaaagatgcgggtgaaggtgggtgtatgggagaagtgatcccaggaagcaggaaaggagtagggaaagggaggcagagaaagaggaaaagtatcaggaagaattatggaagttgttgctgtgatgaggactcagttctgctgggacaagtggtctctgaatagttgaaggttgcccctggggttgataatttctccacatttttggtctatgcttgtgtgtctacaggcgaagaaggctcctgttgcatcagagaaatctcgaggaaagaaaacagaaagatgcatacttgagataaggtgctgtagcctatgaagagtctgaactcacaaagaactatcttctacaattgtggctgaaattagatatggaccgaagagctgtgacaaaggacgtcagagtagtttgccacagtcctgttatctagatattctaaaaactagatattctttaaaaaacttttaaacattaaaacatactttcttaaaaaataaccccttccccttttttttttttgcttgtttttgactaagccaagggggcagtaggatgctgtcttctctgcctaaagatgataccactgacctgccatcagtgagggtatgcattttagtttgttttctatgacatgatgctgttttgtgttgactcattcaaactccttagcaaggcatgtaaagacttccagtcttgacccaatattccttcccattcttatttcctaccagtttagccaaaatgaggtccttattgctctttcaacaaccttgtcataatagttgtgcatattaaacatacttcttgtgcctacttcaaatatcatttcttccatgaagctttttttcaactcagccaagcagagttaatcacacacaaatggaaagagtcagatgtcctgggtgccaaatcccacctccaacactgggctgagctgtacgactgatatcgtttggctctgtgtccccacctaaatctcagctcaatttgtaatccccgcttttcaagggagggacctataatccctgcgtgttgagggagggaggtgactcaatcatgggggcagtttcccccatactgttcttgtgatagtgagttctcacgagatccgatggttttataagtgtttggaagttcttcctttgctgttctctctcctgctgccttgtgaagaaggtgcttgcttccccctcaccttccaccatgattgtaagtttcccgaggcttccccagccatgtggaattgtaagtcaattaaacctctttcctttataaattacccagtctcagatatttctttatagcagtgtaagaacggactaattcaatgacctcaataatttatttaattcatttgagcctcagtttccttatttaacaaatagatgtgtgcaaatgatacctatattagaggactgttgcaaggcttatatatttaaactaactgaaatctgctggtggtcaataaatgtttgcccctttcctcccttcctttctttgtcctcccttagttcataacactatcatggctgttgcgtgcagttgaacatgcaaatttgtttgtttacatcatacatgttttaataattttcattttattgtggtaaaacatttaacatgaaatctaccatcttaaatttttaaatgtacaatacagtattgttaactataaggacaatgttgtacagctaatctccagaatttattcaccttgcataattgagacactattcccattaataagcaactccctatttccccctcccacagccccaggtaaccaccttctgattctatgagtttgactatttttgataccctatataagtggaatcatacagcatttctctttctgtgactggcttagttcacttaggataatgtcttcaagttttatccatgttgtcatatatggcagtattttcttctttttaaggctgaataatattctacgaatgggcatttaggatgtttccacatactggctattgtgaatggtgctgcaatgaacactggcctgctaatatctcttagagatcctgatttcaatttttttggatactcagaagtgagactgctggatcatatgttctgtttttaattttttgagagtctccatactgttttccttaatggctgcaccactttgcattaccaccaacagtgtatgagggctccaattttgtccttgctaatacatgctggtttttgtttttttgaaaatagccatcccagaaggtatgagatgatatctcattgtggttttgatttgcatttccctgctgactactgacattgagcattttttcatatatctgttggccatttgtatgtcttctttggagaaatgtctattcaaacctttagcccatttttaatctggttattctttgttttctgttgttgttattgaggtgttccatatatattttggaaattaactccttatctaatatatggtttgcaaataatttctcccattccttaggttggcttttcactttgttgatcatttcctttgctgtgcagaagctttttagtttggtttgatcccactttctttttgttgcctgtgttttggtgtcatatctatgaaattattgctaagatcaatgtcgtgaagctttccttctaagtgttcttccgtaagttttacagtttcaaatcttacatgtaagtctttaatccattttgagttgatttttatgtatagtgtaagataggagttaaatttcattcttttgcatgtggatatgcagttttctcaataccagttgttgaagagactatacttctcccattgtatattcttggcacctttgtcaaagatcagttgaccttatatgtgtagattgatttctgagctctctattcttttcctctggtctgtatgtctgactttatactagtacaggttgagcatcctaaaccccaaaacccaaaatccaaaatgctccaaaatccaaaactttttgagtaccaacatgatgctcaaaggaaatgctcattagagcatttcaggttttgtatttttgtatttggaatgttaactggtaagtataatgcaaatattccaaaattaaaaaaaaaaatcccaagcattccagataaggaatacttaacctgtaccatattgttttaatcactgtagctttgtattatattttgaaatcaggaagtagcctgatttcagagaacaaagcctctagctttgttttttctcaacattggtttggccatttaagatcttttgtggttctatatgaattttagagtttttaagattgggattttgatagggattgctaaattaaatctgtagatcactttggttagtttgcacattttaataatttaagtcttccaatccatgaacatgggatatttttccatgttcatgtcttctttaacttattgcatcaatgttttgtagttttcagtgtatatatctttcacctcctcagttgaatttattcctaagtattttattgtttttggtactattataaatgggattgttttcctaatttccatttcagatagtttgttgttggtgtacagaaatgcaactaatttttatatgttgattttgtaccctaaactttactgaattcattgattagctctgacaggtttttcttgtgtggagttttgtggttttctatatacataagatcacatcatctgcaaacaaggacaattttacttcttctggtttgatttggatgcctcctgtttctttttcttgcctaattgttcagtctaggacttccagtctatgttgaacagaagtagaaggagtgggcttccatgccttctttctgatcttacaggaaaaattttcagtttttccatggttgagtataatataagttgtggtattttcatattggcttttattatgttgaggtaattttcttctattcctcgtttgttaagagttgttttttggttttgttttgtttcttcctgagatggagtcttgctctgttgcccaggctggagtgcagtggcacgatctcagctcactgcaccctccacctcacaggctcaagcaattctcctgcctcttcctgagtaactgggattatagccacatgccaccacaccttgctaattttttttttttttgtatttttagtagagacaggtttcaccatgttggctaggctggtcttgaactcctgacctcaagtgatcctcctacctcagtctcccaaagtgacaggattacaggcatgagccaccatgcccagctgagagtttatattataaaaaagtgttgaattttgttggatgctttttctgcatctagtgagatgatcatgtgatttttatctttcttctgttaatgtgtattacattaattgatttttataagttgaatcattttagcatcccaggggataaatcccacttggccatggtgtatatatatgatatgctatatttatgcttgttcttgagccttacttcaaatttagtgaatcagaattccagaagtagggcactgacatctgtagctttaacaagtcccccaggtttgtggggattatggttgagcttgctttccacaggtttcctttgactaaaatgtcagctccataaagacaggaaatttttacatgtttttatatatgttcattgccatattaccagttcctataagaatgtcttgcacctagtaggtactcaataaatatttactaaataaataagtgaagatacagaaatgtatccctgcccttaaggagaataaagtgagtacagcaggcagatctatagactcataacgaatgtcttatcattgctaggtaattcaaacgcccaagatatcaacaacctgtgactaaaaagatcttatttacttttaatggccaaatgatgatagttcaaattattgctggcctaattgtcagaaattagccttatcgaaaggcattccagctatttctggaagcctcagtggaatttcaatatgtctacaaaccagtcacacctgcagaaactggaaggcaatggttttcaaagtgtgattccagaaccagccacatcaacatcaccagggaatttgttagaactataaattcttaagcctcaccccagacccactgaattagagactctggggatgggacccagcaagatgtgtttgaacaagccctctaggggaatcggatgcatactgagaacccatgtcacagggcatttacattcttttacttctcttaccccagctttcatttgtttgtactaccagagaagttgcttggtgaagccttacctattaccactgttcatcacaaaaatgatgatacatggcaaggatactaacttcagatatcccaacaaatcccaatacttacggtgccagcgtagcttgctcaatgttgtaatacccaaggagtgagaatgcttcttctctaactcagcaccatttttatttgaataatctgagtcccaaattagctctgcttgagcttagaatctttcaaaatttcccttctctttcttgccctcgctcttctaattgcaggagctcaaactctggatgaggattagacaccatactatcttctccattctactaagctctctttctaaataaaaccacaaaatatcctctcttgttctaagatttgcaaacaaaattatggcgcagaactagggtacacagaaagtgtcattaagcagagggaaaatacctgactttcaaagaatttagttaattttaccttcaatatcattttttctagctcaaacatgaaaatatgataaatagtacatgttggggtgagggcaggggatgattttctcacagtaatgtttcatgtgcccaattaataatgtaacacgctggacttttctccattcttgtactcacttgctgcaggagagaggagtgacctaccggactggtaaacttggggaaaattaaccagatatgctcagcccagcttctcccttttctttcttagaagtgagcttcttacagggacctgggttttcctttactcttctgggtggataaatttgcttaattttagggctcagtaatatgaaacccatttgttcacagatataagctatatcttccaatctagcctatatcaataattaagcctataatttggttaccatacatttatacttttccctgtttctcaattggtaagaattcaggcagggaaatgagtactctctactgggacccttaaagtctccagtactgtaaacaaaactgtttaaggtggatatacgaaaaagcactattaatatgcttaacattattactagaatctaagtttcataaaggcagatttctttgtctgtctattttgttctcattgctttatatctacactacctaggagagggcctggcacacatacttgttgaaaaagaatcaacaatgggaaaatagatttctactctcgggtcctaatcaaaaacattactgggctttggcttacaaactaagattcattcattcaacaaatatttatttcgatgtctactgtgtgggaagtggaacacaaactatattgaataaaatggtgaacaagataagtacaatttttgtcttgttaggaaatgcgtaaagttttaaaaacattaaataaaaatgttacaaaagcattattaaacaaaattttacacttccatatttgatcactataaaacacattttaaaagttccaaaagatgaatattaccagttcctttccacggcatcccttgaaaaactcaggatcagaaactggatcagtgagatatgattgaaggagattcagccgaagacccgtgggaggttcattagtcatttttactccattctgtagaattgttactgggaactaagacaaaataaatggagagcattatacaagatagcaagtggaggctctaaaagtgcatatacacgtggattaaaaaacaggcataatggagaactccagaaatattcaaaaaacctcttaaggttaagcatctgaggcttgattaagatatgcagacagctggccaggcgtggtggtgcatgcctgaaatcccagcactttgggaggctgaggcgggtggatcacctgaggtcaggagttcgagaccaggctggctgacatggtgaaaccccatttctactaaaaatacaaaaattagccgagcatggtggtatgcgcctgtaatcccagctactggggaggctgaggcaggagaatcgcttgaacccgggaggcgaagtttgcggtgagccgaaattgcgccactgcactccagcctgggagacagagtaagactccgtctcaaaacaaacaaacaaaacaaataagatatacagatagctaagtaaatgtacttaactctataaggaaataaacatacttttgaagatggatagcttgtcagccaaagcctaaaggatgagttacaggtttcagaggtaaaatcttcacatattttttccaacatgggcatccaggacactgcaagatggcaattctgtaggcacacccaagttccttcttcaattgctgctttaatcatttttgctgcaatcggtccttgtccctgtcccagtgaaatagcttgaaacttatttccagacatagatttatcatttgcaaatttcagcaggcctataagaggcacaaaaaaatggtcacactacttactctaaaattataaaaaagtgccttatgtataggtgttttatcatgaaaaattctagttacgtttctctgtaaatatcagatttactaactgatttataatcatataaggaatcagtattgagcaagatgttttatttatgatttcttaaaagtttacagtatatgcacttactggccataggatctgctcctggagatagaacaaaaattaagggaatggtgcaatttgaatccaagtaactctttgtcaaatcaaatggtggaggctctacaaactttttccctagtttgtcagttacatagtttgttatagctggggttatctgttgaagagaaaagatatgatctttagagcaacttttatttcacataatggatatgaatattattgaaaaacaacaaagaatacaatttgagcctaatggtcaaaaaaagcatatagcatcatagacaaagcactaatttctctaaaaaataaaaactatatacatttataggagaagactatccaaaagataaatgggcaaaggagacaaactgcttagagaaaatcaagtacaaattgatcctaaacatatgagggatgctcaatgtcactcattatagcagagattgcatattgtcccacttatttgtctctgtttggtattagaaccccaagttttcctggcatttcttgcaggtaatgtggccatgtgactaagttttggccagagagatacaagtagaaattacttatggatcttccagataatattttaaggaagctatttgccttcaacaatttcttctcttttcaacatagcgttcacaagccagcttccattttgctgatgaggaccacactgtaagcatgaaagaacctgagtttctgggtgatctcaggagcaagagcttccctgtcagcccttcatcatttgcctctgagctgttaggagagagagaaattaacttctatttgatttaagccactgtactttaggtccctttgttacagcagcttcatttatacgctaatactcataataagaaaaatacaaattataactatacttagataccatttttaacctattgaattgttatataaatcagccaaagatggcctgggaggccatgatatcttgatatttggtcaaatagcagtctacacatgttgctgtgaaggtatttttggatgagattaatatttaaattagtagatatggagtaaggcagattgccctccacaatgtggtgggcctcatacaatcagttgaaagccttaagaaagaaaaaagcctggggggaggagccaagatggccgaataggaacagctccggtctacagctcccagcgtgagccacgcagaagaggggtgatttctgcatttccatctgaggtacttggttcatctcactagggagtgccagacagtgggcgcaggtcagtgggtgcagcgcaccatgcacaagccgaagcagggcgaggcattgcctcactcgggaagcgcaaggggtcagggagttccctttcctagtcaaagaaaggggtgacggatgacacctggaaaattgggtcactcccacccaatactgcgcttttccgatgggcttaaaaaacggcacaccaggagattatatcccccacatggctcagagggtcctacgcccatgaagtctcgctgattgctagcacagcagtctgagatcaaactgcaaggcggcagcgaggctggggaaggggcgcccgccattgcccaggcttgcttaggtaaacaaagcagctggaaagctccaactgggtggaacccaccacagctcaaggaggcctgcctgcctctgtaggctccacctctgggggcagggcacagacaaacaaaaagacagcagtaacctctgcagacttaaatgtccctgtctgacagctttgaagagagcagtggttcccccagcacgcagctggagatctgagaacgggcagactgcctcctcaagtgggtccctgacctctgacccctgagcagcctaactgggaggcacccccaagtaggggcaaactgacacctcacacggctgggtactcctctgagacaaaacttgcagaggaacgatcagatagcagcattcgtggttcacgaaaaaccactgttctgcaaacacctctgctgatacccaggcaaacagggtctggagtggacctctagcaaactccaacagacctgcagctgagggtcctgtctgtcagaaggaaaactaaaacagaaaggacatccacaccaaaaacccatctgtacatcaccatcatcaaagaccaaaagtagatacaaccacaaagatggggaaaaaacagagcagaaaaactggaaactctaaaaagcagagcacctctcctcctccaaaggatcacagttcctcaccagcaatggaacaaagctggacggagagtgactttgacgagttgagagaagaaggcttcagacaatcaaactacgagctacaggaggaaattcaaaccaaaggcaaagaagttaaaaactttgaaaaaaatttagacaaatgtataattagaacaaccaatacagagaagtgcttaaaggagctgatggagctgaaagccaaggcacgagaactatgtgtagaatgcagaagcctcaggagccgatgcgatcagctggaagaaagggtatcagtgatggaagatgaaatgaagcgagaagggaagtttagagaaaaaagaataaaaagaaacgaacaaagcctccaagaaatatgggactatgggaaaagaccaaatctacgtctgattggtgtacttgaaagtgacggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgagctctcggcagaaactctacaagccagaagagagtgggggccaatattcaacattcttaaagaaaagaattttcaacccagaatttcatatccagccaaactaagcttcagaagtgaaggagaaataaaacactttacagacaaacaaatgctgagcaattttgtcaccaccaggcctgccctaaaagagctcctgaaggaagcactaaacatggaaaggaacaaccagtaccagccgctgcaaaatcatgccaaaatgtaaagaccatggagactaggaagaaactgcatcaagtaatgagcaaaataaccagctaacatcataatgacaggttcatattcacacataacaatattaactttaaatgtaaatggactaaatgctccaattaaaagacacagactggcaaattggataaagagtcaagacccatcagtgtgttgtattcaggaaacccatctcatgtgcagagacacacataggctcaaaataaaaggatggaggaagatctgccaagcaaatggaaaacaaaaaaaggcaggggttccaatcctggtctctgataaaacagactttaaaccaacaaagatcaaaagagacaaagaaggctattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggagttgaactcagctctgcaccaatggacctaatagacatctacagaactcgccaccccaaatcaacagaatatacatttttttcagcaccacactacacctattccaaaattgaccacatagttggaagtaaagctctcctcagcaaatgtaaaagaacagaaattataacaaactatctctcagaccacagtgcaatcaaactagaactcaggattcagaaactcactcaaaaccgctcaactacatggaaactgaacaacctgctcctgaatgactactgggtacatagcgaaatgaaggcagaaataaagatgttctttgaaaccaacgagaacaaagacacaatataccagaatctctgggacacattcaaagcagtgtgtaaagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaaccagagcagaactgaaggaaatagagacacaaaaaacccttcaaaaaattaatgaatccaggagctggttttttgaaaggatcaacaaaattgatagaccgctagcaagactaataaagaaaaaaaagagagaagaatcaaatagatgcaataaaaaatgataaaggggatatcaccactgatccaacagaaatacaaactaccatcagagaatactacaaacacctctacacaaataaactagaaaatctagaagaaatggataaattcctcgacacatacactctcccaagactaaaccaggaagaagttgaatctctgaatagaccaacaacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaatttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatactcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatctgaaaataataacagctatccatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattatatatctagaaaaccccattgtctcagcccaaaatctccttaagctgataagcaaattcagcaaagtctcaggatacaaaatcaatgtacaaaaatcacaagcattcttatacaccaataacagacaaacagagagccaaatcatgagtgaactcccattcacaattgcttcaaagggaataaaatacctaggaatccaccttacaagggacgtgaaggacctcttcaaggagaactacaaaccactgctcaatgaaattaaagaggatacaaacaaatggaggaacattccatgctcatgggtaggaagaatcaatattgtgaaaatggccatactgcccaaggtaatttatagattcaatgccatccccatcaagctaccaatgcctttcttcacagaattgggaaaaactactttaaagttcatatggaaccaaaaaagagcctgcattgccaagtcaatcctaagccaaaagaacaaagctggaggcatcacactacctgacttcaaactatactacaaggctacagtaacaaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatggtcaaggacttcatgtctaaaacaccaaaaacaatggcaacaaaagccaaaattgacaaatgggatctaattaaactaaagagcttctgcacagcaaaagaaactaccatcagagtgaacaggcaacccacaaaatgggagaaaattttcgcaacctacttatctgacaaaaggctaatatccagaatctacaatgaactcaaacaaatttacaagaagaaaacaaacaaccccatccaaaagtgggcaaaggacatgaacagacacttctcaaaagaagacatttatgcagccaaaaaacacatgaaaaaatgctcaccatcactggccatcagagaaatgcaaatcaaaaccacaatgagatatcatctcataccagttagaatggcaatcattaaaaagtcaggaaacaacaggtgctggagaggatgtggagaaataggaacacttttacactgttggtgggactgtaaactagttcaaccattgtggaagtcagtatggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatagaatactatgcagccataaaaaaggatgagttcatgtcctttgtagggacatggatgaagctggaaaccatcattctcagcaaacaattgcaaggacaaaaaaccaaacactgcatattctcactcataggtgggaatcgaacagtgagaacacatggacacaggagggggaacatcacactctggggactgttgtggggtggggggaggggggaaggatagcattgggagatatacctaatgccagatgatgagttagtgggtgcagtgcaccagcatgtcacatgtatacatatgtaactaacctgcacattgtgcacatgtaccctaaaacttaaagtataataattaaaaaaaaaaaaaaaagaaaaatgcctgatttcccctgaggaagaggaccttttgccagcaaactgcctttggacttgagctgcaacatcaactcctccttgagtttccagcctgccagcttaccatgcagattcaccagcttccacaatcacaccagccaattcctttcagaaaatcaatcaatcaatcaatcaattcccctcccctgttgttttatttctctggagaacagagggaaacaagtagaaggcctgaataatataggctttaattccatttagtttaactcaattcaattcaacttaattcatagacatttgttgagcttctaccatctgtcagacattgctctaaatcctggcgatacagaggaaaataacacatgaatcttgacctcaagaagctcacagtctagtgggagaccctaaaaagtaagcagacaattattgtacattctaatggggtaagggctatggtatataagcacaggcttccaaacacggcagacaaagcaaaaaccctacatgtggtattgaaacaatatctctactgcccatcaggggagccattctgtaaagtgcaaataggcaggtgttcccagatacatagctattaagtcttcgtcatgaacaagggaggctactggtgataaaataatgaataaaccattatttaggggttccagggacttaaagtgactctctagttagagtcactgtgtatgtctatacacagacacatatgcacacacaactatcaggcaagaatgagatgaatattaaccaagtacaaaggtctttgggaatcagggtaaggagtaaaacatttatgtaggcctctgtttaaatctacccagagacagagcattagataatgttccttgtgagactttactaaaacggtaaaatttttttcttttaaaaaaagaaggaagaaacgaagggactattgcaatcactttcaaaaccttcatatttttcatggtgtaggtgaagtgacttactggtaaagattctttcctcaaacaaaccttagttagacaggctcctctgaacccctttttctatgaggccttgtcttcaagagcccagttgtagcaagaaccctgctagccagtttagtgagagtcccctaccctctacatctgatcgccctccatatctgatcaaattcctcataccctgccatctcccaggtggtatctcatcaccctggcctgctttcagcaagaattttgttaggtcagggtagcaagaattccccctacccttggtgtctcttcttagtaatttccccccaccctgctccttgactataaatccccaactgtctctgctgtatttcgaactaagcctgagctctctttcctactgtgatagtcttgaacaaagtcttccttactgctttaacatttgtcatgaataattttttaacattactcaaagtttaaactagatgtatgaacatggtttcttgttttctttctattacaaaattatccctttgtaatactatgatcacctttcttaaatttgtgaaaattggtgtcagcctacttatcttacctttagaaagatttctgtgcatgtttgaactaataaaattgtgacatgtacaaaattttctgccatcttctacttttagctatgatgtggttatagggattggatttaccctactaccacaaacaatttaaaaaacaggcacaattaatgaaaccaccatttttgcacagggggcaataggtggtataggactgtgatcactgagaaaaagaaaacaaactgaacgctattctctcagctttcttcttggaggtatgctagactgtggaacagcgagagtgattaaggcagagcaatgcagtgtcactgagttgcaaaaacaagaaaaagactacaaaggggccaaggctgctggaagttgcagagttctaattaggatagaactgtccaggcagagttcagaaatctgctcacagtacctctgaatccttgctgaacactatggtgtgtatgcatgagaccaagaaaagagcatctgaggtgctgtaaccaggagatctggggagctaccactgttcatgaaggctgggactcattcaggttcccaaaagccatagagagtccttagtgatcgcttggagcattcagtaaaggccccagacgggtggcactttggtagagctaaataatgcattgaataaaggctattctagaccatcctaacaaatcttaaacaatatttgaaaggaacaattcaaacttcagtaatttaactacataaccacagaagttgataaacgttctgtagagggccagataagaaatattttaggctttgtgggacatatacagtttctgttgcatgttcttttttattttattattattttttatgagacagagtctcactctgccacccaggctggagtgcagtggttcgatcttggctcactgcaacctctgcctcccaggttgaagtgattctcttgcctcagcttcccgagctcgaactcctgacctagcgatccacccacctcagcctcccaaagtactgggattataggcatgagccaccgtgcccggatacatgttctttttaaggcaacttttttttttttttttttttagatggagtctcgctctgtcacccaggctgtagcgcagtggtgcgatctctgctcattgcaacctccgcctctccagttcaaacaattctccttcctcaacctcctgaatagctgggactacaggcatgcaccaccatgcctggctaatttttgtatttttagtagtgacagggtttcaccatcttggccaggctggtcttgaactcctgacctcaagtgatctgtcctcctcggcctcccaaaggccaggattacaggcatgagctactgtgcccagtcaaaactactctttttaaaaatataaaaaacattcttagttcatgggatggaccaaagacatcgtggggctggatttggcccacaggtgtttgttgacccctgaactagcaggacagaactcaacaatctttataggaaaatgaaatctaactcatcaacaatgtgatattcacaatgtccagtatccaatcagacattattagacatgccaaaaagcaggaaattatcatgtataactaaaagtaaaatcagtcaatagaaacagatccagaaatgatggaattagtagtcactaattttaaaacagttattataactgtgttcaactatttaaaagaaaatattagcagattaaaaagagaaataggatacacaaaaagaaccaaacaaattttttagagatgaaatacacaattactaaaattaaaatgggaaagggatttgtagcagattagacaatacaaaagaagaaatcaacaaatgtaaagatagcaacagaaactacccaaactgatgcaaggagataccacggcttaaaaaataattaacaaagtatcaattacattatattacattagcatcacattaggcaatctaatatatgtgcaactgaaatcctgggtggggtgaaataatatttgaagaaataataaccaaaaatattcctaaattgaggaaaacagtaaacccacagatctaaatccaaagagctcaatgaactgtaagctggataatcaatctgagagttaaagaatcaaataacaagaactttaagcctagcacttcataaatggcaaattatctgggttccaaatagaacacattggtcttttaccttatcaggtcttaaacaccgaagaattattattttctgtagttcatttaggttcttatccattggtgctggaaatttagcattatgtggctctttactgtcatagatttctcgccattcatatatatgttcacaaaaatgttgcctaatagaaaaaagcttaagaattattctttttattgggaaaaacttaaaagagattgttgaacaaggagtagaaaccagacagctatttaaaaccatttaaaaatcactaaattgaagaacaagtttacatattgccattcaatgataaatcatcgaatttaaacaatcacctgagtcctctgaaggcaggaaattcacttgcccgacagatttcctcccagcttttgtcctgtagccaagttggatcaggatttttctcagcacttttaagacttactcctccagttaaaagaaacatcagttcctggtattcaatctctttccttgccctgtattcccaaaataaggactgttatataattgttgattttaaaattgaatgatgtcaacttccgcttttgtaacctggatagaacaacttagactgtacttacccacctgctgtaaacaactagaaaactggacaaaattaatgaaacaactgtttttttgaaattgttcaatagccagtgcaggactgtggcctctgagagaagagaggtgaataaggtgatccccgttcctcagcaggctgcctggcactttctagactacagagcagggaggtgtgatcagaatcagagctctgcagtattgctgaattgaggaaaccggcattaagttctcctcaacagtattgctgagttgaggacatcagcattagggaaagcttaggtgactggagtttgtgagcagaggaggaagatgaatggaaaaggtgaatgaatgtcttaaaaatctacagaggtgctctcttggttctactgataaatacagccaggcattgctcatagaattcttagtcacgcattctaagaagtgtgttgttaggcgatttcatcattgtgtgaacatcataacgtgtacttacacaaatctagatggtgtatatggtatagcctgttgctcctaggctataaatctgtacagcatattactgtactgaatacagtaagcagctgtaacataatggcatgtatttgtgtatctaaacgtagaaaagaacagtaaaaatatggtattataatcttatggcaccgctgttgcatatgcagtttgttgctgactgaaacattgttatgtggcacatgactgtactaagagatgcatcagtaaggtaaaattccaggaagccagcaaaagaacatctaaggggctgtaaactgaaagctcccagagatcacacaagactaagaaatataagttattgccaaccagagttgagtctttgttcagcaccagaggaattcaggtctccttagtggtgaagctaacatagccttagagtaaaggttactctaaaactactgtaagaaagcttaaacacaagtcgtcttcttttttttaagagatggcgaactgctctgtcatctagcctggaagtgcagtggcacaatcatagttcactgcagcctcaaacttctgagcttaagtaatcctcctgacttagccttctgagtagctgagattagaggtgtgggccactgcacctagaataagtcttgaaaagatcaaactaatccagtagcaatttaactacctaaaagagtgaagtctaaagctctttaaaggaatacaaaatgtccagcatttaccaatataaaattcacagcatccataaccaggaaaaaaattggtcttagatgtagatgtagatgtgaaagagataatttaactagccagtaagaatgttaaagtagttatcataaacatgctgaaggagttaaagcaaagtatgaacataatagaagaaataggcaatattaaatagaccaaacacaactcctaaaaataaaaatacataatctgttataggaatagaaaaaaacctaaagataaaaatataaaaattgagatatttacttatttcttttccagatgtatagatattgaaaagattcattacaagtagacctacactacaagatatcttaggggaagtttcagataattggaactctggatctacaccaaagaataaagaacaatagaaatggtaactttgtaggtaaacataaaagatttttttaaaaaatcattaatatttaagtgtctgtaaaagataatgtcaggaatttggaagtcatcactcacatcctcacaataagaaaaaagctgaacaaactgaaaatcagcaacttttcttagatgcatcagaggactgaggtcatatggctaactcactacctcccaactggtaagagacagataaatacagagaatcctaaattacttgagcagaagctcaggttattatcaataataaccttgcatgtaaacaaattaaatcccccaattaaaatatataaactggctaaatgaataaaaaacacccaactatatgctgcctacatgaaactcacctcacctgaaaagacagagactgacagtaacaggatgaaaagagatattccacaccaatgaaaactaaaaggaagtaggagtagctatatttacatcagaaaaaaacagactttaagttaaaaagtaccaagagacaaataataacattatataataataagggaatcaattcagcaagagaatataacaattataaaaatacatgcacctggccaggcacggtggctcacgcctgtaatcccagcactttaggaggccataggcaggaggactgcttgagcccaggagctccagaccggcctgggtcacatagggagaccctctattttaataataaaatttttgtaaaagagagaacttttcagctgggcacggtggctcacgcctgtaatcccagcactttgggaggccaaggagggcagatcacctgaggtcgggagttcaggaccagcctgaccaacatggagaaaccctgtttctaataaaaatagaaaattagccaggcatggtgacgtatgcctgtaatcccagctacttgggaggctgaggcaggagaatcacttgaacctgggaggtggaggttgtggtgaaccaagattgtgccattgcactccagcctgggcaagaagagtgaaactccatctcaaaaaaatatatatatgtgtgtatatatatatatgcatccaacaccagagcacccagatatataaagcaattattattagatctaaaggcagaggtacaccccaatacaacaacagttggagacttcaacaccctactcttagcattggacagatcatctagacagaaagtcaacaaagaaactgcaaatttaaactgtaccatagaccaaaaagacctagaagacatttacagaacatttcatagtacttgcagaatacacattctcttcatcagcacataaaacattctcccggattggccatatgttaggacacaaaaaagaaaccttaaaaaattgtttcgctctccctctctctctcttctctctctttccacggtctccctctgttgctgaggctggactgtactgccgtgatcttggctcgctgcaacctccctgcctcgggctcccgtgattctcctgcctcggcctgccgagtgcctgggattgcaggcacgcgacgccatgcctgactggtttttgtatttttggtggagacgggttttgctgtgttggccgggctggtctccagctcctgacctcgagtgatctgcccgcctcggcctcccgaggtgctgggattgcagacggagtctcggtcacttagtgctcaatgttgcccaggctggagtgcagtggcgtgatctccgcccggctgccccgtctgggatgtgaggagcgcctctgcccggccgccacactgtctaggaagtgaggagcatctctgcctggccgcccatcatctgggatgtggggagcgcctttgcccggccgccccgtctgggaggtgaggagtgcctctgcccggccgccctgtctgggaggtgaggagcgtctctgcccggccgccacctcatctaggaagtgaggagcgcctctgcccggccaccaccccgtctgggatgtgaagagcatctctgcctggccgccccgtctagaaagtgaggagcgcctctgcccggccaccccgtctgggaagtgaggagcgcctctgcccggccgccccatcttgggggtgaggagcgcctctgcccggccacccattgtctgggatgtgaggagcgcctctgcccagccaccccgtctgggaagtgaggagcacctctgcctggccgctgtgcaatcttccaagtgtgaagtgacagcctttctgcaggtgtacccaacagctccgaagagacaacgaccattgagaatgggccatggtgacgatggcggttttgtcgaaaagaaaagggggaaatgtagggaaaagaaagagagatcagattgttactgtgtctgtgtagaaagaagtagacataggagactccattttgttctgtactaagaaaaattcttctgccttgggctgctgttaatctataaccttacccccaaccccgtgctctctgaaacatgtgctgtgtcaactcagggttaaatggattaagggcggtgcaagatgtgctttgttaaacagatgcttgaaggcagcatgctcgttaagagtcatcaccactcccttatctcaagtacccagggacacaaacactgcggaaggccgcagggtcctctgcctaggaaaaccagagacctttgttcacgtgtttatctgctgaccttctctccactattatcctatgaccctgccacatccccctctccgagaaacacccaagaatgatcaataaatactaaaaaaaaaaaaaaaagaaagaaagttgatctcatgagaaagagtagaacagaggctgggaggggttggcaggataaggataaacttgttaaaggatacaaaaattaaagctagataggaggaataagttctactgttctgtagcactgtaagatgactatagttaataataatttattatatactttcaaatagctagaaaagaggattttgaatgttcccaacacaaatcataaaactttgaaaaaaaattgtttcaattgaactaatattaagtatcttatctgaccacaatggaataaaagtataaaccaataacaagaggaacactcagaactatacaaatacgtgaaaactaaacaacatgctcctgagtgaccaattgattaaaaaaagaagttaagagagaaagtaaaaaatacctcacccctgtaatcctagcactttgggaggctaaggcaggcagattgcttgagtccagggattcaagaccaacctgggcaacatggcaaaaccttgtttctaccaaaaacagaaaaaattagccaagtgtggtggcatatgcctgcagtcccaactacttgggaggctgatatgggaggattgcttgagcccaggaggttgaaaccacagtgagctgtgatcataccactgcactccagcatgggggacaaagtgacaccctgtttcaaaaaaaaaaaaaattccttgaagcaaatgaaaatagaaacacagcataccaaaatgtatgggacacaacaaaagccatgtttatagcaagtttacagcaagtatagcaagaggcaagtttatagcaataaatgcctacattaaaaacagaaagatttcaaataaataagctaatgatgcacctcaagaaactagaaaagcaagaacaaaccaaactcaaaattagaaaaaggaaaaaaaaataaaaagcagaaataaatgacattgagactaaaaaaatagaaaagatcaatgaaacaaaaagttggtttttcaaaaagatcaacaaaattgacagagcattaactagactaagaaaaaaagagaagacccaaataaaatcacaaacaaaaggagacattacagttgatactgtggaaatacaaaagatcatcagagactattataaacaattataaactaatcaatttgagaacctagagaagatgggtaaatttgttgacacatacgacctatcaagattgaaccaaggagaaatagaaaacctgaacagatcaataatgagtaatgagattgaatcacagtaatgaaaaggaaatcaagaaagaaaagtccaggaccagatgtcttcactgctgaattctaccaaacttttaaagaactaatatttttaaaaattcttctcaaactattcccaaaaattgaaggggagggaattcttccaaacccattttacaaggccagcataaccctgacgccaaaaccagataaaaacacaacataaaaaaactagaccaatgtctctgatgaacataaatgcaaaaatcttcaacaaaatctgaattcaacagcacatcaaaaatatcatacactattatcaagtggatttatcctagggatgcaaggattattcaacctacacaaataatgtgagacatcacaacagaatgaaggacaaaaacaacacgatcatctcaatagatccagaaaaagcgtttgataaaattcaatatccctcataaaactctcaataaattaggcatagaaggaagtacctcaacacaataaaggctatataagacaaacccacagctaccatatactgaactggaacaagacaaggatacccactctcatcactcttattcaacatattaatagtactgaaagtcttagccagagcaattaggcaaggggaaaaaaatgaagggcattcaaattagaaagaaggaagtcaaattgtccctgtttgtggatgacatgattttatatatagaaaaacttagactctacccaaaaaactcttaaaactaataaattcagtaaagttgcaggatatagatatcaacatacaaaaattggtggtgtttttatataagaacaatgaactagctggaaaagaaatcaagaaagtaattccatctgcaaaaattacaaaaaataaaatacctaggaataaatttaaccaaggaggtgaaggctctctacaaggaaaacttaaaaaacaccaaaaaacaatgattttttgaaagaaattgaagaagacatcaaaaaatagaatgacatcccatctttatggattagaaaaattaatattgttaaaatgactctactacccaaggtgatcaaaagattcaatgcactctctatcaatataccaatgatgttcttcacagaaatagaaaaaaaaaaatcctaaaatttgcatggaaccacgaaagaccgcaaatagccaaaacaatactaagcaaaaagaacaaatctagatgcatcacagtaccaggcttcgaaatatactaccaaagctctattaacgaaaacagcatggtactggcatacaaccagacacacagaccagtggaacagaatagagaacccataaattaatccatgtatctacagccaactgacttttgacaaagatgccaagaacattgattggggaaggacagtctcttcagtaaatggttctggggaaaattggatatccatatgcagaagagcaaaactagactctctcctcttattctacacaaaaatcaactcaaaatctcttcaagacctaaatgtaaaacctgaagctataaaactactagaagaaaacctggggaaatgcttcaggacattggtcctggaaaagattttatgaataagaactcaaaagtacaggcaacaaaagcaaaatataaataagtgggattatatcaaactaaaaaagcttctgcacaccaaaagacacaacacaatgaaaagacaacctacagaatgggagaaagtatttgcaaactggccagacgtggtggcttatgcctgtaatcccagcactttgggaggctgaggcaggtggatcatgaggtcaggagttcgagaccagcctggccaacatggtgaaaccctatctctactaaaaatacaaaaaaaaaaaaaaaaaaaaaaaattagccgggcatggtggtgggcacctgtaaacccagctactgaggaggctgaggcaggagaatcacttgaacacaggaggcaggggttgcagtgagtcaagatcgcaccactgcactccagcctgggcgacagactgagactcaaaaaaaaaaaaaaaaaaaaaggaaagaaaagaaaatatttgtaaactattcatccaccaaagaattaatatccagaatatacaaggaactcagacatgtcaacagaacaaaaaaatctaatttttaaatgggcaaatgaggctagcatgatggttcatgcatgtaatctcagcactttgggaggccaaggcaggtggatcactttagcccaggagtgcgtgactgggcaacacagcaaaaccctgtctctacaaaaagaaaaatacaaaaattagccaagcatggtggcttgtgcctgtgtcccagctacttgggaagctggggtggaaggatcacctgagccgggcaggtggaggttgcagtgagccaagaaagtgccactgcactctagcctgggtgacagagtgagactctgtctcaaaagaaaaaaaaaataggcaaatgatctgaacagacagttctaaaaggacaacacacaaatggccaaaaacacatgaaaaaatgtttgatatcactaataattagggaaattgtggggaaaagaaagagagatcagactgttactgtgtctagatagaaagggaagacataagagactccattttgaaaaagacctgtactttaaacaattgctttgctgagatgttgttaatttgtagctttgccccagccactttgacccaactactttgacccaacctggagctcacaaaaacatgtgttgtataaaatcaaggtttaagggatccaaggctgtgcaggacttgccttgttaacaaaatgtttacaagcagtatacttggtaaaagtcatcggcattctctagtctcagcaaaccaggggcacaatgcactgcggaaagccgcaggggcctctgcccttgaaagctgggtattgtccaaggtttctccccatgtgatagtctgaaatatggccttgtgggatgagaaagacctgaccgtcccccagcccgacacctgtaaagggtctgtgctgaggtggattagtaaaaggggaaagcctcttgcagttgagatagaggaaggccactgtctcctgcctgcccctgggaactgaatgtctcggtataaaacccgattgtacatttgttcagttctaagataggagaaaaaccgccctatggtgggaggcgagacatgtttgcagcaatgctaccttgttattctttactctgctgagacgtttgggtggagaaaaacataaatctggcccacatacacgtctaggcatagtatcttcccttgaccttaattataacatagattcttttgctcacatgttttttgctgatcttctccttattatcaccctgttctccttctacactcctttttgctaaaataatgaaagtaataatcaataaaaactgagggaactcagaggtcgatgccggtgcaggtccttggtgtgctgagtaccggtcccctggacccactgttgtttctctatactttgtctctgtgtcttatttcttttctcagtctctcgtcccacccaactagaaatacccacaggtgtggaggggcaggccaccccttcaggaaatgcaaatcaaaaccacagtgagatatcatctcaccccagttagaatggctatcatcaaaaagccaaaaaatacaaatgctggtgaggatgcagagaaaagggaactcttatgcactgttggtaggattgtaaactagtacaaccattacggagaacagtatggaggttcctcaaaaactacaaatcaacctactgtatgatccagtgatcccacaaccaggcctttatctaaagggaaggaaatcattatattgaagagatgtctgcaccctgattttttttggtagcactattcacaataaccaaggtatggaatcaacctaagtgttcaacaacagatgaagggataaagacaatgtggtatacatacacaatggaataccattcagccataaaaagaatgaaaacttctcatttgtggcaacgggaatgaaactgaatgacattatgttcagtgaaatacgccaggaacacaaagttaaacaccacatgttctcacttatatgcagacgctaaaatgaagttgatttcatagaagtaaaaagtagaacagagtatactagaggctgggaaacagggaaaagcagggattagggagaaatttgttaaaggatacaaaagaagttctagtattcaatagcactgtaggatgagtgtagttaacaataatatattattgttgactcttgaacaaccaacacaggagttaaggtgctgaccccccatgtggtcaaaattcatgtataatttttgactcccccaaaacttaactactagtagtctattgttgactgaaaatcttactgataaacagttaattgtacatatatgtcatatgcattatatactatattcttacaataaagtataccagaaaaatgttatcaaggaaataataagaaaaatgcatttacggtatatactgtatttaccaatactgtaaatttacataatctgtttacaagatgaaatgtctgtctgaaatggtgggtaaccatgctgcagacctcaatttatggtaaatatcaaacaattccattttttcttgtaaagtaatgactcttctctgtctcttgggagaacttccaggaaaactacaaaccaaaatctctcatgaaaatagacacaaaaattctcgacaaaatattagcagatcaaatcccataatgtatacaaagaattatacactagtggcactttgtatgggtcttatgttattccaagtttgtgatattttactaaacacaacgaaaaatacacgagaaccatgaagagatcactttttactgccatacccaatgtactgaagagatgaactgctcttgagatgatgagcatcacctgacattttaagtggataattgtaacacttaagctcatgtcaacagcaacaggaggtggctacaaaattattacagtagtacagtgtgtgccacagttaattttatgcagttatgatttgatgctgcatctttatatttgtttatatttcttgactgcaaatgatgccatgtatgaactgtgtgtgagctttgataaatttcaactttttgtaacagatttgtacatattttatggtagtaaatgataaaaatagactagtatctacatatattttatgtatttatgacatacctaaccttttcttaattttttgaatatttctggctaggcagttcatctgtcttttcaaagtgtcacaaatcttcagaaatttttccagtatatttattttttaaaaatctgtgtataagtggactgctgcagttgaaacccatgttgttcaagggtcaattgtatatattttcaaatagctagaagagagaatactgaatgttcctagcacaaagaaatgataaatgtttgagatgatggatatgctcattaccctgatctgatcactataacctgtatgttctgaaatattactgtggaaccaaaaaatacatacaattattatatgttaattaaaagatacaaaaatgaaaataatggcttgttcaaaataataatagcaacaatgtatttggtgactatagctatggataagtgaaatgaatgaccacagtgttataaggcacgggggaggggaaactgtaaagagtctgttacaaagtacttgcaggaagtggtatagtgttatttgaatgaggacttagatagattagttgtaaatgtacattgcaaactcaagggcaataacaaaaaaaagttttttaaaaaagtaagtataattgatctgctaagagaagagaaaaaatggaatcatacaaaatagttaaaaccagagaagacagaaaaatagaagaggaaaacagtaacaacaacaacagaacaagggcaatgaataggaaacagtaacatatatggtagatattaatccaactgtatcagtaatcagtttaaatgtcaatggtctaaatacatcaattaaaagacaggttgtcagagtggatccaaaagcaagacccaactatatgctgtctacaggaaacccactttaaacatagaaagacacagatacattaaaagtaaagagatagagaaagatataccatgctaacactaatgaaggggaagtagggtagctatattaatttcagactaagaagacttcagagcaaggaaaattattgggaattaagaggagcattacgtaaagataaagaagtcagaatctcccaaaactctcacaagggaaaacagataatatgaatagacctgtatctattaatgaaattgaatcaataattaataaccttctaaaacagaaagcaccaagcccagatgggttcactgaataattctaaacatataattaaacataactaaacatataggaagaaattaaaccaattccaccatgtcttccaggacatagtggaaactggttctatgaagccagtattacctaatgccagagccaagcaagacattataagaaaggaaaactacaatccaaaatctctcataaaaatagatgcaaaaatcctcaacaaaaggaacaaaatgttagcaaatattagcaacaaaatacagcaaatcaaatccaattatgtatagaaagaattatacaccacgactaagtgggatttattataggtatgaaaggctgattcaacatttgaaaatcaattaatgtaattcatcatagcaagagagtaaagaagtaaaaccatatgatcctatcaaaagatgtagaaaaaacatttgacagctgggcacaggagctcacacctgcaatcccagcattttgtgaggccaaggcaggcagataacttgaggtcaggagtttgtgaccagcctggccaacatggtaaaaccctgtctcaatgaaaaatacaaaaattagccgggcttggtggcaggtgcctgtaattccagctactggggaggctgaggcaggagaatcgattgaacccaggaggcggaggttgcagtgagccaagacgagatagagccactgccactccagcctgggtgacagatcaagaatctgtcttaaaaaaaaaaaaaaaagcaaaagacctgaacagacatttcaccaaagaagatatatagttggcaaataagaataggaaaagatgctcaacatcacatttcattaggaaattccaaattaaaatgaaataccactaaacactattaaaatggccactttccaaaataggtaacatgaactcttattcattgctggtggagacgctaaatggtacggccactcaggaagacagtttggcagttctttacaaaactaaacatactcttaccatacaatccagctgttgcactcctggtacttacccaaaggagttgaaaacttatgttctcacaaaaacttacacatgaatgtttgtagcatattattcataattgccaaaacttagaagcaactaagatgtccatcagtaggttaatgaataaactgtggtacatccaaacaatggaatataattcagcactaaaaagaaataagctagcaagccatgaaaagacaaagaggaaccttactactaagagaaaaaatcccatctgaaaaggcatacatagcgcataattccaactatataaccctctggaaatgacaaaactaaaccatggagataacaaaagaatcagtgattggcagggttgaggggagggagggctgaataaatagaacacagaggatttttagagcagtgaaactacaatgatagatatatgacattacacacttgccaaaattgataggtgtataatacccagagtgaagcctgatgttacctatgaacttacttaggagtgataatgatatgtcaatgcaagctcatagatgctaacaaatatatcactctggtaaggggttttgttagtgcaggaggttgtacataagaaatctctatcttctgctcagttttgctgcgaatctgaaattgctctacaaaataaagccttttcaaaaaaaggatgggcaagatatagaaaactatgaaacattatagagtgaaatgaaaaagaactaaggaaaatcgagtgacatactatgttcttagattgaaacactcagtattgtgaaattgttaattttccacaaactgatttacagttccaatgcactcctcatcaaaacttcagtgcattactgggtatctttccactttggacttgaccagatgatgctaatatttatatggaaatgcaaagatccaagaataagaaagacactcttgtgtaaaagaacaacaaacaaatgcaacaaaaacaaagataaatagatgggacttaattaaactaaaaacctcctgcacagcaaaagaaataatcagcagagttaacagacaatccacagagtgggagaaaatcatcacaatctatatatctggcaaaggattaatatccagaatctacaaggaactcaaattagcaagaaaaaaagccaaacaatctcataaaaaagtgagctaaggacatgaatacacaattctcaaaagaagatatacaaatggccaacaagcatatggaaaaatgctcaacatcactaattatcagggaatcgcaaatcaaaaccacaacatgataccacctcactcccgcaggaatggccacacacaaaaaaaatggatgttggcgtggatgcggtgaaaagggtacacttttacactgttggtgggaatgtaaactagtacaaccactacagaaaacagtgtggagattccttaaagagctaaaagtagatctactgtttgatccagcaatccccctactcggtatcccagaggaaaagaagtcagtatatgaaaaagacacctgtacacacgtttatagcagcacaatttgcaattgcaaaaatatgaaaccagcccaaatgcccatcaatcaacaagtggataaagaaaatgtgacatatatataccacaaaatactactcagccataaaaaggaacaaaataatggcattcgcagcaacctggatggaattggagactactactttatttatttattttgagacggagtcccactctgtagctcaagctggaatgcagtggcgctatcttggctcactgcaacctttgcctccagggctcaactgattcttgcctcagcctcttgagtagctgggactacaggcatgcgccaccatgcctggctaatttttttgtatttttagtagagacagggtttcaccatgttgccctgggtggtcttgagcacctgaactcaggcgatccacttgcctcggcctcccaaagtgctgggattacaggcgtgggccaccacacccggactggagactattattctaagtgaagtaactcgcttcacttactgtaatgtaaaagcaaacttcgtatgttctcactcatatatgggagctatgctatgaggtcataaaggcataagaatggtacgttggactttggggacttgggagaaagtgtggggggtggagagggataagagactacacattaggtacagtgtacactgctctggtgatgggtgcaccaaaatctcagaaatcaccactaaagaacttattcatgtaaccaaacaccaccagttcccccaaaaaccagttgagataaataaaaaattaaagaacaagatgaaacactatcagaaatcaagattaattacacacatacacattaatggaactgaatagacagtccagaaacagatctagatatatgaatgtattatttatggcaaggaaggcactacagagcagtagggaaaaggccaagtcttttcaacaagtggagagctgcatggtaaaaatgtaaaatttgacatttccttagaccacacacacacatcagttgcatgtggcttgtacatctaaatgtgaaacgcataataaagcttccagatggttatataggagaataccttcataatattgggctgtgaaaagagttttcacaaagcaagaaccataaatcagattatattaaaattaagaacttgtgctcagcaaaaggcagcattaagagaaagaaaaagcaaactagagagtgagtgccaatttgtcacatacaattgtcaagggatttgtgtctagaatatataaagaactcacacaaatcactaagaaaaacccaatagagaaatggacaagtgatgtgaacaagtacactagaagatttccaagtggcctataaacatgaacaagtgttcaacttcattagtcatcagagaaatataaattcaaaccatgatgcaataatatgtatcacataccaaaacagatttttttaacaacaatataaaacgttggtgggggccgggtgcagtggctcacacctgtaataccagcactttgggaggtcgaggcaggcagatcacgaggtcaggagtttgagaccagcctggccaacatagtgaaaccctgtctctactaaaaatacaaaaattagctgggcatggtggtgcacgcctgtagtcccagctactcgggaggctgaggcaggagaatcgcttgaacccgggaggcggaggttgtggtgagccaagatcccacaaccgcattccagcctgggcaacagagtgagactgtctcaaaacaaacaaacaaacaaacaaacaaaaaaccaacaaaaataaaacgttggtggggatctggtgcaatggaatgctcaaattctgttaatgggatataaactggtacaatcattctggaaaacaatttgtaattttctttctggacatcttcccaacagaaacgtgtgcacatgtgccctctacatttatacacaagagtgttcatagcaccattacttataatagtgccaaactggaaacaacccatctgttcattgagtagaacaggtaacgtcaatgtattcttataatggaatactgtaaagcagtcaaaacaaatgaactagcctcatgctaccacatggatgaatctcaaaagtaatgttgaggaaaagaagccagataaaagaataaagaatacatattacttgctttcattcatatatgtaatatatatatatgtcaagctaatctgcagtgttataaatgagtctatggtagttacctttttggggtagtaaggaggtggtaactgaaaggagtacaagtgcttcaaggatggtggggaaatgttctatttcgtcaccagatcctccctttgtaagaatttgttgaactgtacattaatactctgtgaacttttctgttacataaattttaaaaattaaataaacaccgatactatcgtagaagccattgttatcagtgaaatgcacaagtaaaatcatgacttaagcgaagaaaaatatagacttctgtgagaagacatattcacagatttgattttccagggaggttttaaaaataaataaattatggtaaaagcaagtaacttacagaagaagattggcacataataaaaaggaaaataacagcttgtccttctcaaatagtgatcggcatatattacaatataagttgtatgtgaagtggtcatttaaatatcgtaggcgcttttccaaaatcttggatttgttactaaagttaaaaagaaggaaaacgtattgtcaaacaaaactaagaaaatataagcaatgtgaattaacatatacactttttattttatgaaagtatcactattaaaaacgtataaagatacacacacgagggcatgtaaaactggtgaaatctgaataagctctatgggttgtagcaatatcagtttctcggttgtactataggcaagatgctagcactggagaaacaagatgaagggtacgtgaaacctctctgcacgtatttttctgtgtgcaacttcttgtgagtctgtaagtattttaaaataaaaagttttaaaatgtagggtataattctctgagaaagtgaaatatggtttacaccatctctctattttccaaatcctaaatatcttattctgccccaaagtgactgaagacaatcagttaattaaaaaaaaaaatgcctattaaatctctattagtgtaaggctctatggtagggagggaaatgtaacagacaaagcattatgaaacatttgcccgccccaaagaagcataaagtctagataaaaatctacataatttaaaaatgcatgaaaaggtcaggcgcagtgtctcctgcttgtaatcccagcactttaggaggccgaggtgggtggatcatttgaggtcagaagtttgagaccagcctggtcaacatggtgaaacctcatctctactaaaaatacaaaaattagccaggggtggtggtacacgcctgtaatcccagctacgagggagcctgaggcaggagaatcacttgtagtggaatgcacctgtaatctcagatacttgggaggctgaggcaggagaatcacttgtagtggaatgcacctgtaatctcagatacttgggaggctgaggcagaagaatcacttgtagtggaaagcacctgtaatctcagatacttgggaggctgaggcaggagaatcgctagaacctgggaggcgaagattgcagtgagccgagattgcaccactgcactccagcctgggtgacagagtgagactccatctcaaaaaaaaaaaaaaaagaagaagaagaagaagaagaaagacataaaatcaacaacctaactagacacctcaaggaactagaaaaagaagactaaaccaaacccaaagctagcaaggaagctaggaaggaaataataaagattagagtggagatgaatgaaatagagaatagaagatcaatacaaaaaaaaagagagagagaagactcaaataacaaaaatcagaaatgaaaatagtagcacactctggtagcacaaccaatgccacagaaatacaaagaattataggagaatgatatgaacaattgtatgccaataaattggataacctagcagaaatggataagtccctagaaactaaagcaccgatcgatttattaatatgctaaaaataacatagctaacaaatcatgcaaagcaggaactaatactgtatctgtctaatttcaaagtccacgttcttgctactatgaagtagtaaatgaagtatgctgatttctaaatttgtagttaatttggtagacaatgcatcaaaagttttcctctaaagtgtaagcagaaaaagaaacaatgtaagtgtaattttcctttcatgtctatgtagatagatttctttggtatgagcttggattctaccatttccgcctagaagtagcaaagaaaaatccatttctctatgctaaattttaggttgtagaaattgtttgtgaaaggtcagtgaaagtgaaagaagtccagcaatttctcccttttttttttccactttgtatcatctctctgttggggctacagacccctaggcatataaggacgaagccccaagtacgcactccactatcctgttggtcaccgggacagcaataaagctctaaagaaactattaagattactactaagacaacattaatgccatcaacatcatcatcaggttcatggttaaatctgctagaaaccatttatttatctgaaataagtcctctctgaactggaataaatatatagtcagtggcacaagccaggtacagaaagataaacattacatgttctcacttatatgtaggagccaaaaaagttgacctcatggaggtagagagtagaaagacacttatcagaggccagaaaggagaggcagacagaggaggataaagagaagcagctcaatgggtacgaacatgcagttagaagaagttccagtgttcaatagtacaatagcgcaactatatttaacaatgtattgcatatttcaagatagaagatttgcaacattcccaacacaaaaagatcgatgttctacgtgatagatatcctaaatgtgctgactccatagttattcattttatgcatgtatcaaaatatcacatgtacctcataaatatgtacaaatattatacatcaatatttttttaaagcagcagccatggtaatagtgtagtggataagacttgagttagaaagccttgctctgttatgtgtcacatgtcactcagcttcggtaaaacacagagacaacccacctgctgcattgcattgctgtgcctatagaatgagatcatgtaggtaaaagcggtaaaagctaggtaaagcactcaggacagaactcaacacacacagtagatgctctatggacagtattagcatcatcatcatcactggagttcagtacacagctacacaggctggttctctctttacgagtaaaagaatatactgttttcattttagatactaggcttcttcataattttaccttcatatcctctctccattcattcataccatagctcttagaaatttctggttggaaaatatgcatttttgccatggatgtagccagacgagttaaagattgacgaccacttcctccaagaccaacaagcaaagcatttccaccagattgctttagaactcgacatattcttgataaatgttccaaaacatacctaccacaaaagaaaaattttattaatgcattacaatataaatgtaaatgtatagttacatgtaactattgtttcactttcctagaagaatgtgactctgctgtcccatatgttactatcccaattttaaagagtttactatcaaaaagtgtgatttttcaaaagcagttacaactggatcatttgatgtaggggaaaactaattaaaagttcaaattcaggaaatttgatatacaagttatacaaataaaatgaaatattaactgctaatactggcagtatattatcacttttattaaatatgtttcttcagtctcttaagatttctatgtgagaaaagatcattacctataaaataacaaattcagaaaaggcacttagcttcactggtaattaggttaattaaaattaaaatgataatgagataccatttcactctccttagactagaaaaacttacagtatctgccagtcctaagcatcagcaaaggtgaagaataatggaagctctcaaaaataataatcactttaaaagatgttttggcaaaatttagtaaagttgaagatgcttatatactatgacatgataatcccacttataggaaaatagcctagagaaattctcacacatgtacccaaggagacacggatgtgaattttcaaagccttttttataatagcaaaaactagaagtcacctaaaatttgtctcagaagaatgactgcattgtggtacaattatataatagaatgcaatatagtggtaaatattcatttttctgtgactctcacaatatggaataaaccaactagcagaagattatatccagtattataccatttatatgcagttttaaaatatgcaaaataagactacatacatatttacgaatacatacatgtatagtaaaagttctaagaaacaaaagtttcggccaggtgtggtggctcacatctgtaatcccagcactttgggaggccaaggcaggcggatcacttgaggtcaggagttcgagaccagcctggccagtatggtgaaaccccatctctactaaaaatacaaaaaaaaattagccaggcatgccggcgcatgcctgtactcccagctacctgggaggctgaggcaggagaatggcttgaacccgggaggtggaggttgcagcgagctgagatagtgccattgcactccaatctgggcaacagagcaagactcagtctcaaaaaaaagaaaaagaaaaaagaaacacaagtttcttttcactactactcgtatgacacaggatgcagtgagacagggtgactataacagggaatttcaaataaattactaatattttatgttttatgctggataatgggtacaaagtcattcactgtatttttctttacaccttttggtacatttcaaacatttcataataacattttacagatagcaatttcaagcatcaacaccatatataggtacctaaaaatgacaagattcattcttgttttgtgtgtttgattatactcatctaagcactggtccacaacatcactaaaatgatgaatatttggaatttcaatataaactctatcatctccttcaaggtcaggattcatataatcaccaaacatgagatttcttaagtcttcttcagttacctatagaaaggaaatcaacaaattttaaaacttaaaacatttaaaaataaatttaagaaaacaaaatttttgtttcatccatgttataaagtaattaagtttttaaacattagggtagtaaaaaatgcacttataaaattaatacctgaaattatatccttaggatataaaaagaaaagtaagatttatatgttttgttgttgttaggctagagaagtcattctgggcgactcccattgagtagttactaagtgatggtcatcatgttaagcactttatatctattatatcatttattccctatcacataaggtgttattctttaaataacttctatgttacatactttcctatgaagataaatcttctcaaaacaaacacctatttacaaggaatgctaaaagaatatgttcattaagaaatgatttttaaaaatataacttaattgtaacaattcatatatggtactgctttaactcaatatgttcttaatcgccatactcactggtgcattttgtttcctcaaatgtgaaaagatactgtgaaatgattctttaaaatggtcctttataacagttttagttaactggaacagccatcttcgatcatcatcattaatgaggcgatcataaaacactcggagaacctcatgcacaaacagacggatcatagtgtgtttgttcgccacggcgtctctttcaatgagtaaacagccccggatgacgcgtgaaaaatcacgcaagttgaaagtataatgggattttgtgggagtgggtaaaagattttccacagattgtttatatatctgaatatgaaaaaagcaacaaagcaaaaataaaatgcttataatcagtaaagtcatgtaaccagtggaatgttatacaaaatattttatttactctgtcagattatatgggcttgggctgggcgcggtggctcacatctgtaatcgcagcacttttggaggctgaggtgggcagatcacctaaggtcaggagttcgagacaagcctggccaacatggcaaaaccctgtctctactaaaaatacaaaaattagccaggtgtcatggcacgtgcctgtaatcccagctacgcaggaggctgaggcaggagaatggcttgaacccgggaggtggaggtagacattgcaaagagccaagatcacgccattgcactccagcctgggcaacgaagtgagattctgcctcaaaaaaaaaaaaaaagaaaaaaaaagattatactggcttggaaaattgcatagtactaagcttagcatggcatatatgtttattttggcttatagcactcaaccaggcattattaacttgagggaacttaatatccgattccatccaagcccagcccatccaagtggaaacctgtctctacttttatttcccagttattatggttacaccatttaaaggtgaataatctgaggttaaatagtgaaaaacaaaatctttcagagaaagggaaatcagataactcatgctgaatcattccaaatgaagaggaagatgaaataattttcttgttactacaatcaacttcaaaataaatcaatttgttctctctcttcccttctatctcttattccctcaccccccttcttctttatatctaaattggctttaaggaaatgaagtatatttttactatgtactgaattcaccaaatgaagtttaacgttctcttaaaggaaggtgaattaagccttttataatatagtcaaaaaaggaaaacaaaaaaactttttttttatttttgagatggagtctcattctgtcgccccgctggagtgcagtggtgaggttttggctcactgcaacctccacctcctggattcaagtgattctcctgcctcagcctcccgagtagctgggactacaggtgcacaccaccacgcccagctaatttttgtatttttagtagagacagggtttcaccatgttggccaggatggtctcaatctcttgaccttgtgatccgcccaccttggcctcccaaagtgctaggattacaggtgtgagtcactgcgcccagccaacgttttttatttgtatgtgttctgtgattcatctccctgctccaacctccacacatggtaggtctataatgcttcaaagacagaaaaaaaaaaaaaaaagccgggggtagggaggtggcagggatgctttctgtatccccttctacctgaccaacacctctgtattttccaggacatgcctgaaatagaaatattatgttttataaatagaagcacttttctgtatcagaacaaatgtactatctctttgctcatagtagtttctttacttgaacagcacacactttccactgaaacaaggggagaattttagaagattgatgttcttggaaatggatggaaggattctagggagttttctgcttcctgttgcagtgatcacaaaatgaaacttgctttatgaagcttctagaaagtgtagtttggtaagatcatgactgacgtgcctttaaatatattgtttcccatttaccattagagatgaggctggctctagtctttgaacagaggcaaataacacacccgaaataagttaaaaactgttctttggccatatggggagtcttgttgtctgtttctacccttgtatttctcttttataattattttttcattgctacttataaattatgtggtctgactaaaagtaatgtattcataagctgcttaaatttctttaagacaagcatgcaaaatgggagggaagatagagagaaaaaacgacaagtaccagagtaggaacctaatagaaaaatacctgtgatgtggcagatactagttttagatgttttccttataacaaccttgtgaaataggtgttttattccattttagtcattaaaaaaacagcctctggaatgtcaaattacttgctcaaaatcatatagctaggaaatagcagtcaaggctcaacccaagttggattccctcatttcaaatcctgtgatcttcctattctctggtcttctaaacagtttctctgacaccaaagaccaaagcagatagcatcaaaaaaataaaataagcgccaaatgagggaaatatgtaatactaaaacatttacattgcattattgactgacctccatagtcccattgactatctggttcccaattacaaagtactctggaggaaattcatgagttctaaggtagaatgctacaatagatgagaagattcggaccatagtttcatcactaaaagaattaatactgcagatgttgaaatgtcgaatacaacggggagtaactggatttcttccaccacctggagggcccattgcagcaatcagctctatgtccaccagcgtgattttacttgtgtccttaaggtcgtaccttagaaagcacacacaaaaaatttagattatctgttataaagacattaagatgggatgaaatatagatctcccaagaaatttaatcagattttagcttctctaaaaggaataacttcagataacactttgagtaggagagaaattttttttaaagcagaatttggtttctcccctcagtgactgattctgctacccagattttggatatctggaatgacccttccctcttacttttccctctctttcctcctactcttccttacagtttgactctccatttctcctttcttattccaaatctagaagcatggatgagtgatcaatcctatttgtagctgtttatagataaggtgactatatatctcattttacctaggacaattctggcttgtgcttgttgtaccgaagtaattattaataacactccccttttactccagaaatgtcacagtttgaacactaagttatatactaaaactggttatagcaatgtcctgattttttctcatctcaaactgtatcttcagagtggataaagatgtctaaataggatctatacattttgttatagaaagggacccattagggaaaaatgaaatttcaaagaagttttaatcagaaataaataggaaatgacataatttagctggaaccactcagagtaaaaggttgctattgtcaataagccatcaagtctctaatactgaagttactgcacacacagacatatacatacagaggctggggtaggagtctatctagccagtccttagactaaaagcatgctagaaagtatgaaaatatggtttttggtaacaaccctaataatcaacaatagaagaccagctaagtaaattacggtgacatccacataatattaaagccaataaaacgaatgagtagacaaatatgcactgatatggctatttgagataaatatataagtgtaaaataatttacaaaatattacatgtaatatgagcctatttttacacataaaaatagacttatatagaaaaaaatcactgaggaatagtgattatctcctgataatcactaactcaggagagtgactatcttctgagataatcgcagtgattatctcaacaatggttatctcctgaaagcagaattcctagggcctatagtaataacaaaaatgcaactgtaaaatatgacttagctttgaaattcgtctacccttgtcttgagataaaaatcatggcatactgaggaatagaaaagtacatttaagaggaggaaaggaagaattattcatcctaattaaaaggtgctatatcttacatgtgagaaactaaccatatcaccataaattggtgtggggagaatggaagggttatccatgagattgctgtcaaatacaagccatctcaaagatatggtaggtagttccaagcagccacagaaaacatacagttaaaaacatggtagaaaaatagggtgctgattatggttacttaggttgggcactacccacaaattcttgacttgggggaatggtactttgaaggatgtaatctgtaaattattttcaataattgaaactaatagttgaaaagtgcaggcataccccattttatttcacttcatttcattaagctttgcagatactgtgtttttttacaatctgaaaaagtttttagaaacctgtgttgagcaggtctataggcaccatttttccaacagcatttgcttacttctggtctctgtgtcacattttggtaatacttgcaatatttcaaacttttccattttttttatatctggtatggtgatctgcgatctttgatgttactattgtaattgttttggagcaccatgaattgacctacataagaagaaaaccttaactgattaaatattgtgtgtgttctgactgttccactgactggctgttccccatctctctccctcttctcagaccttcctattccttgagataaacagtatggaagttaggccaattaataatcctccaggccgggtgtggtggctcatacctgtaatcccagtgctttaggaggccaaggtggtggatcacttgaggtcagaagatcaagaccagcctggccaacatggcaaaaccgtctctactaaaaatacaaaaattagccgggtgtggtggtgtgtacctgtagtcccagctacttgggaggctagggcataagaatcacttgaacctgggaggcggaggttgtagtgagccaagatcacgccactacactccagcctgagtgacagagcaagactttgtctcaaaggcaaaaaaaaaagccaaaaacgtcctagtaaactaggaataaaggtaacttcctcaacttggtaaggaatatctacaaaaaccctacagctaacatcatacttaatggtaagaatctccaagctttcccactaacatcaggaacaagataaaaatgtcccctctcatgacttcttttcaacatcatactaagggctagcaataagatgaaaaaaaaggtataccgactgggaagaaaggaatgaaactatccttgtttgcagataacatgatgatctataaagaaaatctcaaagaactacaaaaaactcctggaactaataagcaattatagcaagcttgtaaagagttaccatgtaaaattcaatcacctttttacataccagtaataaacaagtggaatttgaaattaaaagtacaacacctgggccaggcacagtggctcatgcctgtaatcccagcattttgggaggccgaggaaggtggatcacttgaggtcaggagttcaagaccagcctagccaacatggtgaaaacctgtctctactaaaaacacaaaaattagttgggcatggtggcacatgcctgtaatcccagctacttgggaggctgaggcaggagaatctcttgaacccagaggcagaggttgtagtgagccaagatcatgccactgcactccagcctgggtgacagagtgagacactgtctcaaaaaaaaaaaaaaaaaaaaaaaaaaaaagaaagaaagaaaagtacaacaccatttacattagcacccacccccaatgaaatacttagggatatatctaacaaaatatatagaagatctatatgaggaaaactgtaaaaccctgaagaactaaatcgaagtactaaataaaaagaggtattccatgttcatggataggaaaacaatattatgaagatgacagtccttccaaacttgacatgtagattcaacgcaatcccaatctaaatcccagcaagttattttttggatattgagaaactgattctgaagttgatatggagaggccaaagtcccagattagtcaacactattgaaagagaaaaacaaagtcagaggactgacacacccaactttaaggcttactataaaactacagtagtcaagacaatctggtactggcaaagcagacaaataggtcaatggaacagaatagagagcccagatatagacccaataaatacagttaactaatctttgacaaaggagcaaaggcaatattatggagcaaagatagtcttttcaaggaatgctgctgggcacagtggctcatacctataatcccagctacctaggaggctgaggcagatggattgcttgaagctagaattttgagaacagccttgacaacatagcaagacccctgtcttttagcaaaagacaaatatcgttaaacaactggacatacacgtgtaaaaaattgacctatacacaattttacaccctttacaacaattaactaaaaatggatcacaggcctaaatattaaatgcaatactataaaactcctaggagatagcaaaggagtaaacctagttgaacttgggtatggcaatgactttttcagacacaacaccaacagattggttgagaaactggacttcattaaaattaacaacttctgctctgccaaagacaatgtcaagagaatgagaagacaggcctgacttggagaaaataattgcaaatgacacatctgataaaggactattatccaaaatatacaaagaactcttaaaactaaatgataagaaagcaaacaacccaatttaaaaatggccaaagaccctaacagacacctcaccaagtaagatacagagagggcaaataaacatattaaaagatgcttcttaccgtatgtcatcagggaaatgcaaattaaaacaatgaaataccaccacacactcattagagtggccaaaatctagaacactgacaataccaaatgccagagaagacgtggagcaacactaactctcattcattcctgatgggaatgcaaaatggtatggttattttggaaggtagtttggtggtttcttacaaaactaaacgtattcttaccatattgttcagcaattgtgttccttggtatttactcaaagaagttgacaacttatgtccatgtaaaacctatgcacaaatgtttatagcaactttattcataattgttgaaaacttggaagcaaccaagatgtccttcagtaggttaatggattagttaattgtggttaaccagacaactgaatgttactcagtgctaaaaagaaatgagctatcaagccatgagaagatatgaatgaaactcaaatgcatattactaaatgaaagaagctaatttgaaaaggctatatactgtattactccaactatatgacattctgaaaatggttaaactatagagagaaaaagaaattaatggatctcttacaaaggggctgaagttgggggaggaatgaaaagagaacacagaggatctttacagcagtgaaaattctctgtatgatattataatgatggacacatatcatatacatttctccaaacccatagcatgtacaacacataaagcaaaccctaaagtaaactatggactttgggtgattgtgatataccaacgcaggcttatcatttgtaacaaatgtgccaatttggtggggatgttgagattgaggaggctatgcatgtgtcggggggcaaggagtatacaggaaatctctgtaccttcctcttaatttaaaatagtcttttcgaaatatattagagaggcttcatgtataggaaaatctgagcaactattcttttccctaaatatcttgaaaaatgtattattttactttaaaaacctaaaataaaaactgaggtataacttcagcataacttatcgaattaaatagttaccaatgtccacagtcaaaaaactgtcgtaataattcaataggtggttgagctccatacttctccaatgcaggcatattcatatcatctataaaaattatacacttctttcccataggtggtccaaagactcctttgcgtcttttatccaatctagccatgataatgttctaaaatatgaaggaagaatggtatatttacctataattgaattagggatttatcatacttatattaaatcagtatcaacaagtaaaacaacccattttgccagaatccatgggatttttaccagtaacaattactatttgcttaatttatcaatgattaacttaacataaaataccatatttaacaccagaaaaaaaaagtttaagtttctgtagggaaatcataccaagcagcattatgtgtgtgtttttatttattcatatttagggtgatactaaacttcacaatcaacatcattcaaacatttgttgaaatcctatgcactcacaattgttacacatgtatatttatgtattatctttgtatagtatatgcatgtttctacaacatttctacaagtgtcaccaaaatttctacaatattttcctcactggataaccaacatatttttatttttttcttcactgaataattttactttccaacttttattttagattcagggagtacacatgcaggttatatgggtaattgtgtgttgtgagggtttggtgtacagattatttcatcactcaggtaataagcatagtacccaataggcagtttttcaatcctcaccctcctcccccgctccactctcaaggaggccctgatttctgttgttcccttctttgtgtccatccgtactcaacaatgtatctattaattttaacttacttaatatttaaatgcattaatctttacatttggcagctttttatagctaaaataaatgtggatgctttcttatagttctaatactttgggaactcacttgtccattggaaaaataaaccaaaattattttcattcaaataaagctccacagtaaaggagttctaaatttgtaagattttgaagttcagtgaagaacatagacttaaaacaacagaaatgaggccaggagagaatggataggtataaatttggaaatgtatgataaaaacggcaattagaaacagtttcatgaaatgtgtcaaggtcagtttcaccttgacacatttgagggcaaagggtaggatgcactcacatggttcctgtcacaggcccatggtttgaaaggtccagggagcagcaaatgcccctaatgaccatccaggagggtcttgagagaacaattcaaagttctctcatttctccctgggtctccccacccctgccccaccctatgtgtgtgtttgtgtgtgtgtgagtgtgtgtgtgtcttttatattccctttaccagttaagaaatcgttgcttcttctcaggcttaaaaaaaaaacaggtgataaagctcagtaacccactattaacgtaaaaatgttctctgaaacttgtatcattaattccaaaaacttgtaactccccaaacatttgaaagttttaaattcatagatttacacagttgcttatttaatgtacaattttaaacactgagcaaataagacaaaaaaattaacgatagacccccatttctgtctttaaactaacctgaacctgattggcgctggtccgtgcagataagttaatataaaaaggaaagtactggtccttttccaagtgattcattagcttatccttcacatacacagattttcctgtacccgttggacccacaaaaaggagtggccttaatgaaaacaatgaatatattattcaaaatggaaaaaaagtcagaatacatttctactaaaggaggcggtagttaaaagtgtacataagaatcaaatcatcttcattaaaaactcatttttacctatagttatttcatgaaagacagataaaagtaatgattggcatatatttttgcacaacattgcagagactttattttgtgtctttttattttttattctttttttttttttttttgagacagagtctcacttagttccccaggctggagggcagtgacgtgatcttggctcactgcaacctccacctcccaggttcaagcaacccccctgcctcagcctcccaagtagctgggactacaggcatgcaccaccacacctggctaatttttgtatttttagtagagacgggtttcaccgtgttggccaggctggtcttgaactcctgacctcaagtaatccacctgccttggcctcccaaagtgctgggattacaggcatgagccaccatgcttgatctatttttattttttgagataaggtttcactctgtcactcagtctggaatgaagtggcacaatcatagctcactgcagccttgaacttctgggctcaagtgatcctcctgcctcagcttcccaagtagctaggactacaggtggcatgccaccacaccaggctaatttttttacttttaacgttttaaagagacagggcccggctatgttgcccatgctggtctcaaactcttggcctcaagtgatcctcttgtcccagcctcccaaagcactgggattacagacaggagccactgggaccagccttatagatactttaatagtaataaactattatttgaatagatgtaatatcgctatatataaaacacttatgaaacaagtaataatatgcttaacttttcagagcagaaagtcaaagtctgtctcctcagaaaagagttgtatttgtacttttagggtacagacatgggggcagcatgtgaataacaaggggatgacaataagacagctagctgtaggctgtttcccagtgatctcaatagccaaaggttttgtgagagatggaatgacagtcaattctaaagctaacagttatgtatatgtatactgttaacagcatttttaaatcaattcaattacaaactgaaaatatttgtccaaaagcaaactctaaggaattccccattcagtgaatggggaattcaagcaaggtttcccattcttaaatgatcataactaattttaaggggaaaagtaatcatatgagtttatgttcacaaaactctggagaatccctgtttgagaaatgctgcattaaaaataaaatactatcattttgaatgataacttgttactacacaatacataaagacaaacacaggccaggcgcggtggcacacgcctgtaatcccagcactttgggaggccgaggcaggtggattacctgaggtcaggagttcgagaccagcctgaccaacatgtagaaaccccatctctattaaaaatacaaaattaactgggcatggtggcaaatgcctgtaatcccagctacttgggaggctaaggcaggagaatcgcttgaacccgggaggcagaggttgtggtgagctgagattgtgccattgcactccagcctaggcaagaagagtgaaacaccttctaaaaaaaaatttaaaaaaagacaaatacaaaggccagcactgaaactgagtaatagccatattcagttctaaggggtcatctaagtgagccaaactatgctagtattaattttgaaaactgttactgaaatatgaacacaaaattaaagttcttttagaaacagagtgacccctgagaattcatctacatgttccagtctgagtaacattagctctatgaaaatttattaaaatagtattaataaatttctgttcttaacttggggtccatgagccaactaaaaacattcatagaattcagagaatctgtgaacttgaatgacaaaaatgttatacctttactttttgctatcctctaaaatgtagcaattgtatgaatagtacctgtgtctttgtcaccagtagaaatcatagctattatcctacacattacaattgttacagtatctcaaaaatatcactcatgcccattccttcttcaaaggtattatagtcatcagatccactgacagatcttgttatttaatgtgttaataaagaaacatatatatattactactatggcccaaatatgttcaatattttcataaatgtatttcgatataaaaagaaaaaaacaggctgggcacggtggctcaagcctgtaatcccagcactttgggaggccaaggtggatggatcatttgaggccaggagttcaagaccagcctggccaatatggtgaacccccgactctactaaaaatacaaaaaattagcctggcgtggtggcaggtgcctgtaatcccagctactcaggaggctgaggtaggagaagtgcttgaacccaggaggcagaggttgcagtgagcagagatgctggaatgcactgcattccagcctgggagacagagcgcaagcgacttgtctgaaataaataaacaaataaataaatatatatatggtttactttataattctatttgtacttatttaaaagtattattctgacaaatggttcttggcacaaaagaactgtattgccaggcacggtgtaatcctagcactttgagaggctgaggtgggtggattgcttgagctcaggtgttcaagatgagtctgggcaacctgtctctacaaaaaaaaaaaaaaaaaaaaaaaaaaaagccaggcatagtggtgcatgcttgtagtcccagctacttgagaggctgaggtgggaggatcgctagagcctgggaagtcaagactgcagtgagccgtgatcgcaccactgtagtccagcctgggtgacagagtgagaccctgtctcaaaaaaaaaaacaaaaaactgctatactagaaatgtcacagaattggcaattgtcttccttgcttagcttctaaatgcaaaaatgcaactacggacacaaaataggggtaaactaattttccctcataagctatttttcctgtttttttgtttttttaaatgagataaaattggtcacagaatgcattcaggaacagcttctttatcaaaaaaatgacatttatgattatataaacttgtctagtttaaatagtatgaatggtaaattatacctagtgttttaaaagaaaaataactattaaatgttattaagaaagttggtatggatatgcaaacagtacacatctaggcttttgatcagtttcatgtgtctttacttttgatggactcttctgagtttttaatattcaccttaagttatggaatccagaactggcataggacataggtgaaaaatgctaaatgtaataggagaatgtggatcatggttactttgatgtctcaggagtacgctgaatctttaattagactgcatacctttttaacagtaacacagcagcaggctttcagtgtgctgttacaaatcaaaaatgtaaggcaacttatgaggcagcaaagtatgatggcaagggctttggagtgggcaatgggaaatgtgtattccaggtttgccaatagcaacagatgtcactttcaacatgccaacaagtcccccaggatttcagttacctgaaaagggatgatctcgaatacttcaaaaattgccataatcctattaaaatggtacttttacattcaaaatgcttgtttatagcagagttccttactttgcataggtaatactcaaatccattagaaacgtatatctaattgtgtccatcgtagggactatgatatcttgaatcttgatttgtttatctcctaaattagtatttttaattaattcattccaatggacccagcgacctttgtttttcaactacaagaaaatataagttttaaaatattaaaaccatgtacttgctgtatctgaaaggctcttttcaacatgtatactattatattagcttttaaaaacttaagtcttcccccttttaatgaaatattacattcacataaaagaacacatatagcatattttaagtcataagcagattaataaaataagcattcatgaaaacaccaatttaaaaaatatattttttcaattttcatttttaataacctgaaaaatataatgtaacttttgttatcacatattcaacatatctaacatttcagatacttttgcctttatgtcttcttaacactccaatattccccaaatgccttcaagatgtccttttgcatacattgagtatttatttgaaagccactctaatgtacttcaagttacaatttcctgggttttggctttacttttttatattttaaaacaaatgggcaataatctaactaaaaataaaatatcacataaaaccactatatttgtttctctaacattattctctttggcattttgatccaggctgaaacaaccaggatatatatcagcatagctgtattaattgttatgatactgaaattcttctgaatcactggctaaataactgctgtcctgacacccctgagtgcctcccaatcttcactccacccccaaccattatcttcttctgcaggttgttttgacccctccctggagaaccccagcccttccactgttaagtaaaaaaagttttaatacctgccaaagtagccccctaagacccgattccagagctgtggctggaatctcacaatcttttcctattttccagcaaattgtacacgtatatgttacatgtttgaattgtggtaactttgtaagtttgggtgaatgtttctttagtaattcatatttgtatttttttaagttttagcttttatttttatcaacattatatatgtacatattttacagtcaaaagatttacaaggttaagaaaaacagcatttccctactgtcactttccctttcctagagaccttcaccttctctaagctggatagtttggtatttattttcgattcttaaagaatatgcttgtgggccgggcgcagtggctcacgcctgtaatcctagcactttgggaggctgaggtgggtggatcacgaggtcaggagactgagaccatcctggctaacacggtgaaaccccgtctctactaaaaatgcaaaaaatcagccaggcgtggtggcgggcacctgtagtcccagctactcgggaggctgaggcaggacaatggcttgaacccaggaggcggagcttgcagtgagccgagattgcgccaccgcactccagcctggacaatagagcaagactccgtctcaaaaaaaaaaaaaaaaaaaaaagaaagaaataaagaatatgcttgtgttaccacctcttttttcacttttagagattactttattgacttcccgctatggctaatgaggatgaaactctctttctggccagattcttaaaattctgtgttagcatggttttggggaaagggtcctgcactgtcagtcaggagaacttgagtcaagttctggctctgctagccattaatctttttaggtttacttccttatcataaaacttgagatttaagtgaaattataactaatgctctatctagatcttatgggggatgaaataaaatttgtatgaatcaaataattattcaaatacttgctgtttaaaaaatgctttggggaattatttaataaaatggaaaaataaatttaatttaaatgtgaaattataaaaatattattaaagcaaatttatttatacagccaataagttatgggaggtgaaactaaaagaagggagcttaaaaagctcaccgcaggagtcaaaataactctaggatgaaaacccaggagctttgtctgctggcctaagcctttgtgttttatcttaccataacaagctttttatgtcatacctcatacatgtagtcatagaccaggcctttttcatcaaatgggcattcccatttacccacagaatctggcactgggttttcatcatcttttcccagtatgattaatcgtatgaaagtatcaaaaacacgacggccatctgtatcacaacttcctccaatcgaccaaatcaaagagaatataaagcaagcctgttggtggagaaaaaatttaacttatagcaattattttaaaaggcattttaggagaaacattaaccaaaattcaatatattaggatatgctcaacttacttgaacaaggtcgtaagtgtaaataaagtagaatggagcactgctaagccacatagtcatttctctgacaatttttatcaaaatgtttgcatgtctttttttttttttttttttttgagacagcgcctctctctggttgcccaggctggagtacagtggcaccatctcaactcactgcaacctcaacctccccagttcaggtgattctggtgtctcagcctcccaagtagctgggactaccagggtacaccacaaagcctgactaattttttgtttttgctttttaagtagagacagggttttgctatgttacccaggctggtcttaaactcctagactcagcaatctacctgccacagcctcctagagtgctaggattacaggcataagctaccgtgcctggcccaatatctatcaaaaaaaatttttttttcttttttgagacagtctcactctctcacccaggctggagtacagtggtgcgatctcagctcactgcaacctctacttcccaggttcaagctattctcctgcctcagcctcccgagtagctgggactacaggcgcccaccaccacggggtttcaccatgttagccaggatggtctcgatctcctgaccccgtgatctgcccgcctcagcctcccaaagtgctgggattacaggtgtgagacaccgcgcccggcctctaacaaaattttaaatacccatactggctgggtacagtggttcacacctgtaatcccagagctttggaaggccaaggaagaaggattgcttgaggccaggaatttgagaccagcctgggcaacatagtaagaccccatctctacaaaatattttttaaaacaaaaataaataaataaaatgtccttaccaaataacctaggaatttctcttgtgggagtttatactcaaatatatttccacctgtgaaaatgacacatgtacaagaatattcactgcagcactatttgtaatagcaaaagatcaaaagcaacccaaattgttcttcagaaatggtctgcttaattggattctgctaatacactgaaatacatgcagctgttaaaaaacaaggtcactctataagcactaatatgaaaatgacatattacaatagagaaacgatgcaaatcagtagacaatgtatgctaatgtatttaaaaatgtatacatgtaaaagagtgtgtgcataaaatacttctagaattctatatagggcaccggcaatattagctgccttcagtgtggctgggggactgctatggaaaagtggggaaaacccacttttgccttttgaattttactctaggtacatgccttatcaagtccaaaagtaaatatatattcagagaaaaatttcacctagatatcaatctgtataactctcttgaagtgattctgaaccacttgaaaggtttaggttttaggtttaccaacagaataaaatgttcaggaaaaatgcaacttgaaggttatataggtaaactattcccatgatacttttataaacagtaacactgatagatatggaagaaagctaaaacttagttttgtaaaaggcggttccaaacctagggagaaaaaggaataaataaattatacttcaaacatgtctgttcaatatcttctaaagcggaaggatataaaggcgaaaaaggaggacaaaaggaagggatttggttagcaggaaaccctggaatgtgagatgtctgaggcagcagatactttgggcagcaaatggaaggaaaaacaatgggagggaactgctatgctgtgaggggagagggaggagatcaatgcatttaggaataaggtggtgcatgggaaaccagcatagaccaggaaaaagacactaaaaacctctttcctcaggctcttgataatctgtttacttgtgccattccctctggcctagctaaccaagactactgacttctccctacctgaggcctccatggattctgcctccaacactccacctagctggctggatgcctattcctggttttatttttttttgagatggagcaattctcctgcctcagcctcctgagtaactgggactacaggcgcctgccaccacgcctggctaatttttgtatttatagtagggatggggtttcaccatgttggccaggctggtctcgaactcctgacctcaaatgatctgcccaccttggcctcccaaagttttgggattacaggcatgagccacggcacccagcctactcctggtctttcatagctagcttttatgttgcctaaatgctggcttaacattaattaataaaattaattcacctaatgtccaaatttgtttaatattaaatcactttattgttgatcaaattataatctttcataataggatagttgaccgagcatggtggctcacaactgtaatcccagcactttgggagaccgaggtgggcgaatcacctgaggtcaggagttcaagaccagcctggccaacatggtgaaaccctgcctttactaaagataaaaaaaattagctcagtgtggcagtgcgcacctgtaatcccagctactcgggaggctggggcaggagaatcacttgaacccaggaggcagaggatgcagtgagctgagatcgcaccactgcactccagcctgggcaacagggcaagattccatctcaaaaaaaaaaaaaaaattggatagttgccaggcgcggtggctcacgccagtaatcccagcactttgggaggccgatgcgggtggatcacgaggtcaggagttcaagaccagcctggccaagatggtgaaactccgtctctactaaaaatacaaaaattagccaggtgtggtggcagtcacctgtaatctcagctactcgggaggctgagggaggagaatcacttaaacctgggggaggtggggggtggaggttgtattaagctgagatcacgtcactgcactccaacctgggtgacagagtgagactctgccctgtctccaaaaaaaaaaaaaaaaagatagttttggttccttgtgacattttaatttctttaaagtgttttttattatcagaataccaggtgttagggcaactttagtgtctccagctattctttcaatgctcaccaaaaaatagctttggatcttgtcatgtctttctcaatataaacatcatgtaccagaagcataatttatttataattaaaaactacatgaagtataaaaccaaccataatccaaacacgaatgtgcttgctagtaggatcattttctaccacattgcaaagtagcacttcaaagaggcgtgtgagagatacaaccacgttgctgttgcttgtaggaatcagttcctgcaaggtgaaaataagataactttcttaattttcatcttatttagaaaataagaaaaacactttatttttaaaaactgataaaagcatacatggttttaataaggtctttttttttgtttttgagatgggatctcactctgtcatccaggctggagcccagttgcacaatcatagctcactgcagcctccaactcctgggcttaagggatcctcctacctcagcctctcaagtagttaggactataggtgagcaccaccaggctatttttttttttcccagataggctctcactctgtcacgcaggctagagtgcagtagtgtgatcacagctcagtgcagcctcaaccttctggactcaggcagtcctcctgcctcagcctcccaaagtgctgggatgacaggcatgagccaccacaactagcctcataaggtctttataatatttaaacttaaaaactttaagtaggcatgataaaacatttctcaaatattttagtttcccatattatattacacaattatacataacaattgtacaatcgcacataatacattctaaattctctgacaaatgaaaactagctactgcaagagaataaacagtgttctaaggatagcagaaatgaagtctctaagagccattcatttatttattcaacaaacatttatgaaaaacatactatacctatgtggcaagctaggagatatggaaataaaagaatccctaaaaatggatgatattaaaattaaatagacaaaaataatatgatgtaataatgatatgacagagaaagtctcagggtaggaggcggctgctagagtgcttgggataaacaattggaggagtgcacaaggaggaaaacgggagagagatacaccaaagagggcttcctggaggaagtaataatagctgagctgaatttggaaggaaaatgtaagtttgccaggtgaacaagggaaggatattcaaggcaggggaatgtatacaaagaaatggagatgtgagcagacacagattattaaggggattctgtaggatatgaaaatagggtatgaaggagggatgcccaaaaattaggcttgagaaatacacaagagtcagatcctaaaaggtttttatatgctgtattaaggatttaattacaagaggaagagagttccaagggagggttttaaataaaggaataaacagaaaggatttgtgttttggaaacttcattctgtagcaggatacagactggaccagagcagctgcatggtattgattcaggtaggaagtgatgatggtcagaattgagatactataacgggaagggtggggcgaggaggtggctgcagaaacagggatggaaagaaaacaggtataaactttatcaagaagggaaaatcaatagatcctggggcctggaccaggtggctcatgcctgtaatcccagcactttgggaggccgaggtgggcagattgcttgaggccaagagttagagaccagcctggccaacatagcaaaacctcatctctacaaaaaaaaaaatatacaaaaattagccaggtgttgtggtgcacgcctgtaattgtgcctgtaatcccagctacctgggaggctgaggcacgagaatcacttgaacctgaaaggtggagtgccactgcactccagcctgggagataaagagagactgtctcagaaaaaaaaaaaaaaaaaaaatctggggactggatgagaaagaactatgagaagaaaatccattactcattatgtggaaaggtgaagcctattttgtattatttataatatatagcattagagttttaaaactataagggactttgtctattttctctatgaagacactatacagaatcttcataaagtggaattgctcatttttttcttttaaatggcacttttttctatgcctagaacattttaggataaaactgagtatctctttcccctctgtatatcaatatatttatttatatgtaagaagcgaatgtgtgtgtgtgtgtgtgtgtgtgtgtgtgtgtgtaggagatggtggaaatggttgaacaatggtccccaaaaagatatttccatgttctaacctgaggaacctataaatgtgatcttatatggaaaaaggtctcagaagaagcaattaagttaaaaatctcaggaggaagacatcattctggattatctagtgggtgctaaatccaagtccttgtaactgtcacatggaggagagacatgtggagtagaaggccatgtgaagattggccggatgcggttgctcatgcctgtaatcccagaactttgggaggccaaggtgggtggatcaactgaggtcaggagttcgagaccagcctggccaacatggagaaaccatgtctctactaaaaatacaaaaaaaattagctgggtgtggtggcatgtgcctgtaatcccagctactcgggaggctaaggcaggagaattgcttcaacgtgggagacagaggttgcggtgaaccaagatcgctccactgcgctccagcctgggtgacagagcaagacagagcaagactccatctcaaaaataaaataaaataaaaagaaggccatgtgaagatggaagaagttggagttatgtagccacaagccaaggaacacctgaggctaccagaatctggacaaggtaagaaaagagtctcccttagagcttccaaggaagtatagccctctacaaacatcctgattttggacttctggtctccagaactgtgagagaatcaatttctggtttttgggtgttttttggttttggggtttttttttttctgagacggagtcttgctctgtcgcccaggctggagtgcagtggcgtgatctcggctcactgcaacctccatctcctgggttccagtgattctcctgcctcagcctcccgagtagctgggattacaggcatgtaccaccatgcccggctaatttttatatctttagtagagacagggtttcaccatattggccagactagtctcaaactcctgacttcaagtgatccgcccacctcagcttcccacagtgtgctgggattataggagtgagccaccgtggctgtagctttagccatcaagtttgtggcaatttgttatgacagccctgggaagctaatacaatatgtaaagttttctcataaaatactaaatattgaataactcataaactcactaaatgtacattgagtttttagaggcacatatttaaaataatttgaaatacggaaagtaattagaatttttaaaattttagacactatggttgtatacaaatagtttagctggaataattcaacccctgagttatgcagctataacttaagcaatataaaaccaacggtggatagtaaatgcataaggacaaactggttttagttattcattctaccaaccactgtgactttagacttagtcaagttgaatggaaacaaagaaacttgaataggtcagagaattataggattaccttgcattttttcttacgctggtttaaagagggtggtattaaccaggcaaaaagtcctctcagaagagcttgatattctggttcacacagaggtcctttcagtgaattcaaccaagaagacacaagtggttcccatcctaactgtgaaggctccaaataaatcataccacaacgacttacagtggcaggctagagaaaaaaggcaactttttgcactgttgtttttataccagtggcacctggcaattatcaactatttcttaagatgacttatgagatcctttataatctagctcccatctgcttcacatagcttcacacagtctagacgttccccatacagaaaactatttgcagttcagttccccagatatgtaaaggctccatgtctttaaacattatctcgatctggaaacgcctaggatttccaaatccaatctccctggagaagtcttacatcttcctcaaaatcagatcaaacactcagttaccttccatggtgctcctctatccatcctcctcacagatgctcactcctctccacacattttttttttttttgagacggagtttcactcttgttgcccaggctggagtgcaatggtaccatctcggctcactgcaacctccacctcctgggttcaagcgattctcctgcctcagcctcccaagtagctgggattacaggcatgcaccaccatgcctggctaattgtgtatttttagtagagatggggtttctccatgttggtcaggctggtcttgaacttcccacctcaggtgatctgcccgcctcagcctcccaaagtgctggaattacaggcgtgagccaccgtgcccagccatcctcttcacactcttaaagcactaacatgtagctgtgtaatgggattattaacatgcttctcatcctccctaaacaagcatacactgtgtcttattcatctttatattcctagtgcctaacccattttctgacatataataaaaaatacttattggctaaattaaagaatgaagaaatgaacaaaccaccattgtattaaattatgaacttacggatgcctgggaaaggtccattgtttcaaagatgaggctcatttggggggacatctgaatgatttctccactcataaggcaaagctaaaagcaattatttttcaaatgtttattttttaaaatttcaagtttctcagataaaaatttatactatgtataaaataaagtagctcctgtgatataatggaataagaattagaatggaagccagaaaatcttaattctaggtctagccctgttaattattaagtatttaagcaaatacttaacatctccgagtctcagtctcttcatctataaaacagggataatagtgctcttgtagaattgtaggaagggggactataagacaaagtccaaaacctataaaatcctatacaaatatcggctattaagaaaattaagtgaaatactcctgaatttataaagtgaccatagacctttttattaaattaaaaaatagaaaatagagaatagcatgcgtactcttatacccagctcatagatttaatcaatgttaagattttgccatattgccattacctttttaaaaaaacagtttaaagagcattatagacatcacatcatggcatttcacattcaaatgcctatgtttccaaaaaataagtatattttctatgtaatcacaataacattatcacacctaacaaaatgaataattctttattatcatctaatactcagtcaatactcaaatttcctcagttgtaccagaaatgtcttttcaatggatttatttaaagcaaaattcaatcaaagactatgcattgagttttttatgtctccttggtctcttaatctaaaacatttcttcttttatcaaatatgtcaaaaactgaatttatcaactgcttcctttccctcaaatttctgtcttgtctattattaaagccatcctatctcctcaatctctttggcttgcagctatggaattatcattaacttttaatagtattattattattaacttgatacctaaattaattttattactaagtcttttaaattcttgtacatttagttttcagtgtttcctttctgcttttacaatcatcactttagttccagtttttcccctatctagtcacatgtcaacaatgagaaatttaacatttgtggattccgtttcttagctgtaaaatgaatgatctagaggtggattgtccaatacggtagctgctagccatatgtggctatttatatttaattttagctaactaaaactaaataaaatttaaaattcagttcttcaactgcactaatccacacttcaaatgctcagtagccacatgtgactagtagctaccttctcagagaacacagatagttgcagtattgtaaaaagttctactggacatgctggtctagaatacttttaatctttgaccagattatttcagcaaacatcctcctaactctgcacaaatttgaaaggtagggtcagcattctcctcactgccctgtgttgtttcccaactacttctattccacccccagtgacaacccctgttttttccctgccactcaacagtactcagtgattccctcctcaatagctaaagtccttgggacatggcctaatctcactctctactataactctggcctgatccagtgtttataaagactgagaatctcaacacagctgcccatcagatccttgaccaccttgctccactccagctgtccactttatgtatctgggaccttctctccagaaataatacacaattctgaaatattaaattcatgtatctcagtctctgcccacagcctccaatccatccagttatttcattcattgtctcctactacacttgctcctcattttcccaatattttcacatccctgatgttttcacttctttcattaggcagcttttgtcctatggtctaatgcttctaccattctcatgtcaataactttgaagtcttactatatttccaggcctacaatattacctatgcctaagctgcttagactggtagagagtacctcacaaaggcagaccttggtactactaatgataatttatggtcttccactcaatcaggctctcagtgctacccagaagtgcttctatgttttcctaggtagctctctttcccatcttccacaaaggctaatttaagtctcttcttttatcctcaattttgcaaagaaccaaggcccatcacttcacgaagaaaagagaaatcatcacaaggatttgccttcaaatttccacagtcaaatccatacactcacctatagctgtcttttcataattccctctcatgcagtaagagacaatccatctgcttggctctgaacccttagacttcactctacaattagaataaccttcctgcttcttctctatttactttctaccctaagctcaaccaatattactgaatgcatgaaagaaggaatgtgaatgactaaccacctatgataaagtacttcagtatatctttttttttttttttttctgagatggagtcttgccctgtcgcccaggttagagtgcagtggtgtgatctcggttaactgcaacctctgcctcctgggttcaagtgattctcctgcctcagcctcctgagtagctgggattacaggcgcgcgccaccacacccagctaattttttttttttttttgtattttagtagagacagggtttcaccatgttgctcaggctggtctcgaactcctgacctcaaatgatccacctgccttagcctcccaaagtgctgggataacaggcgtgagccaccgcgcccggccttgagtgtatctttaaatgctaattaaatgagtttgtttatttagtagggcagtcatttcatgtaagtatggaaataatctgtgatatattcacacactaggatactaatatagacataaataagttaacaaaactgaactacagtaatatgaacatcacacatatattgatttaaaaaaaacactgaagaatatgattccaatgtattaagttcaagagctggcaaaactaattcatcatagaagtcagaagagtgattatctctggaggaagataaacaaactaggaaggaacatgagtgaaccttgtagggtataggaaatttcatgtgtcattttttaggtgatgattatgtgagtatacaaacacattttaaaaatcatagaatctacacttgaaattggtatacattttataccttatatatgttgtctctcaattaaaataaatattagaatactttcactttctagttcttttgtatatctcatagcgccgaaggtgatatactgtatataaacgctgaagcattccatgttttcaaaaggaattaggcttttgttattttatcctaaaatactgaagttctataagaaaccataagactgaagtcacttaacaacttattctcaccctagattactatgtcttctggctaacacagtaattttaatacaatatactttcattctacaaaaaaaaaaaaaaattaacccaaggacttactatagcagttttcattgaaaagagaatttataaacctactcaacttgctgcatcctttatttttgcatcctttattttaaatagagtcctagtttagttgctgaacacataaaattgcttaatcatggctgaatctgcttctcttttgatcatgatttacctttttattatcatccaatactgtgttcatgctctctatccacaaagtgtcaataggaccatcaaatacaacccatttccggtcaggtgtttctgataaggcaaattctctaaaagtgttagccacaataccatcagtccactgaggaggaaaaaaaagaattaaaaagctctcctcataaaattagatttaggagtaaaactatgaaaatacttcacgtttcttgttttaacaggcactttccataagagagttgggaatacttatatttaggttacctcatgagacactgggtcaaactgtccaaaaagttggcccatagtaatagatttggggtttacagttctataaatgaccttttcttcctctccatagccatgttcattcattaaagttagcgtatccgccagcacatgcagaacttttgtcttagcagcaaaaggctctcctactaacataaaactatgaaggaaaagaaataattatacaataagagtctttaaagagttaaataatttatatcagtatataaaactttaccctgtgataattactacttataatttttgaaatcatatgaatttttctcagacatgaagaaaacatatttaatttctgaactgattgactacaaatcaaattcttcactgtaatattattttctccaaaagggaatataataaacaatctccaaatgacaatgaaaacttattatctgtgtactcttaaaaaaactaaacctgaagcccactaaggagagaactgggaaagatttatattcccaaagtcttcacttgccataaaactattagtgttctttaccaactatttctggatctcctccctcctggcacatataggatttctggccctcttgtggaaagactaggtaactagttctaaccaacgggtaataaatggaaatgatgggcattacttccaagcagggataggtaattgccagctagagacctcacagagctcccttttccctctagcatggccgtgacccacaacgttgaggtggtgcttactctaacagcctgggccctgagtggtcatgacgagcagggctgccctggtaacctactatatataaatgagaaataaatctttgttttttaaatcactaacatttgggtgttgacagttcttacagaatatcctagcccatccttaataacagaagttggtacctagaagagggggggatattcttgccataataataataataaaaaaaacctaatgtggcattggcttaaaggccagattgtgagtgacaaattaactggtatcagaagctaaaatatggacaattattgtcatgcaatgaatgatgaaacatttggtaaatgtattccttgagattacctggaagacagctaattacctaaggaaatgagaattttaggtgaaaaggatagtaaacagaatgttattagtatataatgacaggtactggtttcacttaaaaaagaaccataacaaagaaatgagcccagaaaaaaacatggtcagtttgcaagcaggaatgaaagagggagtccagaaattcagggacttctggaattgaatgtatcaagttattctcattcgcaactggtaaaagataaaattaagaaaacctttaaacaaaaatctattaaaactcagtttggcatcaagtatcaaatcaagggtagggtcattgtatcacattattaaaacctatgaaggattaatatgggccgggtggctcatgcctgtaatcccagcactttgggaggccaaggtgggcagatcacttgaggtcaggagttcaagaccagcttggccaacatggcaaaaccctgtctttactaaaaataccaaaattagctgggcgtgatggcatgtccctgtagtcccagctactcaggaggctgaggcatgagaatcacttgaacccaggaggtggaggttgcagtgagccaagatcttgccactgcattccagcctgggtgatagaccaagactctgtctcccaaaaaaaaaaaaaaaaaaagaatataattcccagtaatcatttcaggagaataaaatgattcatgaaaaacagactaagattgtggctccctccacaaagcctgataaggtcaaggatacttccaggaaattttaaaaggtatggcttattaaggacagtagttacggatataggaacatggagctgtctagaatcaaatagataaaaagctgattgtttttgagggagtttactgaccaaaaaaactgtgagtctagtctaaaacataagtgaatgttcaagacttaaataatccttgggaactaggtgtggtggtgcgcacctgtagtcccagctactcaggaagctcaggagggaggatcacttgagccctggagtttgagaccagcctgggcgatatcaacagactacatctcaaaaatacataataaataatatttaaaataatccttgggtattgaatgcataagggttgattgtactattccctctatttttgtatgtttaaaaatttacataatgtttttgtaaccctacctttagaaaaaatcgtgaccattgagatcccaactttctataggcaagaagcaggctcaaaacatttctcaactctcccaagaacagtattttctctattgcccacttcatatgtgcccagagaagaaaatggaaatggaaagacctctcagaaggttaaactaaggcccaagaagaagaattaaactggaaagcccctctcaggtagcaaaaaccaagcagaagtagattcaggttttaagaaaggtggctctctaagtaaatataaatatatatacacacacacataacttacttatataacatatatataacttttacttatataactataaatacaaaatgtccatagccactttaatgacaccctgtataataaatcacatatacaaaatgcttatggctccttagatgaggcccttcaagtgagaggtcctgaagtttaaactctattagtttcacaatcaatccatctctagaactggggccctcacatgaccagctggatttcagaattgtcacattacagtgttggctgtgtcttctattcttcagtttctgaatgggagtgtttgctctggtaaccctgttctgataagcccactattgtgcactgggtttgtggagaaaagataacttgtctttctaggttgtaggtctctggatcaagaggaacaacttccaggtatgatacaaaggctaccatgcatcgtcacctagggatcctgaactttgagtctggttcatttattgattagaacttttaggtgcctccctgggaagggaagagtgtgtttttatgcaaatggtggtatttattagtactaggtcactgaatgagcacttcttaccaacccttgttggacatgtagtatgagaaataaacctttgccttttaagccactggggggccagggggcgggcgggggttgctctcaactcacctaatcagtttgccaagtctttggttcatggattttagttgttttaccagcttaattaagaaataacatctaactatagcaatatataatcttacccatgtctaacaatcatcatttcatatgtttgaattattttttcaagaaaaaatttaacaggctgaagattatgtacattgcaggcttcatgagcacattccaaaaattcctgaaataaaaaaaagtaatgcatttctacaacacaatattataaatgtcatacctgtcttataagtgtagattttaaatttactagttaaaaaaaaactatcatcattgtttattatttcttaaaactttattattttttcaaatcaagaggagaaacatagactcaaaatacttttaatgtattagtcttccctattgtaagttatgaatgatcatagcatgatagtactgggtgtatgctgcatgaaaataactccttttaatagtgtttcccagaatttcacttttggttaggaaatagaaagacctgtcagacaatcctgcacacttgtagtaaccagaaataaacaaataagttttttaaaattataaaaaatttaaacacatagaagtactttggatgcaaataaatatataaaagaactcagtttcagaaagggatgatgagcctttcctaggtaagcacaaagcaacagctgttttcaccctagggacattttctaagtctggacttggtggatatcggattgggcctgctatagacagaaggacttagccaaagtaggaagaaaccaatagagattttaatggttgtgtgggcttatgtgacagatttgaatttggagaagcccaaatgccaagctggttctcccgaacatccatgcttttgctcagcatgtagtgacacaagagaccaagggcttggctggaaagacacacagagagatttctttagtctcagaatgcttagatcccaaaatcctactacagggaagggccaatcatatggcaggacaattcttactcagaagacatttgaagccagaagtaaactacagctcagtaatgctgcaacaaaactctgacttaggtcaacactcaactgaattgattagcaatgcaacctagctacctgaaatagggaaaaatctcatgatttttctgcaggaaaataataccacctggccaggtgcggtggctcatgcctgtaatcccagcactttgggaggccaaggcgggtggatcacctgaaatcaggagttcaagaccagcccgcccaacatggcaaaatcctatctctactaaacatacaaaaaaatcagccaggcgtggtggcgggcacctgtaatcccagttactcgggaggctgaggcaggagaatcgcttgaacccgggaggtggagcttgcagtgagccaagattgcaccactgcactccagcctgggcaacaagagcgaaacttcgtctcaacaacaaaaaacaaacaaacaaaaacaaaacaaaacaaaacaaaacatcttagcctgtataattattttatacacattgtttaacatacaatcaaaacttaaggttggacgtcctagccagaacaatcaggcaagagaaagaaataaaaggcatccaaatagaaaaagaagaagtcaaactgtcttctctgacaatatgatgctacacctagaaaaccctaaagactctgccaaaaggctcctgaaactgataaatgactatggtaaagtttcaggaacaaaatcaatgtacaaaaatcagtagcatttccacacaccaataacattcaagctgaaagttatatcaagaatgcaatccggccgggcgcggtggcccacgtctgtaatctcagcactttgggaggccgaggtgggtggatcatttgaggtcagaggttcaagaccagcctggccaacatggtgaaaccccatctctactaaaaatacaaaactatctgggcagtagtggcacgcacctgtaatcccagctacttgggaggctgcagtaagcagagattgtgccactgcactccagtctgggcaacagagtgaaactctgtctcagacaaaaaaaaaaaaaaggaaagcaactccatttacaatagacatacacacacacatacacacacacagtaggaatatatctaaccaaagagataaagatctctacaaggagaactacaaaacactgctgaaagaaatcatagatgacacaaatggaaaaacatcccatgctcatggattggaagaatgaatattgttaaaatggccatgctgctcaatgcaatctacggattcaatgctactcctatcaagctaccaagattacttttcacagaactagaaaaaaattattctaaaattcagatggaaccaaaaaggagcctgaatagccaaagcaatcctaagcaaaaagaacaaagccagaggaatcacattacccaacttcaaactataagattacagtaaccaaaactgtatggtactggtacaaaaatagtgacacagaccaatagaatgactagaaacccaaaaataaagctgcacacctacagccacctgatcttcaacaaagtggacaaaagcgatggagaaaagacttcctattcaatccatagtgctaggatggcttgttagccatatatagaagaattattggacccctacctttcaccatatacaaaaattaactcaatatggactgaaaagttaagatctcaaactgtaagaatcctagaagaaaacctaggaatcaccattctggacactggccttgggaaggaatttatgactaagtcctcaaaagcaatcgctacaaaaacaaaaactgacaagtgggacctatttaaactacagagcttctgcatggcaaaagaaactatcaacagaaaaaacaacaacctacagaatgggagaaaatattcacaaattatgcatccagcaaaggtctaatatccagaattgataaggaacttaaacaattgaacaggaaaaaaaaacatttaaaaatgggcaaaggatacgaacagatgcttctcaaaagacatgcaagcagccaacaaatatatgaaaaaatgttcaacatcactaatcgtcagagaaatgcaaatcaaaaatacaatgagataccatctcatacaagtcagaatggctattactaaaaagttaagaacaacagatgctggcaagcctgcagagaaaagggaatactcatatgctgttggtaggaatgcaaattagttcagtcaccgtggaaagcagtttagagatttctcaaaaaacttaaaacagaactaccatttgacccagcaatcccattactgggtatatatccaaaagaaaataaattgttctaccaaagagacacatgcatgcattatgtttaccacagcactattcacaatagcaaagacatggaatcaacctaggtgcccatcaacagtagattgaataaagcaaatgtacatatataccatggaatactatgcagccataaaaaagaacaaaatcatgtcctttgcagcaacatggatatagctggaggccactctcctaagcaaattcacacaggaacaggaaaccaaatactgcatgttctcacttgtaagtggtaggcaaacactgggtactcatgaacataataatggcaacaacagacactggggactactaaggggaagagagagggaggggaacaagggctgaaaaactaactattgggtactatgctcagtacctgggtgatggtatcaataatacctcaaacttcagcatcatgattatgcccatgaaacaaacctgcacatgtaccccttgaatctaaaagttgaaattcctttaaaaataagtaaataggccaggagtggtggctcatgcctgtaatcccagcactttgggaggccaaggtgagtggatgggttgagcccgggagttcaagaccagcctgagcaacataacaagacctcctctctactaaaaatacaaaaaaattagccaggtgtggtggtacattcctgtagtcccagctactcagaaggctgatgtaggaggattgcttgagcccaggagttggaggctgcagtgagccatgattgcactgctgtactccagcctgggtaacagagcaagaccctaactctaaatagtcacttcataacagaaccaaaaaaataatgaagtcatgagaaatagctgatgaccaagagaaaaaacagtaaacaaaacaaactcatagatgacccagatgtcataattaacagataagaacttgacaatacatttacaaagtataaaaagaatagattataagatagaaaaaatagaggaaaaaatatagaattttagcagaaaagagaactctctaaaaagaaccaattggacacactagaactaaaaagatcaaaatatgtgaaattaagaattcattgaatgggcttatcagcaaactggacaaagccaaagaaagaaccactaaccttgaagataggtcaattagaaagtatccaaactacagagagaaagtaatgaaaaacaaaagagaaaaaaagaggcatgagagacacatgaaactatatagaatggtctaatatacatgtcactgaagttccggaaggagagaggagaaaaaattaaggcataaaaacatataaaaagataattactgaatattttctggctgagtacagtggttcatgcctgtaatcacagctctttaggaggctgcttgagcccagagcttgataccaacctgagcaacaaagtaaaaccttgtctctatgaaaaataaaataattagttgggtgtggtggcacgcgcccataatcccagctacttgggaggctgagatgggaggattgcttgagcccaggaggttgacaatgcagtgagctatgatcatgccactgcactccagcctcggcaaaagtgagaccctgtctctaaaaaaagaaaagaaaaagtaaattttctggcaaaacacatcaacacacagattcaagcagcatagcaaatcccaggcaataaagtacaaaacaaaactaggcacatagtcaaactgctcaaaaccaaaaaagaaaaagaaaaaatattaaaacagccagaggagtataaataagaaaaatgcctgacttctaagcacaacactgaaaggcagcagtctatgaaataacatctttaaatgctgggcgcagggtggggtggggaggagacaccttgccaatctagaattctgtatctgtgaaaatattcttcagaaataaagattaaataaagacattttcagacagacaaaaggtgagggaatttgttgccagaagacccatatacacacaaatactaaaggaagttttttaggttaaaaataaaaaatccaaaatgaaaacatatatctgctggaaagaataaaagcactagaaagggtagcgtaagaggcttttttttttcaaatacaatacttaaagcagaaaataataacaatgcattgtggtgtttacaaaatatatagaagtaaaatatatgacaacaatagcacaatgggcaggagtgagtggataatgaaactataccatttaaggtgcttatattttttgtcaactggtaaaatactaactgtaaagttgtaataagccaaggatatatactgcaacctgtggagtgaccactaaggtaaagctataaagccaatagagaagataaaatggagtgataaacattttttgaaatccaaaagaagtcagtaaaacaaatacagaacccattaaaaagcaagatggcaatttagtactatttttccaactggaatctacggatttattgcagtattcataagagtacataagagttcttcaagaaaatattaaaattttgtgttttcattttggtgtttaaaaatcatattagcatattctgaatcatcttgatagtcaccttaacctgccataaaatgcatattagtatttgagcataagaatttaaaaaacagacaaaaaaataaagatgcctttaagttaagtgatctcttaatgatttgacagctcaaacaaaaagattttgcagtcatatcgtaaagagaagacatggaagaattgaatcatcacttggcaaaaggtggtttatgaacgctgaactcaagagaatcttcactgtacatttcacaatagaaattcccataaagtaacaagttactttcagccacatattacctatttcattaattgcgttaaattgaatttgagattgttttgtttgtaatgttattttatttattatttttattttaagatggagtcttgctctgtcgcacaggctggagtgcaatggcgcaatctcggctcactgcaacctccgcctcccgggttcaagcaattctcctgtctcagccttccaagaagctgggactacaggcgtgcaccaccatgccccgctaatttttgtatttttagcagagacagggtttcaccatgttggccaggctggtctcaaactcctgatcccaggtgatccacctgcctcggcctcccaaagtgctgggattataggtgtgagccaccatgcctggcttgtaattaattttaaactatattctggttttctataacggctataagcagcagttaagtatatacatatttaagcttcattataatatgtataatctacatgaagttggaaatgcgagtggtttgtgtcttatttttgttattttaaatttttaattgacaaatatttttatatatttaaggtgcaacatgatgatttgataaacatatacattatataatgattaccacaatctaattaacatatccatcactacccgtagttaccgtgtgcatctgtgttaaggactgtttcctttaaaaaaaaataaaaatgagtctattaagtaaatttgagaaacaaagccttattatgttacctataggatgttttactactttcatttctatctaataaaatacacaatagtatttagtatgcaatactatatattacacaatagtgtaatacactattacagtatgtatactaatattgtaaatcacaagatagaaaataaaatattttttctcagccaggcacagtggctcacacctgtgatcccagcactttgggaggccaagtctggcagatcacctgaggctgggagttcaagaccagcctgcccaacatggagaaaccccatctctactaaaaatacaattagctgggcatggtggcgcttgcctgtaatcccagctacttgggaggctgaggcaggagaacaggttgaacctgggaggcagagcttgcagtgggctgcgattgcaccattgcactccagcctgggcaacaagagcaaaactctgtctcaaaaaataataattattataataaaataaaataataataatacttattctcttacaaagaacattactttttttaatttttattttttttgagacagagtcttgctctgtggaccaggctggagtgcagtggtgggacaccaccatgcctggctaattttttgtatttttagtggagacagggtttcaccatattggccaggttggtctcaaactcctgacctcaggtgatccacccatctcagcctcccagagtccaggattacaggtgtgaaacaccgtgcctggcctgtttaacctgaatcttgacaggttaaccctggtatcatataatatgaaagtacccaaatttacttattgttattaactaaagtggacaaaataggggattttcctcaaaacagaataatttcacacattaataaatcttggtaaacaattgagtcatcggatgaatttattatgccgaataagtcattctcatgggtttacttacgtgatagtcagcttcaggaagtttaataccaggaaataagtcactagttattccattaaataaaggtatatcatgtgataaaaactttggttcatttacatctttaattgatcgaagaagctaaaattacccaaaaagtacaatgttaagttagttgccagcaattgcaaccccacttctccctcccctcccagccccggcctgccccaccccacccccctggctaaaagtcaaagtttattttacattgctctctggaatccctataataaaaagtcaatactatgcttatcaaactaaaaagtctttgtattcatatgaagtataacaacataacccaaaaaaccatcatttcaacctcttatgaaaagacaaagctcaaccctctcaagtgcctatttgtagttcctgattaacctcactaaagaaaattatctttctactgaaactttcccaatgtgtatatttaatacttacaagtatatcttcattttcatttgggtattttagttttagattgccagcagccactaaaacggcttttactgctcgcattccatagtcgtaatgaaattgcgatgagagctgctctgagcaaagcctataggtcattactattttcacagacagaggtcttgcattcaaaaatccgtaagagtagagggagatttctgctataagcgcatagtttggaaccatcatagccactgttctaaaaagaacctgaagtataaaataaatgaaatatattacgtacataaatgaagctgtttttaagctgagcataagtattcaaaggtgtggtgttgtcaagtttattctccaaatgcagcacctttttctaaactctaattttttttagtagtacttttaatatttttatgcagttagtatttttttggatgtttaaaaaagttttgggagggaaattacaattttatggaaaaaaatcattttgaatggattatgctgggtttttttaattcacgaacttacactcaaaaaatattggctgggtacagtggctcatgcctgtaatcccagcactttgggaggctgaggcgggcgaatcatgaggtcaggagatcaagaccatcctggctaacatggtaaaaccccgtctttactaaaaatacaaaaaattagccaggtgtagtggtgtgtgcctctagtcccagctactcgggagactgaggcaagagaatcgcttgaacccgggaggtggaggttgcagtgagccaagatcgcgccactgcactccagcctgggcaatagagtaagactgtttcaaaaacataaaataaataaataaataaataaataaataatattaccttaagattgtccggcaattcagagcgtcctgcatagccaggattcatggtaatagctacaaaacaattcggattgagcttaagttctgtcccttcaaaaacaaacacaaccaacttctgttgaatagctctctgaatgcaaaggatctgttgagctaccactgacaacacttccaactcaattcgattgaattcatcaaagcaagcccaagcaccagaagaagccagtcctttaaaaaactaaggacaaagaaaaaggaaagtgatttttttctcaggaaaggatatcatctcttaaaacaaatacctaatattttaagtcagaattgaaagttaaatttagtaaaagttccaaggataaaaacaatgtctttactcctaaaatgaaagtccaagtaatattcaaaccacattcatgtttaaacatgagtttgcttccatttatccaattagacctagctgtaagtttgaaacatttaatattattgattcagcaatttaactacctttcccattgctagataatctagcccatcagaacagttgaacaccacacactgtacagcaagagctttagccaagtccttggtggtttcggtttttcctgtgcctgctggcccctctggagcacctccaaggtttaaatagaaagcacctatctgaaatgaaaaacacatgtgaaaagaaatccatgcttaaatttaaaaaaacaacagacacttgtttaccaaatggatttagcctgttctgtagcttcagagaagccattatataattacattgtttaatttttagcccaaatttttctagctgcatgaagagaaagcattttaaaacgttcaaaaaagtgacaatgtatcaaaacttgtcttctgacactttcataggtatcccatttgtttttaaaaacaatctagccttatgggggtaaaattagttcaggaaggttttaattagaagtggttgtggagatggttgtggaggacaataatgacacattctagatggctcactgcaaagggggtaaaacaccagaaagtgagagctataaatggcacccatgattgggaaaagaaacagatgacctattatataattttgtctacgatttgcctggctattgccttttactcttggtatgttctccattttctacattcccataaaactgctctatgcttctcttaccggtagtatcactttctaccttgtattatacttaattacgtacattcttttttctcatcaattagtctttaaagtgcttaatgacaatatcagcagtatttgaattattcctgggtccccacaatgactggaatagtggctggaaatttttagaaacataaattacagtcagctctaactatggagtctgtttcacgggagtttcaaatttaacttcttttagaaaaagtacggctaagtgaccaaggctgtgcatgtaaggggggtagggggaataagtgaactctgcagtttgctcttaattttgctatgaacctagaactgctcaaaaaaaggtctacctttaaaaataagtaaaccacaaagtgataaatatttttactttatttttactttattttaaaaatccaagagagacagctagtgtaaaaaatgcagtatcagtgatagttcatccattttattttattttttgagaccgggtcttgctctattacccaggctggagcacagtggtgagatcttgactaggtgcccctctgcctcctgggctcaagcaaccctcccacctcagcctcccgagtagcgaggactataggtgtatgccaccacactcagtttattttttgtatttttagtagagaagaggtctcactgtgttgcccaagctggtctcaaactcctgagctcaagccatcctcctgccttagtctcccaaagtcctgggattataggcatgagctaccacacctggccaacctattttaaatttataatggatgccatattgttaatgcccattaacttgattgctgaaaacctcgggctcttccttttcaattttaagaaaatgttcacaaacatgttccctttattgtgaataataaatatactagtgtgtctggaattggtgggtgcttggtctcactgacttcaagaatgaagccgcggaccctcgaggtgagtcttacagctcttaaggtggcgcatccagagtttgttccttctgatggtcggatgtgttgggagtttcttccttctggtgggttcgtggtctcgctggctcaggagtgaagctgcagaccttcacagtgagtgttacagctcttaaggcagcacgtctggacttgttcattcctcctggtgggctcgtgctctcactggcttcaggagagaagctgcagaccttcgccctgagtgttaaagctcttaatgcagcacgtctggagttgttcgttcctcccaggggggctcgtggtctcgctggcttcaggagtgaagctgtaggtcttcgcagtgagtgtgacagctcagtggacccagagtgagcagtagcaagatttattgcaaaaagcaaaagaacaaagcttccacagcgtggaatagaacccgaccatgttgccaatgctggctcaggcagcctgcttttattctcttatctggccccacccacatcctgctgattggtagagcgagtggcctgttttaacagggtgctgattggtgcatttacaatccctgagctagatacaaagctctccacgtccccatcagattagttagatacagagtatggacacaaaggttctccaaagccccaccagagtagctagatacagagtgttgattggtgcactcacaaaccttgagctaaacacagggtgctgattggtgtgtttacaaaccttgagctagatacagagtgccgattggtgtatttacaaccctgagctagacataaaggttctccaaggccccaccagagcagctagatacagagtgttgattggtgcactcacaaaccttgagctaaacacagggtgctgattggtgtgtttacaaaccttgagctagatacagagtgccgattggtgtatttacaaccctgagctagacataaaggttctccaaggccccaccagagcagctagatacagagtgttgattggtgcactcacaaaccttgagctaaacacagggtgctgattggtgtatttacaatccctgagctagacataaagactctccatgtccccaccagactcagaagcccggctggcttcacctagtggatcccacacccgggctgcaggtggagctgcctgccagtcccacgctgtgcgctcgcactcctcagcccttgggtggtcgatgggactgggcgccatggagcagggggtggtgctcctcagggaggctccggccgcacaggagcccatggagtgggtgggaggctcaggcatggcgggctgcaggtcccgagccatgcccggcgggaaggcagctaaggcccggtgagaaatcgagcgcagcgctggtgggctggcactgctgggggacccagtacaccctccacagccactagcccaggtgctaagtccctcattgcccggggccggcagggctggccggctgctcagagtgcggggcccgccaagcccacgcccacctgtaactccagctggcccgcaagcgccgcacgcagccttggttcccgctcgcgcctctccctccacacctccctgcaagctgagggagtgggctccagccttggccagcccagaaaggggctcccacagtgcagcggcgggccgaagggctcctcaagtgccgccaaagtgggaacccaggcagaggaggcgccgagagcaagcgagggctctgaggactgccatcacgctgtcatctctcactaggagactttttctcagtgtctagtgttatattcaagcgtttaatatgatcccgggtgggcacagtggctcacacccgtaatcccaacactttgggaggcataggcaggtggatcacttgaggtcaggagttcaagaccagcctggccaacatggtgaaaccctgtctctacgaaaaatacaaaaatcagccaggtacagtggcacatgcctgtaatcccagctatttgggaggctgaggcaggagaatcacttgaacctgggaggcggaggttgtagtgagccaagatcgcaccactgcactccagcctgggtgacagagtgagactgtctcaatttaaaaaaaaaaaaaggtggcccagtgaggtggctcatgcctgtaatcccagcactttgggaggctgaggtgggcagatcacctgaggtagggagtttgagaccagcctacataacatggagaaaccctgtctctaccaaaaacacaaaattagttgggcgtggtggcacatgcctgtaatcccagctacttgggaggctgaggcaggagaatcgcttgaagcagggaggcggaggttgtggtaagccgagatcgcaccattgcactctagcctgggcaacaagagcgaaactccatctcaaaaagtgttgaatatgattctgatttttacaactcaaagttgttagcccccaccttacaagcacaccacagcttctgacttcacagaggtaacagatatgacatcctattttgaaattcatctgctcaacaaatatttagggataactgtgtccttgttcagcactagagtagagaacaagacagacatagttcttgcccacaggcagctacccgagaaaataaagggtttggtgaaatcttttctcccagatccattgttgccctacccagagcccctttacccagccattgcattcatcccccatttgctgtgtcagttgcaaatagttcacagctgctcttttctccttatcagcaagaaaatgcctgaaagcttactcatatccctgccccaggggtgacccttagtcaatgacattaaacgggtacaaaagtcagaccctgctgctttgaagtggaataattcgtgccattcatgcttcagagtgccctgtgagagcaggctacaactgtacatctgttgaaaccacatctttgcttaactttttactgtcccatcctgctgtccttatttccctacaggtttttactaagaacattacctaataaatcctttgcacaagaattgccacttcatttctgctttaagataactcattcgaagacactttaatttcacttactcagcacaggtagagtggtacttcttgatgctccttctcaattcccgtaggaagggttgccagatttagcaaataaaaatacagaatgcccagttaaattttatttcagataacggccgggcccagtggctcacgtctgcaatcccagcactttggaaggctgaggcaggcagatggcttgagcccaggagttcaagaccagcttgggcaagcaacgtggctgaaaccccatctctactaaaaaaatacaaaaattagctgggtgtgttggcatctgcctgtagtcccagctacttaggaggctgaggtaggaggatctccttgagcccaggtggcagaggttgcagtgagccatgatggcgccactgcattccagcctgggcggcagagcgagattctgtctcagaacaaaacaaaacaaacaaaaaattctgttacagtgggtagctagtcaggtatgagcagagccggagagcgcgcctcaccccacacacaccaggagtgtccggtgaccatcaggtgatggtcaggtgttgttaactgtctctctaaagtaataattggtcacagctggtaccagggatgggcgtgctcctaacaaacagaaaacacctgaaactggtgatcagctgtttccccataagatctcaggagttgggtgagtggggagaagtaatgcaagacccaggaagtatgtcaatgtataaaagtcaaaaggtcaagctgcgtacttgatctctcaagtcactcacttgggcctccttgaagtgtgctttaccccctttcgttcctgctccaacacttaatgaactttcgctcctgctctaaaccctgcctcagtctctttctgccttatgcccctcagttgaattctttcttctgaggaggtaagaattgaggtcgctgcagtctggtaccgatacagatatgctccactggtaacatattttggtgccatgtgacttgggtaatttccactgctaccattcagataaacaatgaataatttattagtgtaagtatgtcccatgcaatatttgggacatatttacttacattaaaaaattatttgttgtttgtctgaaattcaaatttacctgggaatcctgtattttatccggcaaccacattcccagggtttttatagttgaacagctctatcctccatagcttcagctctggatctcaggtctcagcaccacccccatacatttcatctctccatcctacttaacagcactaatttggtgtcctaaggcccaaatgtacttttctcatcttcctgtcatctctcccaagacgccactgcaaaaactgataccattttccaaagctccagttttctcattatattgtcaatactctcctctttctaattatcccccatcggagtgactcacaactttcatacgataaagttcaaacactcttgtatgctacaaaagcacccagaagtaaatattcactattataattttgcataaagagaattcaggattagaaagggataattgtattcaactactccaggtaagacaagagagaaaagatgacgctacagcaaaaagtaattattaatgtgtgaattaagataatttaaatgcataccaatgttctgtaacacctgtcagttagaggcgtaatgacaagtcgaggtgagttaccaagatattcataagcatattttacattgcaattaatgatacgaactcgggcattctcattttcccaataatatcggagctgagcaagccacaggaaatctgtatcatgtgagacacctagaaaaaataaagtaaaataagacacatgatccttaaatggaaataattttaaaaagaagtattttatcttttataacagcaaatactaaaaataattcatgtttgccaacttataaaaaagattgtgttaaaaaaattctgttgagagaagaatacatatagtacaagtctttgtttccagatgctatcaacattttatctttaaaaattaaagaaaaagtcacatacccattttaatcatgtccatgaccacatctctagcatggacatcaatagtaaccaaagcccccagagtggtcctggtctgcttagacaactttcctcttaccagctctacaatctcattcagttggttctgaagttccttataatacttctttaatccctacaaaataaaaaaaaaagcaatctaattgatgtcacatcatacttaaaacatgtattttatatatttagtcttttataaaacaattctgacttcttaatctatctcaatatagaaatgagttcaagcgtggtggctcatgcctaaaatcccagcatctaggaggttaagatgggaggatcttcttttttttttttgagactgagtctctgtcgcccaggctgcggtggtgggatctcggctcactacaacctccgcctcctgggttcaagtgattctcctgccttggcctcctgagtagctgggactacaggcatgtgccagtaggtctggctaattttttgtgtttttagtagagatgaggttttaccatgttggccaggctggtctcgaaccccgacctcaagtgatccacccacctcggtctcccaaagtgctaggattacaggtgtgagccacggcaccaggcgcaaggtgggaagatcatttgaggacatgatttcaagaccagcctggcaaagcagagagacccctgtctctataaaaaaatttttaaattagccagatgtggtggtgtgtgcctgtggtcctagcaattcagaggctgaggcaacaggatagcttgagcccaggagtttgaggttatactgagctatgactacgccattgcactccagcctgggtgacagagcaagaccctgtctctaaacacacacacacacatacacacatggagaaatgaattttgtgagtgattttgtctaagcccagtaaaatattaagaacaagttctcaggccaggtgcagcggttcatgcctctaatcccagcactttgggaggctaaggtgggcggatctcctgaggtcaggtgttcaagaccagcctgaccaacatggataaaccccatctcaactaaaaatacaaaattagccgggtgtggtggcacatgcctgtaattccagctactcggaaggctgaggcaggagaatcacttgaacctgggaggcggaggttgcagtgagccgagatcatgcctttgcactccagcctaggcaacaagagcgtaactacatctcaaaaaaaaaaaaaaatgaatagttgtaattttaagattatatatagaaactgacagacgtattgtctttgcaaacaatagataagttaactaagaaacataggatggggccaggcacagtggctcatgcctctaatcctaatactttgggaggttgaagtgggaggatttcttgaggccaggagttcaagactagcctgggtagcatagcaagatctcatttctaaaaataataaaattaaattttaaaaaacctggaatgaaggatgttacttaaaagcaaacaatgctttacctccgtcccgccacttatcacttcctgtgtctcagatgtccagaacatttgagaaatacaaagtacaacttggccaggccactctcgaacccagtctcttcttgcagattctggataagcctgaacaattaaaataaatttctaactttaaaagcttgaatgagaaaaaatagctaaatgtctaacaatagagaaatgtaatatttggcacatacataggctagaatgtcatatagtcataaaaaatgttaaatgactaaaagactccctccaaattttataaattattattatgtttttgaaatatttatttataaaagaatggaaagataaacaccaacatgttaataatgggtagatttaactgttgattcttctggaagttgatttctgtgtgatttttatgttcctttgctgtggagagttgtcaagttttctatatagaatacctattacttctatcataataaaatataaaaattttagtaaacttagaaaaaactagtcaaggccagggtggtgactgacacctgtaatcccagcactttgggaggccgaggcaatggatcacctgaggtcaggagttcgagaccagcctggccaatgtggtgaaacccccatctctactaaaaataaaaaaaaaaaaatagctgggcatggtggtgggcacctgaaatcccagttactaaagaggctgaggcaggagaattgcttcaacctgggaggcagaggttgcagtgagccaagatcatgccactgcactccagcctgggcaacagagtgagactctgtctcaaaaacaacaacaacaacaacaacaaaactagtcaaatagattatgtatattgatgccaagatttaattgaaaaggagattatacaatatagttaaaaactgcactaatagcgcccttgtattatttatccatagcttttctgaaaacctatatgaccagggtatacaattttacaattatatatttgttcaattatgcataattgaaccatctatagttttgaattcaaggtatactttcattttttctaacactttgatattcaaaatgcatttaaatggatttatggagggagaggtttaatctttttaaaaatagctttttcaacagtaagtgattttagcagatccaaactataaattgaaaacaactacagaatgaattttgaagctgatgctaatgcaaattatattttcaataaaataacatcatcttagatataagaaagttaaaataggatatcagtattattataaaatgcttcttagccatatttagaaacaaatgcaaacgataagctaacctaagcttcaaagaaggatgaatggtgactgagagctattgctaggtacatagaaggtcaatttctatactgattaaagaaatactttcatggacaatggtggctctttcctatgtgttttagtttgctttgaatcataaatagtaaaaggagagaaaaagtcaagatttatttgtaggaacactgaagctgaacagaatagccaccacaagaagatgagctccatagggctctcggtcaaagaaaaagaacactcactcacatatagtgagttgctgaatataaagcttcgatgccttttaaaactattctactactttacaactgctcatttgtggtcctaaaggcagaaatatacgtgtttatcattcaagattaggttaattggattaacataagtgagatacatgtagtgccaagtgttatccttctttcaaatttatgacatatccccctttaatgtttgttcatctcatttgagtttttaagtagttgtttaagtgtaaaaagcagtaagtgaactaggtcatgcatttaccactcgtgtctgaagagaactgtcctacagatccacatgtgctaatgtgcaggattgtttgcctatgaaacatatccactagcctagctcatagcatttcaattttaatatatctaaaattgagctcttgatattcccctaagcctccacaaatctgcttctcctccaggaatcacccagagtaaatgccacccatatgctcaaattagaagcctaaaagtgatttttgagaactccccctccttacccttgtactctacaacaaattcatcatcaagacctgttgaaattaactacaaaatttatttctgatattctacttttctccctatcttctgccatttgcctagtgacagaccacatcttttttcctttatttttggtttttatttttattttttgaaactgaatctctggcaaaccagcccaaatcatctttcatctgaactaatctgagtctcctaatttgtcttcctgttttcacacctccactaatctattatttataccatagccatagtggtataaaaatataaatcagactatgtcccttccctgattaaaatatttagatggtgttccattgcatttaaaataaaatgcaaactcctaactgccttcctttccaacctcatgtcactttactctccactttgcttactctactccagacatatttgtcttctttcaggatctcccaaatccccagttctctctgattccaggggctttacgtaggatacctagatgctctctcacttgctctttacctggcttattcctacctgtcctttgtgtctcagtttcaacatcaccttctccaatagcctatcactggaccttcccccattctaaattatatacctcttatttttctctctcataataccttttctcttttataacaatcatatactattatcaattcatagcaatattgttatattaataatgttagaaacaaagaagtaaagaaaataaatgatttaaaatagtaagaactttaagtgttaatttactggtttccaaaacctcttaaacaaagcatttgcagaatatagggtatatatcaaatcctaggaaacacaccagcctggctgcagcgatcacatcgtgaacactccggagcattaggtcttccacttgaatgagccacttttccacagcaccccgcgctgcagacgtggaaatgagtgcaatcagctccactcgctcgccctcagagctatacatggctttaatgtccaaattgggaaggaactctaatttagcaatgccctcaaagcatttttttaaatgtggctgaactctaagtggatctttggtctctgataaaatctctaacatttcatcattagataagaagaaaaaactagggaaaaacatgcaaatacaaaagttttagttataattcatcacacataagaaaatgtttttaattacagcacaattgattatttatcataccgagggaagaaaagacgtttcttttcaagatatgcgttaagacctttcataattttctccaaaagttcattgcagttctgtagtttttccaataaacctgttaaagaagtggcagcaagaacctaaacgagacacatgcattcaagtcagcacttttatgccagatataattatgacttaaatatcaatctatactatatgttaaaatcttttaatgttaaaaggtttatgaaaaaatgtcaaaggtttataaaatttgcaatgaaattttttgtagtgtaaaaactattaaaattcaataagttacaaatacttatccaaggacactagttaaaatgacaagttatgattgtcgtgcatattgtcatttctcctatattatttcgaatgatgtgagaaaagtctgtttggctggtgctcgatttaattcttacttttactactgtcaaccataaatgtaacaatttacagcaaggagttggcaaactacatcctgcagaccaaatccagtctgttgtcagtttttgtataagttgtaagctaaaaattattttcacacttttagaagttaaaaaaatcaaaagaagaatattttgtgacatatgaaaatatcagtgtccataaaattttattgtagcacagacacactcattcatttacagattatctctggctgctttctcactgcaacgacaacagaattgagtagctgcaagaaagatctgtcctgcaaagcctaaaatatttactatttggaccttagcagaaaaaaattgctgacctctgatctacaagaaatcatgtttcacaaagattctgaagtcaacaggtaaagcaaaatccttaaaactcataaatttcagtgtactactgactctcagtaagtccagcacagctagtttttcattcagcatgggaataaattgttatttcttaaattgaataccagatgaaaaagtggatgcatatctatggactatgttcactgtgtgtatgaaaaatatatagtctgtctttcaacatttactgggagagacataggaactgagtgagaccaatggagagaacagcagattcttccccatcactccgagtacacagagtcactagtagaatgtcaggtgagtcacctacactattcattctctctccctctctcttgttctcactctctcctctctccatttgatttgatttatctatttattttatgaggaggagagcagtgagtgtttatagtagaaggcatgtgaatcagatgtacatttgaagcagctccaccaggtatactaaagagttacaagcaatgtatcttatgaattgaaaagtaaacttattttaatacttttatgctttcttatatttttctgaactttccagtttgtatacaatgagcaagtttaatttttataatcagaaaaaaagtcacatgttttacttaatttccaaaaacaaaggttcacctactgtgagagagaaaacaaacacttcacctttggatctttagcacaaaacttcatgatatctctccagtgtctgtctactgtctgaaattgacgcccttcttctggcatctgttgcatgatatcctcagaacaaaagatgggctctaagtacagccattgagcttgtacttttaaccattcatcaattgtttcttgtattcgaatcaagcggtcctcccaggccttaatgaaaagtatactgcactaaattctagttattaaagaaaggctataaattatagcaaggaaaatacattttaaatttactattatttttaaataagtgcaaacatctcacagcttaaggttacttatgtatgtctcacaaaggcttagaaaaattctaagaggtctgaagttttcctaaatcactggaactcacaattggaaatgactgtaacattattttgaccagtttcctaatttctcggtgagccatctggagtcccaaaaccatccaagaatatatccttctctaccagcagtggttatcaaccacaggcaattttgcctcccaccccagggaacatttgacaatgtctgtagacatttttggttgtcacaactgatgggggaagatgctactaatgtctagtgggtagaggccagagatgcagttaaacaacctataatgtagaagacagcccccatcacagagaattatagagcccaaaatatcaacagtgacaggttgagaaatcctgctctactctacatcaacacaatttggagaaaaatgaactgaaatgaaaaataaaatgaaataagcctccttattctcaagatcccctagaaatgacaagatatttcattagctgaagaccattaatataatatctctctttggttcttaaatatgtgcctaaggtctatgtgtcaagagattgtctcatatcttcgatttttaaaaaatctctacgacagcttttaaatttgtcttctaaattccccttgttagacaagtaaatttctacaaaaaagtaatatcttatcaggaaaggctaggttagcctgcttcttgggataatgtccagccttatgtcctcttggaagaacattactctgttttctccgaataatgacagccaaaatcttctataaaacaataaataaatcttctatttatgctcatattaaaaccaaactgccttggtttgaaccccagctctgtcacttattagctagatgaacttagaaaaattgcctatcctcctatatgttggtttccttgtccatgaatacagataataacagtgcctactttgaaggtctgctgcagggatcaagtgggttaataagtgcaaagttccagagcagcatctgaaacatagtttcaaatcaattgatatcagggtaaaaaatccagttgtctttccccaatttatatagtccccagttaggatagttttcatatccaataagatatgaaataatcttggagcctcaaataccatttgtttttctcaagtgaacaataattcattaattactctaaaagatccttatgctagctgtttacaactataattaaagtatggttactacaagttacaagaatgcaacaaaaaacagggtctaggttttctaaagttagaataagtaataccacctgttttcctctcaagtctatcactgccattggagaagattttaataagacatttttcttttaaaaatcatttatgtctcagatgtatatatttctatattaaattttgaatatcattttgtattttatgaaataaaatatcaaagttataggtctatgatttgaataaacacttaaaaaaccatccaataagctacttattaccatgagagcgtatatgtaataggattgcaatccgtataaatgaccaagagctgattatcacatttaacataccttgatctcatgttcaaatggtttgatgaaaggtgagcctctcattgtctgagtttttataatttgatcatcaaggatggcctgaatctcatccaccgaagaaagaatacagactccagtgtcacgatacagacttatatgaaaagcaatatcttcccaagttcctatcattgtattcatggctttctctaatgaaaattcctaaaacggaggaatgaagaaagaacgggatggtgaagaaaggatcttatttactatattgactttccctagtgaattcagtaagaatttgatgtattacattatcatttccttaagataatctgtgagtacagtataactttttaagttagaaggtttttcaacaatttaaaaattcctaagaagaacgattatgtagttttaaagaattcacttgctatgaaaactactgctgtcaatattaaaaatggacaagagaataaaatacctgtaggactttctctgaagtggcctttctatggcagcccatagtctgaagatgttttctgtgtacttcaagaacccattctttagggccatacttaccctgctagaacacatacatatcacatgccacatatacaacagtactcttaatggaaaaattatgtaccaacactagcacatcatccaacgacattggaatgtggcagaattaagaggagatcaaaggagtcatttctcgtctggattcaggacaagtaagtacacactttgggggggaggaaagagtgttttgttttgttttgttttgtttttgagacagagtttcgctcttgtcacccaggctggagtgcagaggtgtgatctcagctcactgcaacctccacctcccgggttcaagcaattctcctgcctcagcctcctgagtagctgggattacaggcacccactgacatgcccagctaatttttgtatttttagtagggatggggtctcaccatgttggccaggctggtctcaaactcctgacctcaggtgatccacatgtctcggcctcccacagtgctaggattacagatgtgagctaccgcacccagccggagagtggtcttctatcactctcccccatcacctcccgcgctatccagtactatacacattcaaccccaacaaaaactatgattacttgattaacgaagtcatcacataaagtatttcagttgatctttatgtttaccttgcttgcacctgcacttatcacttcaaattgttccaagtatggggtaaggtttaattttaaaacttttctcagtgtagttccagagtctggagtcaagtcatagcctacaatttctgatatctgtttccagtgacgagctctcattcctggattgcacagaatggagacagtaggaatatattcctaatggcaaaaatataaacaattatgagtcactcatttgacttccacacacatagattccatagatgaagccttgatgatataagggttacatttcttcaatttatttaatatatttctatcagtacaatcaaaacctcaattagatttggaaggagagagatactaagaaaatgaacctaaagttccctgcaaaaataagcatataaaaatagccaggaaaattataagagtaaacaagaagaatgaagggccaggcacaatggttcatgcctgtaatcccagcactttgggaggttggggtgggaggattgcttgagcccaggaatttgaggttacagtgagctaagattgcaatactgcactccggcctgggtgacagagtgaggacttgtctctatttagaaaaaaaaaaaagtattattttagaaattcaaattcattatatatactatttgcagaaatatataatatatagttataaacacacatacatagcatgaatggggaaaatatgtgtgcccaaatcccaaaatgtaacaatgttttatctctgctgagtgacgcctgccttggcctcccaaagtgctgggattacaggtataagccaccatgcctggccccctattttatttttatatgagtcatgttttaactttgtataagtaataatttaatattgtaaatttttttaattggaggaccataaactagcacactttttgttttgcttagttaaggacttcgttttaaccttccattggttatcaccatcatgtttttgcttatcatcacatattccctagaattcatcagaacataatataacaggcactcagtaagtattttttaaataagtgaagttttaacatctaaaaagtagaaaggacatactctttatttatttatttagacagaatcttgctccgtcccccaggctggagtgcagtgatgcgatctcggctcactgcaacctccgccttctggattcaagagattctcctgcctcagcctcccaagtaactgggattacagactcctgagtagcctcatgagtagctgggtcacacaaaagtgaaaaaactccaagcagatgagcagacagtaagagaatcggacttccacatctgcattgcccctccctctattctgtctggtaccaagagggcagaaaatttccccccaactcactgtttctaccctgataagagcaaggtcaaagtggacaaccagctaccccaccaccctgggttccctagcaggagacctgccctgccttaacccacaggaagcaacgccagtgcctgaagggataaataattcctgtggacaagcagagacaaagggaggaagtggcactaccatccccagccctggaaatgttactctgtaagccacagaagatgccaaatcagagtggctattctgcagcaccacactgtaggaggtttgtcccacaggtctcctgggcacaaactcctagccagcttcccacattgccagaatataccctgtgggaccgtccgcattcattaagggcagcgctcccatcaggtactagacccaagccaaacctgggcttaaggtgccacttggagctgaaaaggaagcagtgacctagcggtaaagaaactctaagcaaatatatccaatataaaccaaaacaagccagacaaaaaacactggaataaataatacttcaatgcaaagacagatgtacatccagcaaaaacaacagcaaacagggaaccatgatctccacaaacagaagcagcaaagaaccagtaactgactctaaccagacagggatatgtgagctctctgaccaacaataaacaactaaattcctaactagactgatcaacaaaaaggagagaaaattaaaataatcaatatttagaattaaaaaggagttagcactatagattctacagacatttaaaagataataaagaaatgttattagcaactttatggcgacaaaatcaatgacttagaagaaatggacaaattccttaaaactacaatctaccaaaattaaacacaaaatctgaatagctcctatatctattaaagaaattctcttttccgtcccctagagggggaattggcacaggacttgcttcagccaatgtaatatgggtggatatgaagtatgtcacagctgagtggaagatctaaactcaggtacatggtttagctcagcccttgctctttctctctaacgcgagattggcccacattagctcaggacatagcctgtgtcctggaagttagaaaactcaggagcagaacaagactgcaactgggagcagagacttagctaacccgtggtcctcatggaatatgaagaagaaataaataagtacttgaaaaatatatatatagagagagtctgttttaaaaacctttcctacaaacaaaacgtcaggctaaatggtttcatgagtgaatgtttctctaaaataagaaagaaataatatcaatttataaaaaaactctttcagaaatagagaaaataaaacttcccaatttgttttataaggccaacataaccctgataccaaaatctgacaaagacattacaagaaaactaagaccaagatccttcctgaacataacctcaaatatcctgaatgaaatatgaacaaataacaaactataagagtattagaaaaaaatattttgacatggggaaggcattttaaactacagttcagaacccaagagccataaaggaaaagaataaaaataattacataaaattaaaagggttctgcaaggcaaaagctatcataagcaaggtcaaaaagcaaataataaatattcacatcacagacaaagcctaatctcctatatatacaagaaaagaaatcaataagaaaaaggtcaataattcaacagaaaaataggcataggtaagttaaaacagtttacaggaaaagaaatataaaacactcttaaatatatgaaatatatgaaaatatgcttaaaattttacttgcagtaagagaaatgaaaattctcctagtagagtagcaaaaacctaaagtttgatgatattttgttatgaaggttgatgagagtatatattggtataacttctatggagggtaattcaactgtagattttaacctggcatttactcttccacaatttaccctgcagtcacaccttcaaacacatgcaattcacacacacacacacacacacacaccagattagtcatacattatataggtgtgaaaaaaatgaagaagctccctatatacaagaagaaaaggtctccaagataaattaagcaaaacaaagaaagaaaataatatacattgtatgctacacttcatgtaaaaagatagaaggataagaatatatactcacattgttatatatgtaataaaactctggaactatacacaagaaggtaataacattgatcacctgagttatacaggtgagaaccatgaggagacttttcagatgtctctttttatattttttagaccacgcaaatgtattcaacattgaaaataatttttaagttaaaaaaatcagacggccatggaatctctgagatgaatagacatagacaggaacaatgcttgaatccaatcacagagtttgcactctgggcatgctgacagtggaaatttaaggatgtattactgactgtcaaaaaaactgttcttattctctctttataaatgagaggaccgaggcacaagtggctaaatatcttgctcaaggtatgccactgccaagtggagaactgtgctataactaaacagtgtggttccaaatccttcccagtaaactgttaccctgtgttgctgcacttagtataggctaagtggtctgacctagtaaacttatgcccttatttttttttgagacagggtcttactctgttgtgcccaggagtgcggcagtataatcatagctcactgcaacctcaaactcctcggcttaagtgatcctcccacctcagcctcccgagtagctgggacttcaggtgtagctgaattttttttaccgtgcctggctaattttttattttttgtagaggtagggtctcactatgtcacccaggctggtcttgaacttctggcctcgaatgatcctcctgccttggcctcccaaagcactgggattacaggttacaggtgtcatccgctatacccagcctgcttccaaacctttctatttctcttcattagcacttgatgatgagaatagctctatcaaggtttttttgagtaattttggagtctcgctctattgcccagactgggcatgcagaggcatgatctcggctcactgcaacctctgcctcccgggttcaaatgattctcctccctcagcctcccaagtagctgggattacaggtatgcaccaccatgctcaactaattttttgtatttttagtagagaggattcactatattggccaggctggtctcgaactcctgacctcagatcaggtgatctgcctgcctcagcctcccaaagtgctggaattacaggcataagacaccatgcctggccttgagtaattcttaagattcagaatccataggtcaacaatttctctggactcaaaagccttcatctaagcattttgcaaatgctaaaattttttaatgtattcatctagaaaaagtagttataacctcacttcaaagtttggattatgctgaattaatggtaggctattttattatgtttgtttagttttattatagtaaattataaacaatggtatactcttcctatgttttccataggaaaatgacttagtgtcattttcaggaagtatgcaatctgccctaataggtctgagcaatcttctactgcctttcttgggccagaggaattctttgccccagttttgccagatctggctttatatgtgtattctccttgatctgccccaaatatggctgccattcaccacctaaccagcctttcctacactccacagtggtgcttcatgatgaggagctaaagttgtgggaatgagacaccaaaacatcaaagatgcaaacagatgtaattcaaaagatgagaggaataaaatgccctctcttgcccttaccacttcctcccaaaaccaatcactcagctctgtcacaagtacccatgcctagaacagaggtgggagtgaatacattaaaaaattttagcatttgcaaaatgcttagatgaaggcttttgagtccagagcttgaccaagaggctgaggcatagcagaggaatttaaaatcttatttttttctgattgtttctcctcagtaccttcatttggccatactcctttgattacaagtgacagagacccaattcattagccaaaggggaagaaatagtgtcttattcttgagcctaggagtctgaggctgcagtgagctatgactatgccactgcacagtcaacagagtgagaccctatctaaaaagtaataataggccaggtgtggtggctcatgcctgtaatcccagcactttgggaggccaaggtggacagactgcttgagcacaggagtttgagaccagcctgggcaacacagcaaaaccccatctcttcaaaaaattagccaggcatggtggtacacacctgtagcaccagctactcaggaggctgaggtgggaggatcgcttgagcccaggaggtggcagtggcagtgagtcaccactacactccagcctgggaaatagagcaagaccctgtctcaaaaattattaataataataaataataaacatgtaaaaccagaagataggctttataatttatatattaggtaacagaaaagttgagaagatagctataatattaaaatgttattatatatatttataccttaaaagcttttatctgttccatgactgtactgcacatagtaatagtagcattgtcttttggttcttcttcaattttctcttcttccaaagaccgttttcttgctgcctttcttttttcttgtaattctttctttagcttcgtttggaaaaattttagtgtcttaaaaatttctcgggaaaactcttccacatcagcctccatgctttccccattgaggtccaaaaaccctccatccatccacctgaatggaaagaaaaaatattattaaactcagacttttgaagtttgaaggggccttagagatcctttaggctagaccccttgttttttaagagagaaaaatgagggcaagagctgttaacagtttttctcaggcacacaggtagagctgatggtagaaaagacagaactaaaataatcattttgactatgctgcatgtgctaaaatatgtatcagattataaatggatgattaacagtacccacataaaatgcaggttcacattagagaaatgcaaatcaaaccacaatgagagaccatctcccatcagccagaatggctattattaaaaagtaaaacaaaaaaacaaaaaacagatgctgtggagaaaagggaatgcttatacactgttgcactattgatgggactgtaaattagctgagccactgtggagagtagtttggagatttttcaaagaatttaaaacagaactaccatttgacccagcaatcccattactgggtatatacccaaaggaaaataatcattctgccaaaaagacacatgtactcgtctgttcatcacagcactattcacaatagcaaagacatggagtcaacctaggtgcccatcaacagtggattgaataaaaaaaatttggtacatatacaccatggaatacaatgcaaccttaaaaaaggatgaaatcatgccctttgcagcaacatggatgcagctgaaggccattatcctaagcaaattgatggaggaacagaaaaccaaatacctcatgttctcactttgaagtgggagctaagccctgggtatacatgaacatagagatgggaacaacagacactgggaactactagaggtgggagagagggaggggagcaagggctgagaaactacctattaggtgctgtgctcactacctgggagataggatcatttgtaccccaaatatcagtgtcatgcaatatacccacgaaacaaacctgcacatgttaccgaatctaaaataaaagttgaaattataaaacaaaaataaaaataaaatgcaatttgactccatacttctaattttgggggtaaacattagtgaaattaatctattgtattaaaaagggaattgactctcagaaaccaaaatgacaactcatatattatatatatatatttttcatgtcagaagggtaatgtgccgacattgtaacaacgtttgagggaggcatatctctcacacatgagcatgaaaatccaatcattatgctcataaaccagaaaaggatctcagatattgtattagtaaggttagtgggaccttagcagcactggatgtttctcctacatggtacctggttctctttcaaatggacatataaatcctacttttaaacacttaaccaaaaaaaaaatcaatttatattttacaaattattttctatcatttgcttgatttttattacattaccagcaattaccgtttttctgatcgctgccacttcaaaacaaaattaaaaaacttctgatagggctcaatgttaacttttaatttatccagttcaggatattttgtcaattcccacttgaaaagttcctcttctttattaataaactgcactgcttcttcagattcctgaatacgtttttgtagttgtcttacatctgtcacatactgaaagtaaataagttttttgtcttaaaaaaaattcaagtaatgttataaaaataaaatcctatgatactgtgtacaatatgtccttgtatttatacaacaagtttatttttaggctggagtgcagtggcgtgatctgggctcactgcaacctctgccccgctggttcaagtgatcctcccacctcagcctaccaagtagctgggactacagatgcggaccaccacacccacctaatttttgtatttttagtagagacggggttttgccatgttggctaggctggtctcgaactcctgacctcaggtgatctgcccacctcaaactcccaaagtgctaggattacaggagtgagccactgcgcctggcctatacagcaactttaaatattaacttcacaacataactatgattgagagcaaaaggtacaattatgtctactctacaaatagagaactgagtcacaagaaagataacatagttccagttttgggcctaagagtcaggtctttgtttgccagcctgggcaacatggcaaaaccccatctctacaagaaaatacaaaaaattagccgggcatggtggcacatgcctgttagtcccagctactcaggaggctgagactacatataaagtatttaaatacatatttatgtattttactatatattatagtattagataaatatatatgtatatatgtaatatatagaaaaatatagagtaaacataaaaaaatagtaaacatatttttctatacttttaaatttatgttaacatgtcctatatgactctatgggctggccatagctattgtctcatatatttatcagacctgttgcatgcgctccagctctgcaaattctgtaaactcctccatgcggcgtgattctttttctatttccaaaataagtttctctctcttggccattagttcattttcttttttatgtttagcattctcaattagctttttaaaagacaatttgatcatgttagttaatctgtaacaaagaattatcaagtcagaaatccaaatactgtgtataataataaaaaccatcagagaagtaaaaatgagtacaaaaataaaacaatgcctataattactaatataaaaatgcaaagaataaaccacacagaaaaacattcctagatctccaaagtgactttaacaacttgtattcattaattaaatgctttatttaacagattctaggataataataaaattaccatttattgagcatgtgccatgtatcaagaactattaaatatcttacctatattattactggtattattattctcatttcagagaaaagaaattgaatcttatggaagtcacgttcatgttcacaaaatcataaaaatcaaaatctggattagaatcttggtttatctgattgaaggccatgctttttattacaataccatcttacctcccaattcaggttaaactgatttacattaggactttttcaatatctgaaatatattcagtctgatataaaattgtaaattttatcactgtgatattgaactatttaatttctctgagtctcatatttctcatctataaaatggaagaaatgggagcatgtgggatttttatgagagttaaataattgaataaatggaaagcactttctcagttaagtgtttctattattaatttatataatagttctgactttctaaatgtcagccccactacttaccagaccttgtgagttaagcctaacagcttgtcttaagcctagagggccataagtgtggccagtctcaaactcatattgacacacaaaattacttttaaagttagatggccaggagatatgaaaattaaatgtgaatgatgtgcttgaaatgtcagattacaaaaatacatactgaaaaatatatttacctcatcattttcatcaaagatgggattaattttcctaggccacatgaggacagttgcatttaaagctaagtcttcttgaggaaataggaaaacatctaaaaagtaactcatttggcgtttagattcctacaaaagaaactctggatataatatgtcatatagaaaatctacatcattatgaaaaagagaagaaccaacaacaatctctaataccctttcagatttcagtttgactcagattattaactgatattttatatatcacccaaaccagatgggtatttcaatagctgcagtattatttatcttgcttcatgccacataattgtatacttttatgctagaaataaggcttttaaaaagttttcacttacagttgatttagcataaaggaacttttggtcctcccttgtttatgactgaaaaatataattaaatcttcagaagtcctttaattttgattttaaaggattttaaattattttattcttataaatattttatttttgaatctttgatgacaaagattttagtatcttttcttttgttttgtatcttcactgacatcaccacctttttggcctacttcacatgttactgtatgcaatagtctagaatattgcggtatgtaatagttcagaaagagttgaaggtgagttggccaggtacggtagctcacacctgtaatcccaacactttgggaagctgaggcgggtggatcacctgaggtcaggagttagagaccagcctggccaacgtgacgaacccccatctctactaaaaatacaaaaattagctgggcttggtgacgcacgtctgtagtcccagctacttggaggctgaggcaggagaattgcttgaacccaggaggtggaggttgcagtgggccgagattgtgccactgcactccagcctgggcgacagagtgagactccgtctcaaaaaaaaaaaaagttggaggtgagttgcaaagaaaaaaaactcttaaaacaatagattatctgagtagataggttgaatatttttaccctctatatctttcattgctctataagctgtactgtagtactaatttttaagaattgaaatacagattcaaaggcaaatttgaggtttttgattttatattatacatatgtatacatatatatacatacatctatatatataatatagatataaaattatgtattgaaaataacattaaatatgtattttgtacattctatatattatgtatatacaatgcacatagaaataaaactttaaaataaaaagcaatccgtgtaattcgttatattaatagattaaagagaaaaagcatatgatcaacacagtagatgcaaaaaagcatgtagtgaaattcaaagtccactcatactaatttttcttttcaaaaaacgtagtagcacatcagcaatagaagggaattcactaatctggcaaaagtacctgtataaaacctacaacaaatgtcatacttaatagtgaaatcttgaaagctttccccttaaggttgggataaagatgggaaatctgccatccactgctattcaacattgtactagagtcccagacagtccattgttgcaaagaaagtaaagttttgcaaatgtgtaacatttgatcaggaaaaacagaactgtcatcatttgcaagttatataatggtatatgaagacattccaaaataatcttcagataaactattaaaattaagaagagaaatttaaaatatataaaaatattaaagttaaaaatttttttttgagacagagtttcactcttgttgcccaggctggagtgcaatggtgcaatttcggctcactgcaacctccgcctcccaggttcaagcgattctcttgcctcagcctcccaagtagctgggattacaggcatgtgccaccacgcccagctaactttttgtgtttagcagagacgggatttcaccatgttggtcaggctggtctcaaactcctgacatcaggtgatccacccacgtcggcctcccacagtgctgggattttaggcatgagccactgtgcagggcctaaagttcaaatttttaaatagaaaattttaaaagaaaaattgagcaatgggtattaaattagtatataaaaataaattttggtcgagcatggtagctcacgcctgtaatcccaacactttgggaggccaagtcgggcagatcatgaggtcaagagatggagaccatcctggccaacatggtgaaaccccgtctctactaaaaatacaaaaattagctgggtgtggtggtgctagctgggcgtggtggcgcgtgcctgtagtcccaggtactcaggaggctgagacaggagaatctcttgaacccgggaggcagaggttgcagtgagctgggatcgcgccattgcactccagcctagcgacagagcgagactctttctcaaaaaaaaaaaggccaatggaacagaacaagctgcctcaaaacagatctacacatatacggacacagtggggatggtctcttcaataaatatgtatttgctcatctatatgggaaaatatttaaattggacctcacattatttacagaaatacattttcaggattgaaacctaaatctcaaaagcaaaactaaacagcttctagaaaagggtggaagaaaaatgtctttgaaccaaggtaggagaggatttcttaaataaaacacagaaagcactaggtataaaataaaatactgctccatttaactgcactaaaattaaggcaacatggcaaggccttgtctccaacaggaagaaagaaagagagaaagagagagacaaagaaagaaagaaagattgctccatttattataaaataaaagactgctccatttaactgcattaaaattaaggacttctgttcatcaaaaacaccattaaaaagttaaattacagagtgaataaaaagatacctaataatatattaaaaattactacattgaactgtatacttaaaaatggttaaaatggtaaattttgtgttatgttcattttaccacttttttaactgctacaaatcaataaggaaaaggtacataacccaaaaaaataaatgagcaaaatgtatgtactatcatttcacaaaagaggcactccaaatagccaataagcatatgaaaagtgttcaaattcatttctttttaggaaaatgcaaattgaaaataccataactttcacccaatagactggcaaaatttaatccatctcacaattgcaagtaagaatgttaaaataatagacactttgtgcactgctaataggagtctaaaactggaactacttagaaaagaattttgccttaattagtaaaggtgaataaaagcatatcttataacacctggaagaaatgaatgaatgtgtgcactgggatacatgtgttaaaatgttcacagaagcattgccagtaatatcaaaagcagaaacaaccaaatatccagaacagtaaaatttttaaaataaattattgtatacaatgtggaatggatacaatatggagtggaatactagactgcaatgaaaatcagctaaagtttaggaacaatgacattactaacataacattgatgagaggcaaaagaatataaatggtatgattccctttatataaagaccaaaatcagaagaaattaactatattgattagaaatgcaagtttaagttgtataactataaaaaaaaacaaggaagtaatcactataaaaatcagaataggccaggcgcagtggctcatgcctgtaatcctagcactttgggaggctgagacgggcagatcataaagtcaggagttcgagaccagcctggccaatatggtgaagccccgtctctactaaaaatacaaaaattagccaggcgtggtggcgggtgcctgtactcccagctactcaggaggctgaggcaggagaatcacttgaacccaggaggcggaggttgcagtgagccaaaacctcaccactgcactccagcctgggtgacagagcgagactctgtctcaaaaaaataaaaaataaaaaaaatcagaatagcactaacatccagaagacaagggattatgatgggcttctagagcgttggcaaggttctatttattttcctaggtggtaattactggctgtttactttagaacattccaaattgtacaattcatgttttacgtaattttggtatatgtgttgtttaacatttttaaaagtttcttaaacaaagaataagagtaaaatataggtaaataggtacatcatcttgtgctggaaaaggtaaaaacatactattaaatgcagaaactataaaagaaaaaatatttttaaaaatctatattgtttaaggacatacacaaaattagtgaaactaaagaaattcaaagctaagggggtggagccaagatggccaaatgggaacagctccagtctacagctcccagtgtgagcgacgcagaagatgggtgatttctgcatttccaactgaggtaccaggttcatctcaccggggagtgtcggaaagtaggtgcaggtcagtgggtgcagcgcactgagcatgagccaaagcagggtgaggcatcgcctcacctggggagtgcaaggggtcagagaattccctttcccagtcaaagaaaggggtaacagacggcacctggaaaatcaggtcactcgcaccctaatagtgcgcttttccaacgggtttagcaaacggcacaccaggagattatatcctgtgcatggctcagagggtcctacacccacggagcctcactcattgctagcacagcagtctgatatcaaactgcaaggcagcagagaggctgggggaggggcgcccgccattgccgaggcttgactaggtaaacgaagtggccgggaagctcgaactgggtggagtgcacggcagctcaaggaggcctgcctgcctctgtagactccacctccaggggcagggcacagacaaacaaaaggcagcagaatcctctgcagacttaaatgtccctgtctgacaactttgaagagaatagtggttctcccagcatgcagctggagatctgagaatggacagactgcctcctcaagtgggtccctgacccccgagtagcctaactgggaggcaccccccagtaggggcagactgacacctcacacggccgggtactcttctgagacaaaacttccagaggaacgatcaggcagcaacacttgctgttcaccaatatccgctgttctgcagcaaccgctgctgatacccaggcaaacagggtctggagtggacctccagcaaactccaacagacctgcagctgagggtcctgactgttagaaggaaaactaacaaacagaaaggacatctacaccaaaaccccatctgtacgtcaccatcatcaaagaccaaaggtagataaaaccacaaagatggggaaaaaacagagcagaaaaactgtaaactctaaaaatcagagcgcctctccttctccaaaggaatgcagctcctcaccagcaatggaacaaagctggacggagaatgactttgacgagttgagagaagaaggcttcagatgatcaaactactttgagctaaaggaggaagttcgaacccatggcaaagaagttaaagaccttgaaaaaaaattagacgaatggctaactagaataaccaatgcagagaagtccttaaaggacctgatggagctgaaaaccaaggcacaagaactacgtgacgaatccacaagcctcagtagccgattcgatcaactggaagaaagggtatcagtgatggaagatcaaatgaatgaaatgaagctagaagagaagtttagagaaaaaagaataaaaagaaataaacaaagtctccaagaaatatgggactatgtgaaaagaccatatctacgtctgattggtgtacctgaaagtgacggggagaatggaaccaagttggaaaacactctgcaggatattatccaggagaacttccccaacctagcaaggcaggccaacattcaaattcaggaaatacacagaattccaccaagatactcctcgagaagagcaactccaagaaacgtaattgtcagattcaccaaagttgaaatgaaggaaaaaatgttaagggcagccagagagaaaggttgggttaccaacaaagggaagcccatcagactaacagctgagctcttggcagaaactctataagccagaagagagtgggggccaatattcaacattcttacagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaatcagtaccagccactgcaaaaacgtgccaaattgtaaagaccatcgaggctaggaagaaactgcatcaagtaacgagcaaaataaccagctaacatcttaatgacaggaacaaattcacacataacaatattaaccttaaatataaatgggctaaatgctccaattaaaagacacagactggcaaattggatagagtcaagacccatagtgtgctgtattcaggaaacccatctcacgtgcagagacacactaggctcaaaataaagggatggaggatgatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcacaaagcaagtccttagagacctagaaagagacctagactcccacacaataataatgggagactttaaaaccccactgtcaacattagacagatcaatgagacagaaagttaacaaggatatccagaaattgaactcaactctgcaccaagcggacctaataggcatctacagaactctccaccccaaatcaacagaatatacattcttctcagcaccacacagcacttattccaaaattgaccacacggttggaagtaaagcactcctcagcaaatgtaaaagaacagaaattataacaaactatctctcagaccacagtgcaatcaaactagaactcaggattaagaaactcactcaaaaccactcaactacatggaaactgaaaaacctgctcctgcatgactactggtacataacgaaatgaaggcagaaataaagatgttctttgaaaccaacgagaacaaagacacaacataccagaatctctgggatacagtcaaagcagtgtgtagagggaaatttatagcactaaatgcccacaagagaaagcaggaaaggtccaaaattgacaccctaacatcacaattaaaagaactagagaagcaagagcaaacacattcaaaagctagcagaaggcaagaaacaactaagatcagagcagaactgaaggaaatagagacataaaaaacccttcaaaaaatcaatgaatccaggagctggttttttgaaaagatcaacaaaattgatagaccgctagcaagactaataaagaagaaaagagagaagaatcaaatagatgcaataaaaaatgataaaggggatgtcaccaccgatcccacagaaatacagactaccatcagagaatactataaacacctctacgcaaataaactagaaaatctagaagaaatggataaattcctcgacacatacaccctcccaagaccaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagccgggaagagacacaacaaaagaagaattttagaccaatatccctgatgaacgtcgatgcaaaaatcctcactaaaatactggcaaactgaatccagcagcacatcaaaaagcttatccaccatgatcaagtgggtttcatccctaggatgcaaggctggttcaacatacgcaaatcaataaatgtcatccagcatataaacagaaccaaagacaaaaaccatatgattatctcaatagatgcggaaaaggcctttgacaaaattcaacagtgcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctttcaccactcctattcaacaaagtgttagaagttctggccagggcaatcaggcaggagaaggaaataaagggtattcagttaggaaaagaggaagtcaaattgtccctgtttgcagatgacatgattgtatatctagaaaaccccattgtctcagcccaaaatctccttaagctgataggtaacttcagcaaagtctcagaatacaaaatcaatgtgcaaaaatcacaagcattcttatacaccaataacagacaaacagagagccaaatcacgagtgaactcccattcacaattgcttcaaagagaataaaacacctaggaatccaacttacaagggacatgaaggacctcttcaaggagaactacaaaccactgctcaacaaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttgaagttcatatggaaccaaaaaagagcctgcattgccaagtcaattctaagccaaaagaacaaagctggaggcatcacgctacctgacttcaaactgtactacaaggctacagtaaccaaaacagcatggtactggtaccaaaacagagatatagaccaatggaacagaacagaggcctcagaaataatgccgcatatctacaaccatctgatctttgacaaacctgagaaaaacaagcaatggggaaaggattccctatttaataaatggtgctgggaaaactggctagccatatgtagcaagctgaaactggatcccttccttacacctcatacaaaaactaattcaagatggattaaagacttaaatgttagacctaaaaccataaaaaccctagaagaaaacctaggcaataccattcaggacataggcatgggcaaggacttcaagcctaaaacaccaaaagcaatggcaacaaaagccaaaattgacaaatgggatctaattaaactaaagagcttctgcacagcaaaagaaactaccatcagagtgaacaggcaacctacagaatggcagaaaatttttgcaatctacccatctgacaaagggctaatatccagaatctacaatgaactcaaacaaatttacaagaaaaaaacaaacaaccccatcaaaaagtgggcaaaggacatgaacagacacttctcaaaagaagacatttttgcagccaaaagacacatgaaaaaatgctcatcatcactggccatcaaagaaatgcaaatcaaaaccacaatgagataccatctcacaccagttagaatggcgatcattaaaaagtcaggaaacaacaggtgctggagaggatgtggagaaataggagcacttttacactgttggtgggactgtaaactagttcaaccattgtggaattcagtgtggcgattcctcagggatctagaactagaaataccatttgacccagccatcccattactgggtatatacccaaaggattataaatcatgttgctataaagacacatgcacacgtatgtttattgcagcactattcacaacagcaaagacttggaaccaacccaaatgtccaacaatgatagactggattaagaaaatgtggcacatatacaccatggaatactatgcagccataaaaaaggatgagttaatgtcctttgtagggacatggatgcagctggaaaccatcattctcagcaaactattgcaaggacaaaaaactaaacaccgcatgttctcactcataggtgggaattgaacaatgagaacacatggacacaggaaggggaacatcacacaccggggactgttgtggggtggggggaggggggagggatagcattaggagatatacctatgttaaatgacgagttaatgggtgcagcacaccaacatgacacatgtatacatatgtaactaacttgcacgttgtgcacatgtaccctaaaacttaaagtataataataaaaaaacaaagctgtgcaacattgaaaaaaaaaaaaaaaagaaattccaagctaaaattactgtaaaaatcaactggaaacctctagaagaggacaggggagaaggagaggcatggcgatcagaaagttatatgcagagtcctggggtgctgacaatatcctatttcttggcctaggtggtggcaatataaccgctcaatttacagctatttgtgtaactatatattttatacatcttcaccatgaaaataatatttcacaatgaaaacaaaccaaaatatgcaaattaaaattccttacctggatccttaaaatcaactcttcgattcctacagtccgggctttttctacataagatatcagatccatcatctcttctgttgtttcagggacttttaatgcatgttctttaattgcttcaaattcactgcaaatactgacataatactctgctttaatagacttatggcaattaatgttatatcatattcaataaatgtgtgttatgacgattactataaaataagaactatgatatcctaaaaaaattgcttgattcactaaggtatcttaaaaatatttaagcttggccaggcacagtggctcacacctgtaatcatagcactttgaaaggccaaggcaggcagatcacttgagctcaggagttcaaaaccagcctgtgcaaagtggtgaaaccctgtctctacaaaaaaaaaaaatacaaaaattagctgggcatggtggcacatgcctgtagtcccagctacttgggaagctgaggcaggaggatcacttgagcttgggaggttgagctacagtgggccatgattgcaccgttgcactccagtctgggtgacagagtgagaccctgtctcaaaaaaaaaaaaaaaaaaaaagcttatctgctataattcagtatatactatacatcaacaaaacctacaaaattaaggtaatatttacatgcaaaattatggcatattagaaaaaaattttagcgacctcttcaactctcttaaatacccaggtaacactcatctttctggattgttgtaatacaacaatgaatgcaaagggtctagcacatagtacactctatttactgataactataatcattagtataattattagttttattattattagtgcctcttgtgaaacatgacagtacagcaagtaaacagatcaaaccctcaaactcttatacatagtttctttaattaacagttctcttagaatatcccatgtaggatatgaacctagatatcctacagcattattcaactaaagttacatttcatggaattttttcctgtgctttaaaatatctgggccaaactaatctttgataaagcatacaaaaacataaattggggaaaggacaccctattcaataaatagtgctgggaaacctgaacagccacaggatctccatctctcaccttatacaaaaatctcctcaagacggatcaaagacttaaatccgagacctgaaaccataaaaattctagaaaataacatcagaaaaaagcttctggacattggcttaggcaaagaatccatgactaagacctcaaaagcaaacacaacaaaaacaaaaataaataaatgggacctaattaaaccaaaaagcttctgcacagcaaaagaaataatcagcagggtaaacagacaagccacagagtgggagaaaatatttgcaaactctgcctccaacaaaagactagtatccagaatctacaatgaactcaatcaaatcagcaaggaaaaaacaaataatctcatcaaaaagtaggcaaaggacatgaataggcatttcttaaaagaagacagccaaaaaaacctatgaaaaaatgctcaacataactaatcatcagggaaatgcaaattaaaaccacaatgagataccacctcactcctacaggaatggccataatttaaaagtcaaaaaacaatagatgttggcatggatgtggtgaaaagggaacacttaaactgcttgtgagaatgtaaattagtacaaccactatggaaaacagtattgaggttccttaaagaactaaaaatagaactaccattcaatcaagcaatcccactactaggtatctacccaaaggaaaagaagtcatgaaaaagacatctgcacaagcatgtttattagcagcacagttcacaattgcaaagatatggaaccaacctaagtgcccatcgaccaatgagtggataaagaaaatgtggtatatagacaccacggaatactacttagccataaaaaggaatgaaataatgtcctttgctgtaacttggatggagctggaggccattattcttttttttttttcttttctgagacagagtctcactctgttgcccaggctagagtgtagtggtgcaatacaccacaaccttcacctccaggttcaagccattctcctgcctcagcctcccgagtagctgggattacaggcgcgtgccaccacgtctggctaatttttgtattttgagtagagatggggtttcacatgttggccaggctggtcttgaactcctgacctcgtgatccacctgcttcagcctcccaaagtgctggaattacaggcatgagccaccgcacccggctggaggccattattctaagtgaagtaactcaggaatggaaaaccaaatatcgtatattctcacttataagtgggagctaggctatgaggatgcaaaagagtaatataatggacttcggggactcggtgtggggaaggctgagaggcaggtgaggggtaaaagactacatattggtacagtgtacactacttgagtgatgggtacactaaaatctcagaaatcaccgctaaataacttaactgctaggcgtggtggctcatgcctgtaatctcagcactttgggaggtccaggagggtagatcacttgaggtcagaagttcaagaccagcctgaccaacatgatgaaaccccatctctactaaaaatacaaaattagccaggcatggtggcacatgcctgcagccccagctacctggggggctgaggagattccaggagaatagcttgaacctgggaggcagaggttgcagtgagactccatctcaaaaaaaaaaaaaagaatttacccatgtaacaaaaccacttataccccccaaaactattgaaattttaaaaattaaaattaattttttcttttaaaaaaatatctagcccaggcacagaggctcacgcttgtaaacccagtactttgggaggctgaggtaggaggatctcttgagcccaggaggttgaaatcagcctacgcaacatggcaaaaccatgtctctattaaattttttttaattttaagtaagaaatagaaatcggtattgtcattctattactagaaatatcaggaaaaaaccatgtaaaaacaaagtgtaaaagaggtaaatgattttttagttcatgcaggaatttggagaaatatgtgggaaattatacttgctcattcactcatttaataaatagctgagtacctacaatatgctaaggaaaattctaaatatagcagcaaatgagaccctgccctcataaagcttgtattgaagctgaggaaagagacaaaagcacacaaatatgtacactgttaggtagcaaaaaaaatgctgaggatcccttgagcccaggagttcgaggtggaagtgagctataattgtgctactgcacttcggtccgggcaacatagtaggaccctgtctctaaaggagaaaaaaaagctatgaagaaaaataaagcaacataaaaggaaaaagaatgatggagtgtcaagaagaagccactattttatacagaggggccagagaaggcctttctagggaggtaatattcaaggtgaggggaaaaaacaaatgagttgttcaaataccaggaaaagagattccaggaagaaaaaccagcaaggacaacggccataaagtggtaataagcttggcatactttaggaatggcaaacgaagttgaagtggtgagcaggaatcagatcatgtaggactttacagttaattattgaatatcagaaatacaggaggaatgtggccaggcacagtggcccacacctgtaatcccaacactttgggaggctgaggagggaggatcacttgagtccaggagtttgagaccagcctaggcaacatggcaagaccttgtctctaatagaaaagaaggaagaaaggaaggaaggaaggaagggagagagagagagaaagggagggagggagggagggagagagagagagaaagaaagagaaagaaagaaaaaaaaaaagaaagagaaagaaagaaagaaaaaaaagaaaaagaaagaaaaaaaagaaagagcaagcattaatgtggataatgcaaaaagacagataatcctcctggggatcatcttgctagtgcagaatctgagtcctttgggcagagatacttcagcaaaagaaaaggaggcaaacaaaatgatgagagcaagatggcccaagcagatgctaaaccaaacggtgaagtaagcaaattgctcttcagtgaccttgtacttaacctaggggcacacatttcctccttttgatgttatctaaagtacagaattgaaacaggaggaatcaaagaataaactaggtgaaggaaactggataaattttcagctgcttttatatcatagctttataataagataattattttgtgaaaagtatggaattttccagaaaaatcacagatactacaaaaataaatacaaaaaaattatgttaaacataaacttataaagtgttttttttttgttttttgttttttggttttttttaactaactatggcattgtcattgttgttactcatcaggatggttacaactctcaagaaagggaaaggttctaatactttaccctctttgatatcttctcgtgtagtatacttttatacagaatatgcctgataaatttgacttctgactgtcatatatttgcttattcaatttaagatatttattgggctcctattctatgccaagcaaggcactagatattttacaaatgttatctgtgatcctaatattagtcctgcgaggaaggtactctttttctttttgtttttgtttgtttgtttgtttttgagatggagtctcgcactgtagcccgggctggagtgcagtggtgccatctcggctcactgcaacctccacttcccgggttcaagcgattctcctgcctcaacctcctgagtagctggggttacaggcacctgccaccacacccagctaattttttgtatttttagtagagacggggtttcaccatgttggccaggctggtctcgaactcctgacctcgtgattcgccctcctcggcctcccaaagtgctgggattacaggcatgagccaccgtgcctgcctggaaggtactatttttcatagttgacacagtagaaaactgaggctcaggaaaattaagtaggttgcccagagttatggaactagttaatggcaatcagtattcaaattcatgtctttctgattccaaagcatgcaattttttcactttgcttccgggaaaataaacataatagttaacatttattgagtaccatgtgccaggcagtgtgctaggtgctatacatacattagttttcatctttacagaagttacaagcttttttggggacacacagataacaaatgagttcaataaattggatgatgaattggttgagcactgggtgaacaaaccacaggacatattccctctctaaaaggcaaagttgcttcttagctccatttaccacagcaggcccgatgtggcatggtcttcccactttttcaagaaaggtaagaaatccaaagtgtgtgtgtgtgtgtgtgtgtgcacgtgcgtgtgtgtactaattttaaaatgatggtagcaagtccaaaatctgtttaaacaaaataaaacacagtgtgaaacaagcaaaacacatctacatgacacactcaagtagcaggccactagtttatgaatccaattttatagccaccctgaaaagtaggtattactgtctccattttacagatgagaaaaataagctcggtgatacaataagtaaatattgaggtcagggatgatcccagatctgcccaatatcaccaaaagtctacaatcttatcattatcatgtaacctgtacctgaatctggtttatttccatttcttttttaaaaaaatcctgggttgcatttaaaaaggtatcaaacagtatcaaacaaaaagaatccagcccaatgggactacaaaggcacctctataggaggcagctatggagaaaaagttgtacgtacttacatattttaagcttttgtttttaaacaagagttactttagcaaaatacttcttttagccatataattctgagcttgggaattaattctacttaccattcattttcttttctatattttgaagctatgtcatttaataatatgtttgcaaaggcttttgctttatttgtcaggcctgtcttcaaatcttcacaatccaaacgcaccatagtgtaatgaatccactgaggcaaaagcattatttctgaggcaagactgagaaatttttctataaacttgaaaaaaagtgttcaaatgaaaaaaaaaatgtttagaactttcagtgattttataatattgtattgttatgaaagtcctaattatataaatacaactttatttcttttttgctaagtgactaaaattttttcccttgttgcatacatatttttttcacctattctttcattaaggaatttgtcaatataccagtaaatatccaatacgataccattcacagtatcaaaatctgaacatatcacacggtaaaatttccctcaataattattttttaaaattatccccagagtcaacccatttctctgtttagaaacaaacttatatcatgtaacaatttgcatagtggataaatatttgcttttgccattactgatagctcattaaagattctatttttttcactttacgtccacatggtcaaggattctaattcaacctttaggaaaaatacatatatataaggaacttattggtttttgtcaaaatactccaagccaggcatgatggtttgagcctataatcccagctactgttaggaggctgaggtgggaggattgcttgagcccaggagtttgaggctgcagtcagctatgatggcaccctgcattccaggctgggtgacagggtaagactctatctgttaaaaatataatgataataatccaggaacagatgctctgcaattaccaagatccaagatattggaatgtatgtcaacttcttagtgcccaaacactggggtaattttttaaaattaaacaaagtagtatcaagaaaatctgacaggatatgtgatacttggtaaaagtgaaacacacttaccaactttggacaaactttgacttaatttcacaatccacctttaatgtttctatctgccttccttctcacttgatctccactctctactgaaatggcctgttccttttattcttccttcaggagaactttccttcatgttactctctctcaatgctgtcctatttttctagagtatctaggatgtggtgaattgggtttaaatttttcagtgttcaagggggaagataataattaattgattcaaagactatcttaagcacctgccttgttcttggttggaaatacaccaaataggccaggcgtggtggctcacgcctgtaatcccagcactgtgggaagccgaggcgggtggaccacctgagggcaggagttcaagaccagcctggccaacatggtgaaaccccgtctctactaaaactacaaaaattagctgagtgtggtggcacatgcctgtaatgccagctactcaagaggctgagaatcgcttgaacctgagaggtagagattgcagtgagccgaggtcacaccactgcactccagcctggaagacagagcgagactctatctcaaaaaaaaaaaaaaaaaaaacaacaaataaagggtagacagaactcatggcattgaaaaaagatgaatatggataaattttaccatgatgaaagaagaaaaacacaaaagaatatatacagtatgatacctttcatacaaacttaccgtggacaaaactaaactatattatttaagtatacacacataggtggtaaaaccataaaggaaagcaagaaatgtcagggtaatagttaccaataaagacagaagaaagttataattggggagaggcacgtggtggcttctgggttttgcaaagttctctttcttaagctacatggttattaacacctaggttataattacctatcggtctatacatatgtactatgtatgttatatttcacaattacattaaattttttcatggaacattttaaacatacaaaaataggtaaaatgtacccattatccagtttcaacaattagcaactcatgaccaatctttttttaactatactcctaactactcccctgtcctgttttatttttacacaaatcacaagcatcttataaattcatctgtataagccaggcatgatggctcatgcctgtaaacccccagcactttgggagactgagacaggaggattgcttgaagccaggagttcaagatcagcctgagcaacatagggaaacccccatctctacaaaaaaaaataataatttttttaaaattagccagccagcttgggcaacatggtgaaaccctatctctacaaaaaatacaaaaattagccaggtgttgtggcgtgtgcctgtagtctcagctattcagaaggctgaggtgggaggaacacttgagcccagaaggcagaggctgcgttgagccgtgatcacaccactgcactatagcctgagtgactgagactctgtcaaaaaaaaaaaaattagacgggcatggtggcacatgcctttaatccttgctacttaggaggctgaggtggaaggatcacttgagcccaggaacttgaagctgcattgagctatgctcacatcactgcactccagcctggacaacagagaccctgtctctaaaaaaataaataaataataggccgggagtggtggctcatccctataatcccagcactttgggaggctggggcgggcagagcacctgaggtcaggagttcgagaccagcctgaccaacatggagcaaccgtgtctctactaaaaatacaaaattagctgggcgtggtggtgcatacctgtaatcccagctactcgggaggctgagacaggagaattgcttgaacccaggaagcggaggttgtggtgagccgagattgcaccattgcactccagcctgggcaacaagagcaaaactccaactcaaataaataaataaataaataaataataaataagttcatctgtacagatgttacagttcatcattcttaaatttcccccaaaataggcatactaaccacaactatagtatatcagaaactgacaaagaaatccaggaatatgttactaaatctaaaagtaaatttttaaatagttatataaactatcccaaaattattacaaaattctagaaaatgtcactacaaaataatagacctaaggaaataatcattttcaaagttaatgaagccgggtgcagtggctcacacctgtaatcccagcattttgggaggccgaagcaggtggatcatgatcaggagattgagaccatcctggccaacatggtgaaaccctgtctctactaaaaatacaaaaattggccaggtgtagtggtaggcacctgtagtctcagctactcaggaggctgaggcaggagaattgcttgggcccaggaggtggagcttgcagtgagtagggatggcaccactgcactccagcctgggcgacagggcgaaactccatctcaaaacaaacaaacaaacaaacaaacaaacaaaactttaatgaaacatatacttggtcttgatatttaggacttatagacactacaggttatacccagaccacaaaaaatttagttggtaattcatagaacatttattgtgtctattctctgcatagcactatattgagatatatggtaaaatacaaattaaagagaatacagttggccctctgtatccatgggttccatatctgcagaatcaactaacagcagattgaaaatatttgaaaaaagccataaaaataacaataaaataattcaaataaaagacaatacagtataactctttatatagcatttatattgcattaggtattagaagtaatctagagatagtttaaagtatactggaggatgtgcataaattatatgcaaatactataccattttatatgagacttgagcatctgcagattttgatatctatacaggggtcctagaacaaatacctgcagctaccaaaagacaactatataccatccctgaatttgtgaaagtaataatgcatttatgcattcacaaaatagtttcatgaacccataaaaaccaaataaggtaaaaagtatgcatattagaaaaaaacacatagtcgtctcaatagctgccaaaaaagcattaaacaaactggtgtaaaggtagtgagttatctcatttgattgttcacagtcaatcacagatcaaactgcttgttctactctttcccctttctcattattgggtacttgaccagtcaaaaaaaaaaaaaaaaaaaagcatttaacgaaacccaacactctttcatggtaaaaacacaaactaggaatagaagataacatcctcaactttcataaggcatgtctaggaaaaacctacaactaatattatacttaatgatgaaaaaatgaacatttccctctaagatcaagaacaagataagggtggttcgtgcttgtaatgccagagctttgggatgctgaggcaggaggatcacttgcatccaggagtttgagaccagcctgagcaatatagtgagaccccatctctacaaaaaatactaaaattagctgggtgtgatggcacacgcctgttgttccagctacttgagaggctgaggtgggaagattgcttgagccagggaggtcaaggcagcagtgagcaggattctaccattgcactccagtctggataacagagtgagaccctgtcttaaaaacaaaacaaaacaaaacaaaaatgtgtactacattggctgggcccagtgtctcatgcctgtaatcctggcactttaggaggccaaggtgcatggattatttgagcccaggagtttgagaccaacctgggcaacatagtgagaccttgtctctactaaaaataaaaaaaaataaaaatttagccaggcatggtggcctgtgcctgtagtcccaggtaattgggaggctaaggtgggaggatcactggagtctgggaggttgaggctacagtgagctgagatcataccactgtactttagcctgggcaacagagtgagaccctgtctaaaacaaaacaaaacaaaacattgtactaaaacaaaacaaaacattgtactacaggtactagccagtgaaattaggcaagaaaaataagtaaaacgaactcagattagaaaggaagtaagacaatcactattacacatgacatgatattgtatacagaaaattcagggccaagtgtggtagctctcatctgtaatctcagcagtttgggaggctgaggcaggcagatcgcttgagctcaggagtttgagatcagcctaggcaacatggtgaaaccccttctttacaaaaaatacaaaagttatcccaccatagtggcatatgcctgtattcccagctagtcaggaggctgaggcaggaggatcacttgagcctgagaggttaaggctgcagtgagctgtgacagcaccactacaatccagcctgggcaacaaagcaagaccctgtctcaaaaaaaaaaatgttactagagataaacagagatattttaaaataataaaagggtcaatccatcagaaagatatgacatttacacatatatttgcacttaataacagagtaccaaaatatgtgaaacagtaaatgacagaaataaattatactttttcagtagattgattgtataatatgtgaattacttctcaataaagttgttttgtaaaataaaagctagagtattagaatcagtaaaaacttcagaataagaaatataatcaggggccaggcacggtggctcacgcctgtaatcctagcattttgggaggccgaggtgggcagatcacctgaggtcacgagttcgagaccagcatggccaacaggttgaaaccccatggctactaaaaatacaaaaacattagctgggcgtggtcacgggcacttgtaatcccagctactagggaggctgaggcaggagaatcacttgaactccagaggtggaggtttcagggagctgagatagtgccacattaggacacaaaaagtattaacctcactctagcctgggcgacaagagtgagactccatctcaaaaaaatatacatatatttacatattttgtatatattatatatatttttatgtatttatataatatataaatatataaatatttctttcaaagttgttataccatttacagtctcaccagattatatctgctggtgagattatatataaatatatgaatatttttatatatttatatattattttatatatttttatatatttatatatttttaatccttgattttatatatatttatatatttatatatattttaaacaatgtatttatatattttataaatatatatttttaaaatatatttttatatataaattttataaatatatttctatatttatatatattttatactattttatctatttatatatttatatattttaatccctgattttatatatattatatatatataagatcagggacttaaaaggttattttataataataaagaatgttcatcaagaaaacataacaatcctaaatatctatgtatccaaaaccagaaattcaatagcctgtggcaaaccgaatcctgtcaatgaccacttgagtgaacttggaatcattctgcccccagtcaaaccttcatgagaacatagccccaactgacagcttgactgcaactttatgagagaccttgagccacagggactcagctgatccaaggctggattcctgacccacagatactatgagataataaagtctggtattttaaggcactaaattttgggggtaattcaagtttatcccaggaaaacaacattgggttaatatttgaacatcaataaatataattcaaaatattaacagaaaaaagagaaaatccatatgatcaattaaatatatgccaaaaaatacttgacaaaattcagcgccctcccatgataaaaactcttggcaaacttggaatagaagggaatttcatccacatgataaagggcatctaccaaaaaccctactcttaatgtatttaatgacgaaaatctgaatatatttcccataagaccataaacacagcaaggatgccctatgtcactgctgctattcagcactgtactgtaaataaaaattgctattaaaaatactatttatggccaggcgcagtggctcatgcctgtaatcccagtacttcgggaggccaaggtgggcggatcacctgaggtcaggagttcaagaccagcctggccaacatggcaaaaccctgtctctactaaaaatacaaaaattagttgggtgtggtggcacgctcctgtaatcccagctactcaggaggctgagacaggagaattgcttgaactcaggaggcagaggttgcggtgagccgagatcttgccattgcactacagcctaggcaacaagagtgaaactctgtctcaaaaaaaaaaaatgctatttataagaaaatcaagtaaaccagaaacattttaagggacagatttaggaaaatatttgcaagagctgtacaatgcaaactataactacattgctgagcgaaattaaagaaggttcaaataaatttaaatacacactatggtcatgtattgaaagcttctatttcaagatggcagttctttccaaattgattcagagattcaatggaatcctaaccaaaatcctagctggcttctttaggaattgataggttgattttaaaatgtatatggaaatgcaaagcacctagaacagtcaaaataattttggaaaaaggacaaagtgggagaacttgcactacttgattttacaatttaccattgaactacagaaatcaaggcagcatggtactggcataagaacagatacataaatcaatggaaaatagagaatccagaaatagacccacagatatagggtcaattgattttcaacaaagatggcaagataattcaatgagtacaagatagtatttttgatatatgatgctggggcagctggatgtccacatgaaaaacacctgaacagtgacccatatcccacaccacatacaaaagttaacttacaatgggtcatagacctaaatgtgaaagctacaactataaaacttctagacaatcacatgtgttgtttaggaattctaagaaaagcttccagagtaaaatgtaggaacaaatctttatgatcatgcagtaggaaagatttcttaggacacaaaacgtatgaacctcagaagaaaaaaattgatagactagaattaattataatataaaatgtctgctctttgaaagacattgttataaaaataaaatgtcaaggcataaactatgagataatatttgcaaaactatttcagatacaagacttttacccagaatatataaagaattcttaaaactccataacattgattataacaatatagtccaataaaatacatccattatagctcaacaataaaacataaaaacccaatttaaaatgtacaaacaaaagacactttatttttattagtaaaaagatacacagatggaacatgacatgttaaaagatgctaaacatcattagtcatcagggaaatgcaaattaaaaccacagtgggataccaatatacacatgaaattaaaaagactgataatctagatgtgaaagtgcagtgggaaaaaataaaacaatagtaaaaagtaaaagactgataagcccaaaggttgaaaaggatgtggaagaactggaaatctcatacactgctggtgagattgtaaatggtataacaactttgaaagaaatttaagtttcttctgttttttgagacaaagagttttgctctgtcactcaagttggagtgcagtggcatgatcataactcactgcagactcgaactcctaggctccagtaatcctttcacctcagcctcctgagtagctgagactacaggtgcaagctactatgcctggcttaacagtttcttaaaaagttaaaaatacacttcccataccacccagcaatccagctcctagaaagagaaatgaaagcatatgtccgcacaaagacttgtaaacagaagaccatagtaactttattcataatagccaaaaactggaaacatctcaaatatccatcaaaacgtgaatgaataaagaaactatatacctatacagtgaaatactactaagcaataaaaggaataagttaggctaggcgcggtggctcacacctgtaatcccagcattttgggaggccgaggtgggcggatcatgaggtcaggaggtcgagaccatcctggctaacatggtgaaaccccatctctactaaaaacacaaaaaattagctggccatggtgatgggtgcctgtaatcccagctactcgggcggctgaagcaggagaatggcttgaacctgggaggcggaggttgcagtgagccgagattgcaccactgcactccagcctgggcaacagagcaagactccgtctcaaaaacaaaaacaaaaacacacacacacaaaaacaaaaacaaaagaggaataaactactgacacaaaacaaataaatctcaaaaactttatgctagtaaaagaaatcagatgcaaaagagtatgtatatatgattctatttatctgaaactttagaaaacaaaaacctaatctatagtaacagaaagcatgtcagcagtttcctgaggtcagagttggggagaattgaccaggatggggtataaggaaggtttctgaggtaggagaaatgttctacatcttaattctggtgatggttacgtaagtgtacacatttgtcaaaactcatataactgtacaattaaaatgggtacagtttattgtatgtaaactaaatgtcaagttgattttttaaagttaatttctcttgaaattaataaagaatttttaaaagggatggaatgacaaataaatatagcaaaatcctagaatgtaggtggtatgctttgtaaaattccttcaatttctctgtacaggctgggtgtggtggctcatgcctacaatcccaacactttgagaggccaaggtgggaggactgcttgagcttagaagttcaaaaccacctggggaaacataaggagacaccatctctacaaaaaaaaaaaaaaaaaatatatatatatatatatatatatatatacttcttaaaaaaattagccaggcatggaggtgtacgcttccagtctcagctactcgggaggctgaagtggaggactgcttgaacccgggaggttaaggctgtagtgagccatgatcatgccactgcactccagcctgggcaagagagtgagaccctgtctcaaaaaacaaaacaaaactctatatgtttaaaatttaagatgttagaaaaattaaaatgtataaagtatacattaaaaaatctaaacagtcaatagaaagggggaaaatgaagaaatatgccagttttaaccaatagaacaaggtcccttgaggaggtaggaatcttttttctttcaattgccttttccccactactatcagaattacctttttttttttttgagatggagccttactctgttgcccaggctggagtgcagtggcatgagctccgctcactgcaaccttcgcctcccaggttcaagcgatcctactcctcagccccccctagtagctgggattacaggcatggaccaccatgcttggctaattcttgtatttttagtagagatggggtttcgccatgttggccaggctggtctcgaactcctgacctcaggtgatccacccgccttggcctcctaaagtgctgagattacaggtgtgagccactgcacccagcccagaattatctttctaaaactcagatccgaatagattacttccacagcgaaaaaccttcagaacaaagtacaaactcttgagcaaagatactccaggattttcccatgtggctccaacttacatttcgaacttcatcatattctaaatcttccatgtactgtgtccctgttccctattctttaactattttcattcatttatattctctgaacaccctggttcatgctacatcccctcccttctccacctataaaatctatttcaaagcccaactcacatttcacttcttgcataatctcttcaccaatttcccaaagcaaacaacactttgtccatatctctattctagtacttatctctatagttgttatttccgtgtcaggcttccaggccaaatataagctcctgaagacagtgcttatgccttttttttaagacagtgtctcgccctgttgcccagctggagtacagtggtgcaatcagagctcactgcagcctcaacctcctgggctcaagttatcctcttgcctcagcctcctgagtaagaaggactacaggcatgcaccaccatacctggctaattcaaaaacaaaaacaaaaacaaaaacaaaaaaactttcgtagagacacggtctcactatgttgcccaggctggtctcaaattcctgggctcaagcaatcctcttgccttggcgtctcaaagtgctgggattacaggcatgagccaccattcccaccctttcatttatttttgcatcaccaaatcttgttaggtgtctgaatgtgataaggaaatttttattgaattaataaatgagtaaatgaatgactaaagaaattgtaaggtaagacaatgagttttactgaaatgatattttaaataagaaattctatttaagcatttactttttagaatggaaagatcctaatgttacaaaaaaattcaaaacgcattaataaaaacagaattaccgcttacctctgtatattcatcaaaagtatgatcttctgtctgaaaagtctctatattctcaactgcagtcccatcaaggagccaattatatttttcaactgaaaattaataatctaattaaaatctcaataataccctttttagaagataaaacactttttttatatgatcatggaatggggacctactcaattaaatattattattaatagagtattaacatacatgatttactatattttaagaaaatgggtagaataaaaggaaaccaagttaaacagacattttaaaacaaaggtattagagtatttgaggcttttaagaataacttaggggtacatatacaccaattaatagaagatattggttaatagaatgtcaaagaataaccatacatcctgacctcacacacacttgagaagactacagaccaataaaattgagctacaggctctttgaaactattctcagaaactaccttgcttttacccttgaattattcccaacatttcttctctctgcctttgactttatcaccctgctccagttcatatgcaccctttggactggacaacaaaatgtattgggtttgattcttttttttttttttgagacggagtctcgctctatcgcccaggctggagagcagtggcgcgatctcggctcactgcaagctccgcctcctgggttcacgccattctcctgcctcagcctcccgagtagccgggactacaggcgcccgccacgacgcccggctaattttttgtattttttagtagagacggggtttcaccgtgttagccaggatggtctcgatctcctgaccttgtgatccgcccgcctcggcctccctgggttggattcttgactctgccaaaagctacgcctatgctcacttctggctctccctgttctttcatggcagccccagacaaacaaacatctgaccaaattctagcacaaataaagtgatgacaaatggtataatattatgtatgtcatacacaccatatgtctcataatgctttcttgcaccttctaagttccgatgtactgctgccttcagtgtatcaacagcccagtgtaacacgtgttcaggaagttctgtgtcaagatttactggtgttgaagttcctgatagccaagaggggattgtttggacattctaacacaaataaaaataataacaatgtatacaataaatatctaactgtataattaatctatatgtagatctttttttttttcctttggagacggagtcttgctctatcacccaggttggagcgcattggtgcgatctcggctcactgcaacctccgcctcccaggttcaagcgattctcctgcctcagcctcctgagtagctaggattacaggcgcacgccaccacgcccagctaatttttgtatttttagagacggggtttcaccatgttggtcaggctggtctcgaactcctgacctcgtgatccgcccacctcagcctcccaaagtcctgggattacaggcgtgagccatcatgcctggcctattttttgtattttagtagagatggggtttcacagtgttggtaaggctggtctcgaactcctgagctcaggcaatccgcccgcctcatcctcccaaagtgttaggattacaggcgtgagccattgcgcctggcctatatgtagatcttatactatattttaaaacattcttttcagatttcaatggcccaagaaaaaataacttgacataaaataataatttaaaattgtatagtttgtagtctaacataaaacaagttgggccaggtgcagtagcacatgcctattgtcccagctacttgggaagctgaggcaagaagatcacttgagcccaggagttcgaggcagcagtgtgctatgatcatgtctgtgaatagccactgcatttcagcctaggtaacacagtgagaccctgtctcaaacaaaacaaaacaaaacaaagaaaaccttaagttgggttagttttctatcatccaacaaatatttattgactaattatttactgacaaataaatatttgtcaaatatttatttatttatttattattggtttttttttttttgagacggagtctcactgtgtcactaggctggagtgcagtggggtgatcttggctcactgcaacctccgactccctggttcaaggggttttcctgcctcaacctcctgagtagctgggagtacaggcacgcgccaccatgcccagctaatttttgtatttttagcagagatgaggtttcaccatgttggccaggatggtcttgatctcctgaccttgtgttccgcctgcctcggcctcctaaagtgctgggattacaggcgtgaggcactgcgcccggctgacaaatatttattgacaaagtaattatgccagaaagctctagaaagaacaaatatcaattagatcttgttcttaagaagctcacaactcagaggagatgagacatgcaaataaaaaaatcaattcatagctacaagaaaagttctaagaaggaaaatgtcatctccagccttcaagcgactttttcaaagagaaagcaatttctaatttgaaataattgggggaggaaaataacagaaagagtcataacattgtatgtacacatacactgcatagagattcaattcaaataatttaaaattctttcccgatgggtaaagatgtaatacctgcagagcttcggctattcgttccaccaaactcaagacattatcttccaaatcttgaaaggtaggataaaattccattttgtcgtcatcaaatgtcaattctatcttaaatattggcagcctttgttgatcttttgggtcaaagagttttacaaatccttctacagttctccttaatagatcctttagctgcgtgatataaatcactgttactttagagagtacaaattcaacctttaactaaaatcagtaaactgattataattgtctatatctgattataattgtctataattaaaacatcctatcaatccatttaattgaaaattatcttcattcagcatactatatatatgtgtgtatacatacatgcacacacacacacacacatatatatatacatatttttttttaagacagtgtctcactctgttgcccagactgcagtgcagtggtgccatcatagctcactgtaaccttgaactcctgggctcaggcaatcctcctgtttcagcctcctgagtagctgggactacggcgcgtgccaccacacccagctaatcagcatgatatgttcttattaatttttaatatttgtgggtacataataggtgtatataagggttacatgagatattctgatacaggaatgtaatgtgcaatagtcacatcagggtaaatgggatttccatcacttcaagtatttatcctttgtgttacaaacaatctaattatactcttttagttatttttaaagggatgattaaattatgttttgctgtagttacccagttgtgctagcaaatactaggtcttattcattcattcttttttcttttctttttttctctctttttttttcttttttctttttgtttgttttgtttgctttttgtttttgagacagcattgcccaggttggagtgcagtggcaagacctcgattcactgcaacctctgcctgctgggctcaggccatcctcccacctcagcctcctgagtagctggaactacattcacaagctaccacgcctggctaatttttgtattttttgtagagacagggttttgtcacgttgctcatggctggtctcaaactcctgagctcaagtgacccgcctgctttggcctctcacagtgctgggattacaggcgtgagccaccacactcagcttatccattctttccaacttttttgtacccattaaacatctccacttaccacaccccccaccccccgcccacttctcccactacctttcccagcctctggtaaccatccttctactctttatctccattagttcaactgttttaatttttagctcccacaaataagtgagaacacacattaacaaaggtaacctaaaacaataaatagaacattatatgcaaaccctaattttgtttttggttttggttttttggtttttgtttttgttttgagacagagtctcactctgtcggtcaggctggagtgcaatggcacgatcttgactcactgcaacctctgtctcccgggttcaagcaattctcctgcctcagccccctgagtagctgggattacaggtgcctgccaccacgcctgcctaatttttgtagttttagtagagacagggtttcaccatgttggccaggctggtctcgaactcctgacctcaggtaatccacccaccttggcctcccaaagtgctgggattacagatgtgagccactgcgccgagcctgtttctgttttttaagactgggtcttgctctgttgcccaggctggagtgcagtggcacaatcatagttcacagcaggctcgagctcctgggatcctgggctcaagcaatcctcccacctcagcctcctgagtagctgggacaataggcatgagccaccattcctggctaatttttaattttttttctagagacagtgtctcactttgtttcccaagctggtcttgaactcctgggctcaagtgatcctcccacctcagccacccaaagtgctgagattacaggcgtgagccaccacacccagccaaaccttaattttttaatagaatatcaacaatcttaaaatggtgactcagaacttttcacattctttagtaattctgtccctggtacagaaaatgttccagaagatcaaacaacatggtaaagactgaagggaggggaggtctgacagccagaggtaagtgtgtaatggggggacatgcacatggagtgaggtacagtgaaatgctagaactagctcctgttctctcaagagccaattgttaaatactcaagaattttgtgagccagttgctaaactcttagaagctcgaaatttaccactgtgggaatatttacaccacagaagtcgacaaacactacaaatcagggtaattatctttttcttttatttgtttattcatttatttatttatttacttatttatttattatcttgagacagagtctcactctgttgcccaggctggaatgcagtggcacaatctgggctcaccacaacctccgcctctcggtctcaaactattctcgtgcctcagcctcctgagtggctgagattacaagcatatgccaccacacctggctaatttttgtatttttagtagagaggaggttttgccatgttggccaggctggtcttgaactcctgagctcaagtgatccacctgcctgggcctcccaaagtgctggtattagaggtgtgagacaccgtgcccagcctcagggtgattttctttcctggagagccatatttctagcacactactgggtgaaggtaaagccactggaacttagaaacatgcacaaggagcttctaaagtacgaataatggtttcttatagagaaccaactgttgggaatttagcccagcaaacaaacatggttctaaatgatcttcaagacattcctcatctctttacttttattaaataatcacagtcctcttaagagggtaaaggtagaaaggaaaccatgtgtattagttacagcattacatactagatattaaatatgtatattatccttttaaatatgctagacaaaattcatggaattgttggaggtctttactgaaagggaaagtttttcttcaaaactatttttctagaattgtatatcttcaacagtaaaaatttgaggaggccataaatataatttcataaaattaaaaattccctatttgtcatttaaagatgatcaataactttaaaaattttttccaccagatacctcttatacaatgatcaataacattttaaaccaagattttactgagaacaaaatgagaatcaatcaacttggaatctaataaattcaaaaatatgttactagaatagttcttttgttaacatactccaaataaagctataattaacttatatatcctttaggcatgagccaagtaattactcataatactaatatatacttctagatttcctttcattttagatagtttcagaaacacaatatttttctgctaaaattattaaaataaaattacagtagaaatattttatttcaaaataattacttagcactatgtttacgtagaattctatttaaaatattgaactaattttaataacattatcatttaatatatataaagtgtatgtacctgatttgacataagtgtggaaacacagctataaaatgcatccaatttttcaggtttaacaccttctagtgcctccttcttggtaaagagatttataacctttggataccatgtattcattatcttctcttctgcgtttctagtttgtattgatagatcagttttcagtgattcacagtcaattggacctttagctctatttatgagaaaaagaaatgtgatttgaagcaaatgatacatattggtcttaaaacacaattgttgggccgggctcggtggttcacacctgtaatctcagcactttgggaggctgaggcaggcagatcacgaggtcaggagttcaagaccaacctggccaacatggtaaaaccccatctctactaaaaatacaaaaattagctgggtgtggtggtgtatgcctgtaatcccagctactcggaaggctgaggcaggataattgcttgaaccagggagacaaagcttgcagtgagccaagatcgcaccattgcactccagcctggatgacagagcaagactccatcacgggaaaaaaaaaacaaaaaaaaaaaaaaccaaaaaaaacccacacaattgttgaaacaaacaagatacatttttttaaactctaaaatctagagaaaagtgttgaagatttaggattccattttaaaaattatacagtcaaaaatatagactcaagcaaggagacattcaaattttaaattaaacgggattttacctaattcctgtgaagtccaacaaaactgtatcagcaaatgttgtataaccaaggtccagtaacattttcatagttggatgaataatgtgcaaattagagaatatttgatttcttgcctgcacatagctagaatgccaaggattagaataatctaggcctctggaaaagcaaaacaccatatcaaacatgatgaaaataatacaccctaaactttaggaaataatgcttataacatgaaattagtattgaagtgagaaaactggggcttgagaagagggagctgtggtcagcaatgggaaccttaagatatatgcatttaataaaaacacatcaagaactcaaaactgcattatcttcagagagaacagaaataatttgtgagtaaggcagagtgatgggccagatctgagagctctgctaacttccactgtgctttggctcagttatcctggtaaaaatgaaagaacacagtctttaggactaaagaaaagcgctggagaaatctgtctgccataccccaaagcttactcaaggctaagttaagctatgcattcataaagatctccccagttatgtatgcagaactaaatgagcatagtagagagaatacctctgaggtaaaaacaagagtactttttttttagatgtgttcaaaatacctttgagcatcacaattgtatacttgaaggtaagatcagtttattttttatctatatcaaaaattggatgaagtactgtttttaaaataatttactcacacaggagattcaggtaaaggacctccttcatcttcaagcgatttaactggtggtttcacaagaacgctctgcactaaaatacatggatatattaatgcttcttgaaaatctctgcacaatctattaatatcaaagtttctaacttttgattttggatggtatagtttactgtgcattaaaaggaatgtaagaaaaaactcctttatttgaaacaaaatcaagttcttggtagtattttggccttacttgagagttcagataacgaaaagctttaataagatctcagtttttcacattccatctactcaaaagtcactagcatggccacttaaaaaaatgcatttcatggtggctaccaggggctgggaggatgttggtcacaggctacaaaatttcagttagataggagggaacaagttcaagagattacgcgacatggaggccgagcgcggtggctcatgcctgtaattccagcactttgagaagccaaggagggcagatcacctgaggtcaggagtttgagaccaggctagccaacatggtgaaaccccatctctactaaaaatacaaaaattagctgggcatggtggcaggcgcctgtagtcccagctacttgggaggctgaggcaagagaatcgcttgaacctgggaggtggaggttgcagtgagctgagattgcaccactgcactctattctgggcgacagagtgagactccatcataaaaaaaaaaaaaaaaaaaaaaaaaaaaagaaagcaattatacaacatagtgactagttagtaacaatttattgtacccttgaaaattgtcaagagtagattttatgttcccaccacacacaaaaaatgataaatatgtgaaaaaaatgcatcagttaattagctcaatttagctattccacacatatttcaaaacgtattgtacatgataattatatacaatttttatttgtcaatttttaaaaaggaaaaaagtttattctaaaaaatagcaaagattatacccctaataaatctcccaaaacatattagtattttctagcaaacctataaatagtatagctaaaatcataaagacaaagtaaaaaatcaaagagaagttagctaataaaaaaaatacaaaaagtacccttaaattgtaaggattttgacttaagtatagactcaaaataaaaactttaaataaaaatcgtatctaagaaatacatatagttaaggctgggctgagtggctcagcgtgtaatcccagcactttgggaggctgaggtgggtggatggcttgagcccaggagttttagaccagcttggtcaacatggtgaaactacatctctaccaaaaaataaaaaaattagctgggcatagtggtgtgtgcctgaagttccaggtactcgggaggctgaggtaggggaatcgcttcaactcagcaggcggaggctgcagtgagccgaaatagcaccactgcactccagcctgggcgacagagatcatgtctcgaagaaaaaaaataaaaagaaaagaagaaaaaaaccagatatagtttaaatacatagtgttcattactcattttgcttatttctatttttgattcagtggggacggggggaggccaaggtgaaagaagcctggtgtgtgttagatgctacttacccaaatatctcttcatgctgttttcaaagtcacttgacacctcatttatgagactttcaagaagttcttctctttctttcccttcctttaaagactcaggtatcagccttaacatgtgatccagccattcctgctgaataggtactaaaggactactttctacacattgcttcatataaatatagttgaactgagaacataagaaaaaattaaatgttctgcatggttgtatcatttcagtgtaactcctgaactctcccttcctaagacaacattttttcagattaaaaatattctgaaaaataacattttcagaataaaaaccatttaatccaaaagtacatcccacaaagaaaccattttatctttttctttatttatgatgaattcttgccaaattaatattcttagtatggttttcattttctcaaggcaaaatgaagattctttacctaacttattattccttattatctaacttattattataatatatccaccgattcaacaaatattcagacattgttctaaatgctgggtatatagtagctgaacaaaacagacaaagcccatgctctcttgagattatattccagtacaatagtagtataatataatttcataaattctcccataagaatgaatagtctcactaaaaatagacacgaatgaatgaaaagacacttgatcttagtaaagacattttaacatcatgaaaatttcacttttcccaaaattgatttaacacaataccaataaaattatctacatacatttttatggaattagataagttgatcctaaagttcatgtggaaaaataaacatgcaagaatagccaagaaaaccctgagaaagaaaatctgcaatggagggctagccctaggagacattagaacataccagaaagcctggtgtagcacaggtgtatggatagacagaccagtagaaaacaacagaaagtccaaaaatacaccagtatatcagaaaatttagcatatgataaacatggcatctcaaatcactgggaaaaatatgaaggttttaataactatttctggaacaactggttagccatttggaaaaagataaaataattcataccttccaccatacataagaacaaactccaggatttaacttaaacaatgaaactatacaaggatcaggaagaaaaacatagatgaagtcttttataacttgagtataggaaaaaccttcctagctatgattcaaatactagatacaaaaaaggaaacaagtaatagattaatttttactacataaaaacataaatgtttgcataacaaaaacaatttaaaatgtcaaaagacaattgacaatctggcagaaaatatttgcaacatacatctcagacaaagtgtaaagaatgctttaaaatttaggggatgggtgaaccttaaggacattatgctaagtgaaataagccaatcacaagaaaacaagtattgcattattccacttatataaagtaaatagagcagttaaatttatagaaacagaaaacaaaatagtagttgccaggggctacagggaagaggaaatgaggagttgttatttaataagtatagagtttcagttttgaagatgaaaatgttctggagattcgctgcacaagaatgtgaaaatactactaaacagtgcttgctttggcagcacatatactaaaattggaatgatacagagaagatcagcatggcccctgtgcaaggatggacacaaattcgtgaagcattccatatttttgaaacagtagatgctggcgaggctgtggagaaataggaacacttttacgctgttggtgggaatgtaaattagttcaaccattgtggaagacagtatggcgattcttcaagtatctagaaccagaaataccttttgacccagcaatcccattactgggaatacacccaaagaaatataaattattctactataaagacacatgcacacatatgtttactgcagcactacttataatagcaaagtcatggaaccaacccaaatgcccatcaatgatagactggataaataaaatgtggtacatggccaggcatggtggctcacacctgtaatcccaacactttgggaggccgaggcgggtggatcatgaagtcaggagttcaagaccagcctggtcaagatggtgaaaccccgtctctactaaaaatacaaaaaaattagccaggcgtggtggcaggcacctgtaattccagctacttgggaggctgaggcagagaattgcttgaatccaggaagcggagattgcagtgagccgagatcgcaccactgcactccagcctggcaacagagtgagacttcatctcaaaaaaaaaaaaaaatgtggtacatatacaccatggaatactacacaggcataaaaaggaatgagatcatgtcctttgcagggacatagatgaagctggaagccatcatcctcagcaaactaacatagaaatggaaaaccaaacaccgcatgttctcactcataagtgggaggtgaacaatgagaacacatggacacagggaagggagtaacacaaaacaaagcccactgggggatggagggcaaggagagggatcctagagagtgggtcaataggtgcagcaaaccaccatggcacacgtatacctatgtaacaaacctgcacgttctgcacatgtatcccggaacataaagtaaaatttaaaaacttataataaaaaaaatactactaaactgtacccttaaaaatggttaagatggttttatgttatgtgtattttatcacaatttataaacatttagggggaaataacatcaaaactacaacagaaaaatgggcagaagatataaactaacatttcacaataaaaatataattaaaatggcacttaaaccatattttaaacgtataatcttattcataattacagaaagcaaatttaaactaccctgagataccatctgtcacatatcagattgacaaaaatttttttttaaatatgacccccacattcttttgtgaaactatggggaagcaaacactctcataaattgctagcacattttggaaagaaattttgcaatatctaataagactacatattgaagtcccacttagagaaattaaaacaatacctccagcagtatgaaagcatacatatacaaggtattcattgcagcaaaatactggaaacatttaagagtggctgatgcatacattcgtgttctgtgcagcaatagtgaaaaatgagaaagatctctaaaaactgatatggagcgatttctaggatacattattaagttaaaaacaaaatgcggccgggtgcagtggctcacgcctgtaatcccagcactttgggaggctgaggcgggcggatcacctgagatcaggagtttgaaaccagcctggccaacatggtgaaaccccgtctctactaaaaatacaaaaattagctggacatggtggggggaacctgtaattccagctacttgggaggctgaggcaggagaatcgcttgaacccgggaggcagaggttgcagtgagccgagattgtgccactgtactccagcctcggtgacagagtaagactctgtctcaaaaaaaaaaaaaagaaaaataaataaacaaaaaaaagcaaaatgcaagagtatctacagtatgacgcattttgtgtaagaaaacatacctgttcattttttaaaaaaattaaacacaggaaggataaatcaaaaattaatgagattggttatatgaaagagtagcttggaacagacagaaagtatgggggcatgggaacagggtggaagggatgggagatgcttctctgaggtgtacttttggtatagttctgattttaaaccttgctgttgttttacctgctcaaagtataagtaaaaaatatcatcatgaatgagggagaaaagaaactccaaatgaaaacaaacaaaccaatgaacctacctgaatttcaagttattaataattacctagctgaaaatgtattaataattacctattgaaaaggagtgtagaactaaccaatactgaacacaatattttaaccatatatccttatgctaagtacaaaagactataggtgaatattaaactatggtgaggtttgtttttcacagtagtatgagttagcaattttgaaattatttatgtatactctaggatttaacaaaataagtaaaccttgtggctaatggatgaaagccagattcctcactaatagagaaggaagctatgcatagagaaagggggacaggctagaataaaccctgggatgttactggaataggaggtatcagtatgaatccatgggttttgagagagagagagagaaataattattttctagatcttctgctgagaaagccaggaagcaatgacactcagtatcaaggagcacatttaacacacatatcatggtttttaaataccattctccactaaaaggagccaaaaatccctggagaaatgactgattacagggctagaatagaaaaagtatatatagcatgatcctggaacatcttattgtgccagaaagtaaggatgtgctcaaagaatgatgggatatgtaaaaaaaagacgaaagagtcaactttaagggctcccactggccaaatgtggaacaactgaacttcaaattaataataaagccaggccttgtggcgcatgcctgtaatcccagctactcaggaggctggggtgggaggatggcttgagcccaggagttcaaggcttcagtgagccatgatcacaacactgctctccagcctgggcgacagagcaaaaccccatctctacaaaataattattattaataataataatacattataacttaatagttaaagtaaaaatctatagtccacactgatctaaatgaatgaataagcgaagaaaaatattaaaagttctttcttactacagaattccaacaaaaaatgtaaaagaaatgatagaaaaattactatttggcaacaaccatagtaatcattgttacaggcaaagatgttaacattatgggaacacataaagcatacaggggaattctttgtactcttttttgcaacttttccgtatgtctaaaattattttgagataaaaagattttttaaatgtgtagcctagatggacattttttcttttgtctcttacttttattttttttcaattagttgctcactccaaaattcttacagaaagacattttctatgtccactccattaatgtactgcttagtctttttttttttttttttttttttttcttcagatggagtctccctccgtcgcccaggctggagtgcaatggcatgatcttgactcactgaaacctccacctcttgggttcaagtgatgttcctgcctcagcctcctgagtagctgggattacaggcgtgggccaccatgcccggctaatttttttctttttagtagagatggggtttcaccatgttggtcaggctggtctcgaactcctgaccttgtgatccatccgactcggcctcccaaagtgctgggattacaggcatgagccaccatgcccggcccatgtactgcctaatcttaaaattcttgtgtgatagtccccagtccctcactatatcaatgggctgacctctgtctagcaatgaaattggtcctctccctactccagctcttccctcctctctagatgatcttaataataagtgtcgccaattaccctgcaaaatcagaccaaagcctaagaatcatccttggttcctctttttctcactgcccacatgcaccctacctgcaagtcctgtcgcatttacatccaaaatatgtcctgaatctaacaatttctctctagctctattgctatcactctagtctaaactattctctctcacctagactgttatcttgtacaactacctggttcttcctttatacttttgccgtagccacaatccatcttctaaagaatctaagtggcctttttcatataattgtcaaagtgactttttatcattaaaagtaaatcaagttatgttatccccatgggtagaatcctccaatgacttccaattgccactctgagtaaaatccaagcaacttatcatagcctacaaggccctcatctctggctcctgacccccttttcaagtttattttatactttcccatgagctcaatcagcagctggccttctttcagttcctggaacatacccagttgttttctccttcaggtgacttaaacttagctgttccctctgttgggaaattctcaaccccaggtctttccacggctggctcctttctaccattcaggtctccataaatgtcaccacctcagggacgccttctctaaccacatgcctaatatggccccactccctcaccagtcactatctaccatattaccctgtatttccttcacagtacttatcacaattttatttattaaatgaaatagaaaaattttatttaattattatatgtcttcctcattaaagtataagcttcataagggcttatatgtccatcttgtccatcaatcttcagcatctagcacaggatcaagtatgcatagatatttgttaagaatctcatgaataaataaattatacagacaaagatgatattttctcaataccccaaacctatagcagttctagaaagcaggtcagggtcaagcactgaaatattagatagaaaactaagcttgaataaaattattatatgactatatagtgaaaggaaatttattgaatgtggtttttgttgcagaaaaaaagaaagaaaaaatgaaatttaaattcattattctaattatgtatctataacttatacctttctaaaaccatttcatctcctaaaataaaaatatgtttgacccttagaattaaagtatataatcttccttagcaaaacactatctaagtcaagtgatgtactttcaaaatttttcttgaaaactccctggcccagcacggtggctcatgcctgtaatcccagcactttgcgaggtagaagcaggtggatccctttcagctcaggagtgagagaccagtctgggcaacatggggaaaccccacctctacaataaataaataaataaaaattatccaagcgtggtgcctcacatctgtagtcccagctcctcgggaggctgaggctaagagattgcttgagcctggaaagcagatgttgcagtaagccaagatcactcccctgcacaccagcctgggtgacagagtgagaaactgtctcaaaaaacagaaaacataaaaaaaaaaactttctatattatgccctcactgtagtctcttcacacttctattataacagctgttacattttactgaacatgtgtttttatatttattcattcatcaatcattcattaagtaactatttttagtgctcgatatcatagtagttgattaagaagcaattcctggccgggcacggtggctcacacctgtaaccccagcactttgggaagctgaagcaggtggatcactggaggtcaggagtttgagaccagcttggccaacatggtgaaaccctgtctctactaaaaatataaaaaattagccaggcatggtggcatgtgcctgtaatcccagctatttgggagcctgaggcacaagaattgcttgaagccgggaggtggagggtgcagtgagcttaggttgccccactggattccagcctgggtgacagagcaagactactctgtctcaaaaaaaagaaaagaaaagaaaagaaagaaagaaaagctgctgttggctgctgtggtcaagataagagatgaagctctgatctaaggctaggacaagaaaatgactgttttgagaactatatagagctcttgggaactaagcatatgggagggaggtagttggggaaggggaacaagaagttcagattcagatattttaagcatgagtaaccggattgatggtgataacaactagaatagaaaatgtgcaagaggagtcttatggaggaagcttgtggtctcatttttttgacacgttgattctgaggtatttgtgcaaaaaagtctctgggagtcatcaatatatgaaaggtagctgaaatcagaaaaggagagaatcatccatggagattcaaggaaagagaagagtggctacagccagtcaagaaagaggaacctgtggagatgacagagaaataatagagaaccagatgaataaacataaaggaatgttagaaaggaaataaatggtcagtggtgtcaaaagtcagctgaaattgtcactgatttttatttcagccatcctaataggtatgtagtgaaaacgaatcaaggttttaatttgtattaccataacggctaatgatgttgaacatctttcgcgtgcttatttgccatccgtgtatcctctatggtaaaatgtctgttcatatctttctttttgggaggagggggtttaaactgcactttatttgttaccataacattcttttttaactgatcaaccgtaagcatgcaaaaagttctcctctgaatgaaactgattccacagcctgttgtatagaaatgggtaaattataaaggtgattcagtttggagttctctccttttttatagcactcctaagctatgtgtgcgacacataccacagaggtagaaaggatcatctttaataaattatcttcttaattgtagagaatttctgaaaataaaactgacaaaatgctaaaccaagcctttgatgtgtcccaaaggaccacagatccatcgactcctatttgaagaagtaatcccctggagtgttctagcctttgaagggcacttgataacaagatccaccaaggctctgaacaactgcactaagaagccttctaaccgctctcatttgccgattctttgggccacccagtcctgctggcagagagggcagcgattgttctgtttcacccacagggacatgcagcagttgcggaaggaatgattacattctcccaagaccacaacacagtcctcttgtttgttttcagcttgacatctgagacaggcatccatcacctggactctgcagatggcgcacatatctcactccacggcccagctccacatggccaccacgttccacttcttgagctagaacatcttgtcgcctcccgacttggagcctgcgctcctggagtgagaggtcagggcgtagggttcctcgccgtcttccacgtcggccatggtagcgccgcggagccgatggccgacgttgggttggggaaagccggaggctgtggcggctctgtggctacagcgttaccttatctttcttctacctattttcttttcctttcttttttgagacggagtttcgctcttgtcgcccagactggagtgcagtggcgcaatctcggctcactgcaacgtctgcctccggagttcaagcgatctcctgcctcagcacccctagtagctgagattacaggtgtgtgccaccacactcagctaattttgtatttttagtagcgacggtttcaccatgttggccaggctagtctcgaaccgcccgcctcggcctcccaaagtgcttggattacaggcatgagccactgcgcctgaccgtttttacccattttcttttcctttttatttttattttattattttatttattattattattttttttttgagacggagtcttgctctgtcacccaggctggagtgaagtggcaccatctcggctcactgcaagctccgcctcccgggttgacgccattctcctgcctcagcctcccgagtagctgggactacaggcgcccgccaccacgcccagctaattttttgtattttagtagagacggggtttcaccgtgttagccaggatggtctcgatctcctgagctcatgatccgcccaccccggcttcccaaagtgctgggattacaggtgtgagcacccggcccgtttttacccattttctaatcagattttttgctttcatactgctgagtttaaagagttatttatatattctagatacaagtcctttgttggatagccaattcgtgaatattttctcccagtgtgtagcttgttttttcatcctcttaacagggtctttcactgagcaatagcttttaattttgatgaagtctaatttactgagttttaaaaaattttctgcaggaggctgaggcaggagaattgcttgatctggggaggtggaggttgcagtgagccgagatcgcgccattgcactccagcctgggcgacaaagtgagactctgtctcaaaaaaaaaaaaaaaaaaaaaaaaaaaaaaaaaaaaattctggattgtgctttcgaggacatacctaagaactctttgcctaggctagatttttctaaaagttttatagtttatgtttatcctatgcctttttctaaatttttttatagttttatgttttacatttacacctatgatcaatttttagttaatttttgtacaaggtgggagctttaggctgaggttttttttattttatggatatccaattgctttccgccattcattgaaaagactattcttcctccactgaatgattttcgcaacttagtcaaaaatcagggggatggtggcatgctcttgtagtcccagctactcaggaagctgaggcaggaggatcacttgagcccaggagctcaagaccagtctgggcagcaaagagagacccctgtctctaaaaaaaaagaaaaaagaaaaaatcagctggctatacttgtgtgcgtctatttctaggtcatctattctgttccactaatcaaagttttttaaaaaagacaggtagaggctgggtgcggtggctccgcctgtaatcccagcactttgggaggccaaggtgggtggatcacttgaggtcaggagttcaagaccagcctggccaacatggtgaaaccctgtctctactaaaaatacaaaaattagctcggcatggtggcaggcgcctgtaatcttagctactcaggaggctgaggcagaagaatcgcttgaacccgggagacagaggtagcagtgagccaagatcgcaccactgcacgccagcctagctgacaagagggagactgtgtctcaaaaaagagacaggtggaggtccaagagagagaagtatagaaaaaatatcttttggccaggcgagatgtctcacacctgtaatcccatcactttgggaggctgagatgggtttattacctgaggtcaggagctcgaggccagcctggccaacatggtgaaaccccatctctattaaaaatacaaaatttaggtgggtgtggtggcacatgtctgtaatcccagctactcaggaggctgaggcaggagaatcactagaacttgggagatggagtttgcagtgagccaggatcacgccactgcactctagcctgggcaacagagtgagactccatttcaaaaaaaaaaaataaataaataaaagaaaaaatatcctttgaatttggcagttagtagttattgatgacattcatgatgaagtgatggaattcctagaagccatattgccaagagcagtgggctcaggagtgaatgactgtatgcctggctaggaacaatgaggatactaaacacatacacgcaaatattaaatacatttggcaatttgtacattaaatatttattaatgttttgggaatgttgtgtatcagtaattatacctagtaaaaagaaagatccacatccaaattctccagaaacgggtggccaggtaaggaggaagaagagcattttaaaaaccaaaaccaaaacaaggaaaagctaaaaagagtttcttccaaatatcctgaattcatagaggttgaattcacatcttcagcctctatcccccaaagtgaattttaagggacttgagaagcttataccccatctgaaaacatgctgcatgatttcctctttcacgtctccagttccatacgtttctgttatcctttgctagtaaagaaattttagatgtttttgtctttccaccaatcatatcataagtcccctgttgccactcatgcagtcagtgtcttttttttttttaatctctagcacctagcatttggcaagcacataacagattctaaatacatatttgctgagtggctactatatcattatatcaatattagaatactcaattattaccctaatgaaaaagagagatggagttcctttataactgccactttgagttttttttcagttgtttggaataagaatgaaaatatttacgtaattaatctgcaaatagtgaatgccaacaaaaatgtaattcttaaaacccatattggccgggcacagtggctcaaacctgtatttctagcaatttgataggccaaggtgggaggatcacttgagtccaggagttcaagaccagcctgggcaatatagtgagatctcatttctacaaataattttaaaaattatccaagcatggtggcatgtgattgcagtcccagctactcaggaggctgaggtgggaggactgcttgagcctgagtggtggggctgcagtgacccgagatcgcaccactgccctccagccttggtgacagagcaagaccttgtttaaaacaaaaaaacaaaaaaatctatattgccatattgttgttcatgacatgtttgctcccttgggaagagaaaataaaaacctcagtttctaaatttatttattttctagaatgggacttagcaggtggtcttagatgaaactactttgcaataatttctttgaacattttcaaacaagaaatataaaaacttgaactcactcctttttttttcatttcactggtcatctgtcaaaaacaaacaggatataattaaatcaaggagaacattttaaaattaatttaaattgtttaaaaattaaatatatagtttaaatatatctattattccttttaaaaacatcagttatattgagattgtcttaactacaaattaaaatgatataaggataaactttttaacgagaaaacataaacttacagtttgaggataatcaggtggtggtaatagaggtgttcttttacccagtgttctgtctaaatttcttttggctccatcaattctgaaatttatagttagaaatatgactctcttgataacattagcataagttactaaaacattacaatttaagcatttttccaactatactaagagatattcaagagttatcttactgaattttttatgagaaacaaatcccaatagacattatcaatgagaccttaatttttaaataatgcatatatatgtaacagggtgaaactaaaaatcaaaatcaaattttttcaagtataacttactgaccatttaaaaattaatcccaatgaatagtgggcacttatatgtattatctctgttcaaatgtctgccggtctgtcagagaagcctccccgtacccccatattaagtagtacctccttcgatatccatcctttttatcctcacttatcttgcttcaaagcacttaccatcgtttgatatagaatattttgtaaactgttttattcactgtggttatcctcagtgcctagaacagtacctggcacatagtagctgctcaataaacagtttaccttcaaaactgttaagagattttttttgcattcataagatataattttctctttaaattaagttgtataatcctattgtataatcccttaatctgtcaataaatatttattgaatccctatattatgtaaatcacaatactagatcctattaaaatataacaacaaatctcaaggactgatgaactgtttaagtgagaagaaaaaaacagagtgccatataggtaccctgtggttcagagaggggacaagttagttcactttcatctgtgaaggccacatacatgttaccattagcaatgagctttaaatgaaagagaggatttcaggtggagacatagttttcctgggatctaaaaaaacaaagaccccaagaaacaggaaggcaaggaaaggatcaaagggggaaaaaggaagcaggggtcgttcaatccacccaaaggtgacagtgtcaagtggagataagtctggagaagtggattgaaatatccagctaaaggcctcaaaaacaagctttttaatccaatagacaatggggagtaatcgagaggttttgagcatggaaacatatttaggaagacaaatctaatagtctataatgctagatatactagaagagatggccaaagaaaaaagcatacaagggaaattaaaagagaattcagaaaaaattgtagggtgtcaagtacgacaggaatgacgaaaaacaacaattgaatgagcaaaggagataccatcaggtaggtaagaggagaaacaaaaaaaaaaaaaaaaagaaaaaaaatctgaaggaaagggtgtccactggagctataaaaccaaagactggtaagtagcataaagacaaggaccatgtctattttgctcactgctctccccacaccacttaaatagtatccatgaagatgtaggagctcaataagcatctggtgaatgaatgatcagaatagcatatttggaaatgatcttgcatatctagtttggtaccttacctaatagatgaatcctctcagcaatatcaagctgtacccatggtactccaggggcacagcttgagagaaccatgagagtactgtgagatgggtggggatgttgaaagagaggtggcagtcatcactttattttttaaatttttgtgggtacatagtaggcatatgtatttatggattacatgagatattttgatacaggcatgctatgcataataatcatatcaaggtaaatagggtatccatcacctcaagcatttatcctttgtgttacaaacaattcaattatacttttagttattttaaaatgtacaattaaattatttttattatagttaccctgtcatgctagcaaatagtatgtcttattcttttttttttttttttttttttttgagacagagtctcactctgtcccccaggctggaatacagtggcatgatctcgactcaccaaaacctctgccacccagttcaagcaattctcctgcctcagcctcccaagtagctgggattataggctcaggctaccaggcctggctaattttttgtatttttagtagacatggggtttcaccattttggccaggctggtctcaaactcctgacctcaagtgatccacctgcctcggcctcccaaagtgctgggattacaggtgtgagccactgtgcctggccttttttctttttttgtacccattaaccatccccaattccctcctctcatcttccccactaccattcacagcctctggtaaccagccttctacaatctatttccatgaattcaaagagtttaatttttagcacccacagataagtgaatgactttaatttttagtgcccacagataagtgaaaacatgcaatgtttgtctttctgtgcctgccttatttcacttaacataatgaccatccatgttgttgcaaatgataggttctcattctttttttatggctgaatggtactccattatgtatatgtaccaattttctttatccattcatctgggttttttgtttttgttttgttttattttttttaggtaagtttattagagaagtaaagaaacaaaagaatggctactccatagacagagcagcccattcatctgtttatggacactgaggttgtttccagatcttttttttttttttttttttgagacagagtctggctctgttgccaggctggagtgtggtggcgtgatctcagctcactgcaacctctgactccctggttcaagctattctgcctcagcctcccaagtagctgggactccaggtgtgcaccaccacgcccagctaatttttgtatttttagtagagacgggtttcacccagttggccaggatggtctcgatttcctgaccttgtgatctgcccacttcgacctcccaaagtgctgggattataggcgtgagcactgcgcccggcctcttttttgttgttgttgttgttttgttttgagacagagtcttactctgtcacccaggttggggtgtgggtggcactatctcagctcactgcaacctccgcctcccaggttcaagcaattctcctgcctcagcctcctgagtagctgggattacaggcacccaccgccacacccagctaatttgtgtatttttatcagagacagggttccaccatgttggccaggctcgtctcaaactcctgacctcaggtgatctgcccctgtttgctattttcatgtcttcttttgagaaatgtctatttagatcttttgcctatttttaaatcagattattagtttttcttttcctatagagtttgtaataggccattcttgcattgctataaataactaagacaggtgtggtgactcatgcctgtaattccagtcctttgggaggccatggcaggaggattgcttgagcccaggagtttgaaactagactgggcaacacagtgagactttgtttccaaaaaacaaaaacaaaggaaattttttaaaaagagagaaatatctgagactgggtaatttataaagaaaagaggtttaattggctcctggttctgcaggctgcacaggaagcatagcagcatctgctgttggggaggcctcaggaagcttataatcatggtggaaggtgaaggaagagcaggcatgtcacatggcgaaagcaggagcaagagcaggggtgggaggcacactttgaagcaaccagatctcacgagaactcactatcatgaggacagcatcaaggggatggtgcttaaccatttatgagacatctacccacatgatccaatcacctcccaccaggcctcacctccaatactgaggaatacaattcaacatgagatttcagtggggtcacacatccaaactatattagagttgttagagctctttatatattacggttattaatcccttgtcagatgggtagtttgcaaatattttttcccattctatgggttgtctcatcatgttgttatttcctttgctgtgaggaagctttttaacttgatatgatcccatttgtctatttttgctttggctgcctgtactcgtggggtattactcaagaaatcttttcctactccaatattctggagagtttcacccagtgttttcttgtagtagtttcgtagtcttagatttaagtctttttttaatctatttattttttttgagacagagtttcgctcttgttgcccaggcgggagggcaatggtgcaatctcggctcaccgcaacctccgcctcctgggttcaagcgattctcctgcctcagcctcttgagtagctgggattacaggcatgcaccaccatgcctggttaattttgtatttttagtagagacagggtttctccatgttggtcaggctggtctcgaactcctgacctcaggtgatccacccaccttggcctcccaaagtgctgggattacaggcgtgagccactgcacccggcctaggattgttttttctatatctgtgaagaatgtcattggtattttgatagagattgcattgaatctgtagatatttggggggtagtacagacactttaacaatattaattctgctgggccaggcgcggtggctcacgcctataatcccagccctttgggaggccaagggggggggatcccctgaggtcaggagtttgagaccagcctgaccaacatggagaaaccccatctctactaaaaatacagaattagccaggtgtgatggggcatgcctgtaatcccagctactcgggaggcttgaggcaggagaatcccttgaacccgggaggcggaggttgcggtgagccgagatcatgccattgcactccagcctgggcaacaagagctaaactctgtctcaaaaaaaaaaaaacaatattaattctgccaataaatgaacatggaatatctttccattattttctgggattttcaatttctttttttttgagacggagttttgctctttgttgcccaggctggagtgcagtggcatgatcttcgctcactgtaacctctgccatctgggttctaagcaattctcctgtcttagcctcctgagtagctgggattacaggttcccaccaccataccagctaatttttgtatttttagtagagatgaggtttcaccatgttggccaggctggtctcaaactcctgaccacaggtgatccacctgcctcagcctcccacagtgctgggattacaggcgtgagccatcgcgcctggccgatgaatgacctttttaatgtgtcgttgaatttgttttgctagtattttgttgaggatttttgtatcaatattcatctgtgatactggcctgcagtttcctttttttgatgtatctttgtctggttttggtatcagggtaatactggcctcaaaaaatgagtttggaagtattccctcctcctctatttttcagactagtttaagtagcattggtattagttcctctttaaatgtttaatagaattcagcagtgaagccataagggcctgggctttttttgctggaagacgttttattatggcttcaatctcattacgttattggtctgttcaggttttggatttcttcatggttcaatctctgtaggttgtatttgtctacaaatgtatccatttcttctagatattccaatttattggcatacagttgctcatcatagccactaatgatcctttgaatttctgcagtatcaattgtaatgtcttctttttcatctctgattttatttatttggatcctctctctttttttcctagtctggttaaaggtttgtctattttgtttaacttttcaaaaaaatcaactttctgtttcattcatcttttgtattgttttcttcattccaatgtcatttatttctcctctgatctttattatttcttttcttcagctaattttggtttggtttgctcttgtttttgtcatttgttaagatgcatcactaggttatttatttgaagtttttcttctttgttgatgtagacacttatagctataaatttctcttttagtactgctttcactgtatcccataggttttcatatgttgcatttccattatcatttgtttcaagaaaattttcaatttccttcttaatttcttcattgactcactggtcactcaaaagcatattttttaatttccatctgtttgtatagtttccaaaattcctcttgttattgatttctagttttattccattgtggtcagagaaggtgcttgatattatttcaaattctttgaatgttttaagttcaattcaaattttttgaatgtttaagctgggcatgagtcaccatgcccagccagtaataaaactctacacaccttgatttcatccccctgctttttaactttttgttgtttctatttatatcttattatactttctatgtctttttttttcttgttacagaacaataaacacctttattacataagcaaatacagaaaggatgaggatttatttgcctttctgggccttgattttccaaagataaaactccaactcccaggcctctagcacatagccatctgctgggccacactgctctggccttgatgtgatacatgccagatgcttgccctgctggaactgctcctccagaagactgctgattttggcattctttttcctttcatcatatttcttctaaatttttttagattgttttttgtttaaaatctcttcctcctcaggagtcagcttggcccccttcttgcagcccagggacaatgtatagtgggattttcaccactgtcagtagagtgtgctgtcactgagcacgatgcagttcttcaatagcatcttggtacggaccagtttgttattggacacactgtagacaacattgatgatccttgttttgcacctacatcacttggagccccaggagaaattccccacatccagcctcaaggtacagtatttcttgttacgtccctgcacacagactgtgtggacgcagcgggggccaatcttggtgttggcagcggggcactccagctcatacttccacttcttgtgggagggcttactcttgcccctgtcttgcagcacttgtgccagttgtcacgagagcccattgctcgacatctgtactatgtcttgaaaaattgttattgttttgattggttcatcttttagtctttctacttaagagtagtttacacaccacagttacagtgttataatattctgtgttttttctctgtacttaatattaccactgagttttgtactttcagatgatttcttgctgctcattaacatccttttctttctgattgaagtaccttctttagcatttcttgtaggacaggtctgatgttgatgaaatcctttagcttttgtttgtctaggaaagtctttatttctctttcatgtttaaagcatattttttccagatgcagtagtctaaggttccttcagcactttaaatatttcattccactttctcttggcttgtaaggtttccactgaagtctgctgccagacatactggagttccattgtatgttatttgtttcttctgttgcttttaggatcctttctttatctttgagctttgggagtttgattattaaatgccttgaggggccaggcgtggtggctcacgtctgtaatcccagcactttaggaggctgagggaggtggataacttgaggttaggagttcgagaccaacctggccaacatggcaaaaccccatatctactaaaaatacaaaaaaaatatctgggtgtggcggcatgtgctgtaatcccagctactcaggaggctggggcagaagaatcccttgaacccaggaggctgaggttgcagtgagctgagatcacaccactgtactctagcctgggcgacagagcaagactccactccatctcaaaaaaaaaaaaaaaaaaaaaaaagccttgaggtcatcttctttgggttaaatgttaaatctgcttggtgttctataatcttcttgtacttgaatgtcaattatctttttctaggtttgggaagttctctgatattatctcttggaataaaccttctatcctgtctctttctctacctcctctttaaggccaattactcttagatttgccctttggaggctattttctagatcttgtaggcatgtttcattcttttttattcttttttgtctcctttatgtattttcaaatagcctgtcttcaggttcactaattctttctgcttgatcaattctgtaattaaaactgctattaaaagaacgctgatccattcttcagtatttcaattgcatttttcaactccagaatttctgcttgatttttaattatttcaatctccttgttaagtttatctgataaagttcgaaattctttctctgtgttatctcgaatttctttgagtctccacaaaaccactattttgaattctctgtctgaaaggtcacatatctttgtttctccaggattagttcctggtgccttatttagtttggtgaggtcatgtttttctggatggtgttgatgcttgtagaagttcttcagtgtctgggcactgaagagttaagtacttattgcagtcttcgcagtctgggcttgtttgtgtctgtccttgggaaggctttccaggtatttgaaggaacttgggtgttgtgatctaagccatatctgcattagggggcaccccaagtccagtaacatcatggttcttgcagactcatagaagtatcaccttgtggtcatggataagatccagaagtattctctggattaccagacagaaactcttggtttttttccccttactctctcccaaacattcagaccctctctctgtgtgctgagctgcctggagctggaggtgggatgacacaagcactgctatggccaccaccactcaactgtgctaggtcagatctgaagccagcatagcactgggtcttgcccaagacccactgtatccactacctggctaccacctatgttcactcaaagccgtaggtctctacaatcagcaggtggtgaagcaagacaggcttctgtccctccctttcaggaggtgagttccccaagccccaggtgggtccagagatcccaactgggagctagggactggagtcaaaaaccttagaaatctacctggtgtcttattatactgctgctgggctagcactcgaaccatgagactcagtccttcctacttttccctcccctttcacaggcagaggagcctcaccccacggccaccaatgtcacaggcccatatggatcactgccaggctactcccaatgttcacttaaggcccaagggctcttcaatcagtttgtggtgaatgctgcgtggcctgggactcacccttcagggcattgggctcccctctggcccagggcaggtccagaaatgccatccaagagccaaggcctagaatcagggaccccaagagcccgcttggtgctctaccccactgtgccctacctgctacctaagacgcaaaacaaatttccctttactttttcctctgcttttttcaagcagatggcatctgtcaccatagccaacagggctgtgaatgtgcttggcctaacctggataatttcagacaagccagcatgcctcagagtctcactcaaggcccacagtgtactacctgagtattgctgatagttattcaaggcccaagggctctttagtcagtaagtgatgggtcctgccatgaccgcatccttcccttcaaggcagcaggttcccttctggccaacgatgtgtcaataaatgtaatccagaagctagggcccagaatggggttctcatgactctgcctggtgccctatcctagtgtgactgagcgggtatcccagatgcaagacaaaattctctttgctcttccctttcctctcttcatgcggaaggaagggtctcttttggagctgcaaactgtgcagcctggggttaggggttaggaaaggagtggcacaagtactcccttaacagcacctgctggtgtctcagtaggtcatgtgcccctgcagtccactggatctgagctcagctcagcactaggacttacctaggagttgcagtccttgtggcctagactgcctttcaagtttatttagggccccagggtactttagcactccatgataaggcttcccagaactcaagttctgatcactgggatgtgcgattcccctctggctggggctggcctatatgctccctctgtgggcaggcatcacctgagttcagctcagttttgctttccactgtgacaaggcagcattgagttcaatgcaaagtctcacaatcactgcactctccatccccaagtgcacagattctctctccatgccatgcagccactgctgggattgggggtgattggtatcagcaattcaagactctttcctgccctcttcagtgcctttcagtaatatgaagttaaaacaaggtattgtgagttctcatctgattttttggttcttatgaaggtgtttttttgtgtgtagaaaattgttaaattttgtgttcctgttgaggggtatgttcagtggagccttctattataccatcttgctctgttcccccaccccaccaccaccatgatcactttctgaggtagcccaatttattgttagctagctttttttttttttttttttgagacagagtctggcccagttgcctgactgaagtgcagtggtgtgatctctaatcactgcagcctccacctcccaggttccagtgattctcctgcctcagcatcccaagtagctgagattacaggcatatgccaccatgcccggctaatttttgtatttttagtagagatggggtttcaccatattggatagtctggtctcgaactcctgacctctggtgatccacccgccttggcctcccaaagtgctgggattacaggtgtgagtcactatgcctggccagttagctcatattcttagaaacaaatttcttatattgagctgtatgtttgtaacttctagtctctgaagctatacagaaaaaagtcatattctttgttcatgtttacttatctggttcctttaattattcctgtcaatgaattactgtttattatgagtttattatgttttaggcataggcttaagatctttatatgcatttaattctcacaacattcctaaaacatacacactatttctatctccatattaccgataggaacatgaagataaattaggtaacttgccaaattcacatggttaataagctgcagagatggtatatgaactcaggcctgattgatggcagagcctatagtctaattaagtgaatcagcttccttcaaatttcctcactctcctcttgctatggtttaaatgtgtcccccaaaagttcacgtgttggaaacttaatgcctctgtcctcatgaatgaattaatgggttaatgagggctgtgccctcatgattggatcaatgtcactatcaaagaagtgggctcattatcattggaatggctttgttataaaagcaagctctctctgactgtcttgccctctcaccatgtgatgctttccatcatgttatcactcagcaagaaggcccttacaagatgtcagcactatgctcgtgaacttcccagtctctagaactgtgagctaaataaacctctattttttttatattttattttattttattttttatttttaagacagagttttgctcttgttgcccaggctggagtgcaatggcatgatctcggctcaccacaacctccgcctcccgggttcaagtgattctcctgcctcagcctcccgagtagctgggattacaggcatgtgccaccacacctggctaattttgtatttttagtagagatggggtttctccatgtcggtcaggctggtctcgaactcccaacctcaggtgatcctcctgccttggcctcccaaagtgctgggattacaggcgtgagccaccacaccccaatttttttttttttttgagacagagtctagctctattgcccagctggagtacagtggctcgatctcagctcactgtaacctcggcctcccgggttcaagtgattctcctgcctcagccacctgagtcgctgggattataggcatccgccaccatgcttggctaatttttgtatttttaatagagacggggtttcactgtgttggccaggctggtctcgaactcctgaccttgtgatccacccaccttggcctcccaaagtgctgggattacaagcatgagccaccacgcctggcctaaacctctattctttataaattatccagtctgtagtattcagttatagcaataaaaaatagactaggatacttctgtagctattctagtttatcagtgtccctctttttatttttattttatatggaacacctcacaaatttgtatgtcatctttgcgcagacaccttactaatcttctctgtattgttccaatttttgtgcatgtgctgccaaagtgagcactcaaagtccctcttaaagtgtgatcccagaattccatatgtttgaccagtgcagagtgaaaattttctctcccatttcctagacatgctacatttattaaagtatcctaaaactgaattagcctttttgagcagcctcatttccctgttcaatcttactaagcctgtactaaactaaaactcctaagactttctcacatgaagtagaaaatgtgcctggatatcctcctcctttctttgttaatcttcaagacgttggccaggcttcccttcatccatcatttctccctaaagagtctagctctcagtgattgctacttccaaggaatttaccttatactttggtatgcactagttggcactagtcatagttagccttgcactgtaattatcccaacataaatatgcctgacttccggttctttatatatgaatgccaccctttaacatagcaacaatttctggagcatgttttctcctactggctataaataaaaagagctgggaagaacatacaagtgagccttttcactacctgactgtttttgatttgtatattagcgattataaacaggccgggtacagtggctcccagcactttgggaggccaaggcaggtagatcacttgagttcaagaccagcctgggcaatatggtgagacctcatctctacgaaaaaatacaaaaattagccaggtgtggtggcgcacacctgtagtcccagctactcaggaggctgaggtgggaggattgcttgagccaggaaggcagaggttgcagtgaacagagatcgcaccactgccctccagcctgggcaaaagagtgagaccttgtctcagaaaaaaaaaagagggggtggcaaaaacatgaataatcatagctaaactaaaaaattttgtaataaaatcaaataaataaaaacttgataatttcaaatgactgggtgagaaaccacatgcagtaaaggagagaaactggcttgaatcaagagatgaggtagtagctaaggaagaaggcaggctcattcttgagactctggaaagctacaaaatgatactggctcagccaagcattcccagggactggtcctagtagggggtccacttctgcccatgactctttacatcctacctcaccccaggaactccctctatccacagacttcactccacctttgaaaaagagaagtctgcgctcctgtcatctaacaggtgcagatagcaaggggatggagaatcccaaagtccatggccacccagaaagatatgtttgcagtttttttaaaaaacctttaattttatcaggtattttttaaaaaatggtttctaaaagtttttttttttttttgagacagagtcttgctctgtcgccaggctggagcgcagtggcatgatcttggctcactgcaacctccgcctccagggttcaagtgattctcctgcctcagcctcccgagtagctaggactacaggcatgcactaccacgcccagctaatttttgtatttttagcagagacggtgtttcaccatgttggccaggatggtctcaatctcctgacctcatgatccgcccgccttggcctcccaaagtgctgggattacaggcgtgagccaccacgcccggctgaaagtttttgcattagacctttggacagctaaaaatgagtttgaaatccaaggagaataaaccaaatatacttaaagtttttgaaagtagcgaaaagaaacacacacaagataaagttagttttcaaagaatgagcttattaataaggagaaggaaaaaaatgaagtggaattcagtaagaggtaaagtttagcaaagtgagcgctgactgaagtaacattttttttcttttaaatgaacctaacattgtgaacatatccaggaaaataaaacaaaaccaataattcaaaatgcatttttcccaaagaaatgcctagcaattctaatctcagtattaatacagcactatgcttcaggtaattttgaggcagtgtttttaaattaagcaccaaaataaaagttgtactacttacagatctgtataaagcacaataaaggcaaggttcttccctaaaaattcattcatcccttcattcattcatcaacaataacatgccaaaccctttgatttgtgttgagatccctctccttaagcatgtcaaagtggagaagacaacaaagaaaataaaagtacattgtgttataacatactctgtgcttatgacatcctgctcttctgcttttcctcctgccttaccagttatacttacactacctgctggttgacttttctccgcacatctaaccttttgccctaggcctttgcctttctcagttcacttgctcacttgcgctctctcctgtgttctctcttgcctaactctcactctcgctctctctgtgattccaacaattccctatagctttaaaaatcatctacatgctggtgactcccaaatttttacatctccagcctagacttcttctcttatatatccaactgctattaatgtatttccctttaaatgttatatggcacttaagctccaaaagagaattattgctttttaccccccacctcctggacttcctcaattctctataaatggtactactatccacctagctaccaaagctaacccaacagccaatcctactgattctgcctctgacacacatctcttgtaaacctactttcctcctccactgtctccagccttatccaaaccaccataagttctcatctatgctactgtagtggcatcctccctggtctctttgtgtccccctattcctgccctcttcctctccacctcagtctattcttaatagccagagtgatatcttttaaatgtaaatcaggtttcatgtcacttccttgtttgaaacatttcagtagtttccactggacttaaaaataaaatctgaattctttgtcatggccgacaaggccctacactatctgctcccacctccctctccatcttcacctgatactacccttccccaggttcatgatactctagagatgttggtctttgtcagttcctagaatgtactgaaagcattcacatttcagggatttcatgcttgctatcccctttgctagagagcttttctcatgtttacttagatgacagtcttcttctcattctctggatctctccttacatattacctccacaggcctttcctgtggtgctcctgggaatatcttctctctatcccactgtcttatttctttccttttccttttttttttttttttgagatggactcttgctctgtcacccaggctggagtgcagtggcacaatcttggctcactgcaacctccgcctcccaggttcaagtgtttctcctgcctcagcctcccgagtagctgggactacaggtgcctgccaccatacccggctaattttttgtattttttttagtagagacagggtttcactgtgttagccaggatggtcttgatcttctgaccttgtgatctgcccgcctcagcctcccaaagtgctgggattacaggagtgagccaccgtgcccggccccactgtcttatttcttcgtagcatctatcatcatctaaaaggttaacatgacttttttgttttttacatatttactatctgtttcctctcactagcatacaaacaacttaaagacacaatcctttctgttgtgttttcttttttcttttttttgagatggagtctcgctctgttgccaggctggagtgcaatggctcgctctcagttcactgtaacctccacctccccggttcaagctattctcatgtctcagcctctccagtagctgggattacagatgcccgccaagacgcctggctaatttttgtatttttagtagagacagggttttgccatgttggtcaggttggcctcgtactcctgacctcaggtgattcacctgcctcggcctcccaaagtgctgggattacaggtgtaagccaccgtctgttgtgttttctatggtctcctcagtaacaggtatctgtgtaacagcagatacttactatctgctaaataaactgttgtgagagaaatgcgtgcatgaaagggattaggagaaggctttctagaggaggtgatccataaactaaacctggaagaacaaggataagtattcaggcagacagtgcagtgagggaaattgcagagcgtatctctaaactgtgaaaaatacagtatatttgtgaaactgcaagcagttcaacatgataatgcaagataatgaaaagttatggagtaaaaacaatctaggcctgatgcagtggctcatgcctgtaattccagcactttgggaggccaaggcagatggatcacttaagcccaggaatttgagaccagactgggcaacatggcgaaaccatgtctcttcaaaaatacaaaaaattagccaggtgtggtggtgtacgcctgtagtcccagccacttgagaggctaagatgggaggatcacgagagtccaggaggttgaggctccagtgagctgagatcgtgccactatactccagcctgggtgacagagcaagaccctgtctcaaaaagaaaaaaaaaaaggaacaatgtataattcctagagaactcccttctctaaatctactgaaacactgaatagaatcttaggaatgaaggaggaatgcatctctccccctcccttttatttttttgagatggagtctcgttttgtcacccaggctggagtgcagtggtgtgatctcagctcactgcaacctccccatcccaggttcaagagattctcctgcctccgcctcctgagtagctgggattacaggcacctgccaccacgccaagctaattttttgtatttttagtagagatgggtttcaccatgttggccaggctggtcttgaactcctgacctcaggtaacccatccacctcagcctcccaaagtggtaggattacaggtgtgagccactgcacccggcctctctttttcttttaagactatttttgtctgcttgtttgagatagggtctcatgccattgctcattgctgggagtgcaatgatgccatcacatcttgcacactacagctttgacctcctgggctcaaccaatactcctgcctctgcctcccaagtagttaggaccacaggcatgccccaccacacctggctaatttttttttttttatagcgatgagggtctcactaccttgctcagactcatctcaaattcctgggctcaagcaatcctcccactgtggcctcccaaaatgctgagattacaggcatgtaatcttttttttttttctgtctaagtcttgaatacttaagcatctctaatagtacatatactgatattagtttatataccctataaatgtatatttaaatatgagtaaattattgctggactaatacaaatgtaaatctaaagaaggtatatgattaatagacctgtttaattgtaaggaaagtaaaattagcaaaaattaaaattattaaattggcaatgatacttagctgcaaaaaaaggtttttaaataaggccgaccaagaaaggaaagagaatgtagaaagggaaacagaaatccaccaaagagaaaacctcattttatagtttaagtgttggcttggaattttgtaaatgaaatccatgtatttttctttttatttatccctagaaaccagcagaatcggctgtctaggaaattctcagtaactgtctaattgaactgaaccaacctcatcacagcctttggcagcaggtacccaaattagttttaatttccactaaactggggggggggggggcggtgagtaggatgttgaactctgtttccttttgtagcaaaaaaatttcaaatataagtagtttcaagatattttattaagtatttgttcaaattgtaggggttcagttatttgattttactttcagggaccagtatggttataatatattgaaaggaggaataatgtggtgcttaaagaatgtgaactttagaaccagaccaaccaggtccaaatcccagctgtgcaaccttaggcaagttacttaacttctctatacctcagtatactcatctaaacaatggagctaacaatagtacctaccttataggattgttgcaagaagtataggcgataagaacaatgtctgtcagtgtacagtgtataatatttgctaccattacaattacttttcaattgtttttctaattaacttgaaaatagtattttacccatgaacaacctccacagttaaaactttttaggagaatatgaacactaatcattttacttgaattccaagcaagaattatctactaatatgctacttacactaactgattaattttctgctgctgctccttggatcttctgtattttagcagcttactttgtgttggtgtatcaacgcctatgttttctgggagatggacaatggggggtaacttcaagttcagagcttccttttctgctgcaatggcagctttgtttgcatctgacatcttgatcccctaaagattaaaatactctgtactctgaggagaaaaagtccataaagccattattatgtcagcaagcctcgacacattcataacatatctaacatatcaataccaaaagtaaaattctagacacttttggatcttcctcccaagtatggtattagtctaaagaatgacagttgaggtaagttggcagggattcctgttagaactctaaaactcacttatgaagcaatgagccagtcagttccccttcagggcttgtttcctaatggatgaaactaaggaattgaattagatgctctgtaaatatccctacagctgtagcattctgggtgcaaaattttcccgagatgcaaaccactaccaccaccaccacaacaaatccagttgttgagggatgatccccttcccagtaaaagctgatatttaacatcattaatggtttttttttttttttttttttttttgagacagattcttgctctgtcgcccaggctggagtgcaatggcgcgatcttggctcactgcaacctccgcctcccaggttcaagtggttctcctgcttcagcctcccgagtagctaggactacaggtgcgcaaccacgcccagctacttttttgtgtttttagtagagacagggtttcaccatgttggccaggctggtctcgaactcctgacctcagatgatttcccgcctcggtcccccaaagtcctgagattacaggcgtgagccaccgcccccagccaatcattaatatttttaaacatcagtatgatatcttagtcttgctgccttccaagaaagtgatgctatgatcaagcaaaaaataggcatacttgatgcatggcaaatataaaatgtcatgtaaatgctcaaaaattttactgtgggccaggcgcggtggctcacgcctgtaatcccagcactttgggaggccgaggtgggcggatcacctcaggtcgggagttcgagcccagcctggccaacatggtgaaaccccatctctactaaaaatacaaaaattagccgggcgtggtggcaggcgcctgtaatcccagctactcaggaggctgaggcacaagaatcgcttgaacctgggaggcagaggttgcagtgagctgagatcccgctaccgcacttcagcctgggcgataaagcgagactccgtctcaaaaaaaaattgtactgtgataacaactatatttgccatgaatgcctacaggatttggagattcctgccttgaaagagtgtttaagttggcacccaaatcgcgatacctgccctgggagagaaaggaagagaacagcagagaacaagtacctgattgtttctcactacttccccgctgcgcagacgccagagagagagagagacagtcagagcctctcctcaggtgaaaggcagggggataacgagggagaaacctccggaacgccaccggctctcaaacgagtagctggagaagggc

SEQ ID NO: 2482 - DNA, 315459 bp, Homo sapiens
ccccggggcagcgcaaccgctggggccggcctcagtgggctgagtggtcggggcatcggggcccagagagcggctggtgagtacttggtcggagcgcgctgtgagcgcccggcccctgtccgggaggccctgatgcagccgggttccccgcccactttccttctttttaggggactggaatccacgctacagttcagtcctccacctctgttagttgaacccagggaacccctgcttcaaaaccccagctgagtcactaccctttgtcagtctctacactggacatctaagtgacttcacacccactccccgttttgagactagaaaaccaaataccgcacgttctcacctatgagtaggagctaagctattgctacgcaaaggcatccagaggggtatagtggacttcggagactcagaaggggaagggtgggaggggggtgagggatgaaacaactacatatcgcttgcaatgtatgctacctggatgaccctgaagtctcagacttcaccactatccaatgcatccatgtaaaaaaaccacctgtacccgaaaagctattaaaataaataaataaataaataaatatatatatatatatatatatatatatatatatattttttttttttttttgagacggagtctcactctgccgcccaggctggagtgcagtggtgcgatctcggctcactgcaatttctgcctccctggttcaagccattctcctgcctcagcctcccgagtagctggggctacaggcacccgccatcacgcccggctaattttttttggtattttcagtggagacggggtttcacagtgttagccaagatggtctcgatctcctgaccttgtgatccgcccacctcggcctcccaaagtgctgggattacaggcatgagccaccacgcccggccatatacctatatatttttaaaaattcaaaaataaaacaaaaaaaatgcctctccctccggcttatttcccgttcctctacccttctcattcccctctagcccaaaagtctcatcactgaatttaccacttttcccaagatagttgtgcctctttttgcttctctgcttttgtacgccactgttcccaccttctgcctataatgtttctctctcccatcctctcctgacaactcttctttagacccgactcgggtggtaccttctccgtcaagttttctttctttctttttttgtttttcagaagttttgctgcctgctaagctctcttagcccttcgttaattcacctgtcattgacattgaccatcttgtgttgtattcaatagtctgtcacaccaatttgattgtgcattttgctttggagaagtccttagtcttttatgtagccacagtggccagacatgcagaagacgttcaatattgctgaatgaactaatgcatttgggatagggttacagaaatgggtgcaagagaaaagggtgtggttgaattggctgtacccagcacacaggtatgcaacttgctcacttactgtagtattcctaggaggggaggagttcaacacctggaaatgctcctgaaaataaccaggatgcatttcttgttgactttgcagaagttcactgaatccttaaaatttaacttaagaagggatggtgggaattgaaaatgattgcatccagcctgggcagcatagtgagatcccatctctacagaaaaaccaaaacccaaaccaaaaaagaacagccaagtgtgattgtgtacgcctttagtcctagctacttgggaggctgaggtaggaggatcgcttgagcccaggaggtgaggactgcaatgagctgtgctcacatgactgtactccagcctgcacaacagagcaagttgtctgtgaaggagagaaggacccagagaaagtgaacaagtgttgatgccacattcactctgtgtgctttgcatcagcagaatgtgaatgcttgggggtagattcgtagggaatttcaggtcttatttatttattttttaagataggttctcactctgtcacccagactggagtgcagtggcgccatcttggctcactgcagccttgacctcctgggctcaagctatcttccctcctcagccctcgaagtagctgggactacaggtgcacgccaccacgcccggctaattttttgcatttgttgtcaagactgggtttctccatgttgcccaggctagtctcaaactcctgagcttgagctcaggagtttgtatgttacagtatatgatatgcacagatgtaatacaactaaaatgtacacatgattttttttttttttttagaaaagaaccatacagaaagttaggaaattggaaagtaaaaattcttcttctacttcccttcttcaatttctttcactcagagtgattcttattaataatttattgtgtattctccctagaaagcttataatgtactttatcaaatctaaactattactgattacaatttttttgcaattctgtacatgcaaattaggtattttatgtaactgcataaagaaaaaaatgctgagaaacaaaaaaatgctgcatattaaaccttcttaaagtatgcatcttagaattgatgaaataccgtatatacacatatacacactttaaaaattttatgcgagtggtgttattatgcaatgtgtcttgctttttatgtaacgatgtgtcttggagagttttacatatctgcatatatagctctacctcattctttgtatcgctaatgatgcattaaaattttattgaacaagggtagtacagaacaattagtgggcccttcattaagggacatcttggttgtttccaaggtgtgggtatgtgtctgtgtgttttcttgcttgtttttgctattacaaacatgttgtagtgaaccaccaaccttgtgtgtatgtgtgtctgtatatatattgtatatctatctatatatagttggtaagattttttcatttttgctacagtttttaggaattcctctatataaagtagttgcatacatcttctaacctaaaattaaataattgcatcactcttataagttgataagttgatcttttagtatttagagtttgttacctgccaagcaatatttgacactcaaaaaccatgtagaaaatgcatctcaaattacagtatttcattagagggaaagttatatgatttccttaaggaaaatctctccaaaatggcagtggtcatgtatttatatatttattttgggaatcttagctatatgatctattttaacaaaatttaaactataacaaattatttataatttatttttttctgagtcacaatagggattaatccctgattatcaattttcagtgttcacagacacttgtattcgcagaaacagagtctgtatgtcagtgttcacagtcacaaaagtctgcttgtataaaaaccacatttattatttatcttaacagattctgaatccttgctgtttgtggtcttttggaagaatgaatatgatatgatgtcgttctaaactttttttcccaaccaaattttccctgctttgacctgttcatagctttttatagtttacctctttacttctctgtttaaatttcttccctctgcttcttgttgactcctacttatcctttaaggccaactaatgttcaaatcctccatgaaatcctctttgtctattttgtccacgtttctctcttccttctttaaattcctttttcagcagaacatcacaatttaacattcttgattgattcatataggttactttatctcctaaatgagactgaattcttcaggaattcttgtctgggctggatttcaggcaagacatctagggggtgctacattagctgtggttgctgagcacttgtggcttgaagtagtctttttttctgacttttattttggattcagaggatacatgtgaagatttcttacaaaggtttattgcatgatgctgaggtttggagtatgattaaacctgtcacccagatagtgagcatagtacccaataggtagttttccaaccctaacccccatccttcccttccccttcttgtacccccagtgtctcttgtttccatctttatgtccatgtatccccagtgtttagtccctacttataagtgtgaacatgaggtatttggttttctgtttctgtgttagttcacttaggataatggcctctagctgcatacatgttgcttcagaggacatgtgttttttttatggctgcatagtattccatggtatatatttcttcatccaatccactgtgaagttgtattcttaagacaagaggcagggcttctccagagacctggagggggtgtagctaatgcagctgatcattacagctcattccctctagcatcagaggaatgcctgggctgctgtttcacagatagacgcctattctgcccagcattagagttgccaccaaagatttttactgcgaatgggctaaccattaagctgcagccctaaaaccctaccaagctcaaaaatgcaccctgacattgtgtttcaaaatggtggcacagaagcaagctggctgtttcttctcccttaccaccagaaaatggaaacaaatacacaatgttaagattatcaccaacaatatcccaaaactcagatataaggatgagatcatttccagtaccacagagaagtgaaaaaacctctaagcagatggtaagagaattggactttcatagcatgacactccttacctcagtctgcctggcaccaggcaaatggaaaatttctcccagtcttacggtttctctaatgggaaaagtgagattgaagtggacaaccaactttcctaccatcctgggtttcatggcaggagacctgttcttgcctcaaaccacaggaagtatcagcagtgctaaagggagaaatatccctgaggacagccagagatgaaggagggagataggactaccatccccattcctggaaactctgctctgtaacttggccaaagaagacaccaaatcagagttgctgtttggcagtaccatgctgtgggaagctcatcccacagttcccttaagcatgaacccctagccagcattcccacactgctgggataatccttttaggacttcccccattttggatgggcagcaatctgattgtttactagaaccgaggcaaacccaggcttaagccgacatctagtgctggaaatgagtcagtgacctagtgaaaaacaaaagaaaatctacaggtaaattgtaaagactctctaagcagacatatccaataaaaaccaaaaccagccagacagagaagactggagtaaataattaatccttcaacacaaagacatacacatacattcacaggaaaaaatagcaaacagaggatcatgacctcttcaaaaggacaaagcaagaaaccagtgactaaccctaataagaaggcaatatgtgaaccctctcaccaagaattcaaaatagcactgaggaagctcagtgatctccaagataacacacaaaaaaaattcagaaatttatcagagaaggttaacaaagagattgagattaaaaaacccagaaattttggaattaagaaagagatttgctgagctaaaaaacttattagaggttctcaacagcagatcaagcaaagaaagaatcactgaactcagacaggttgtttgaaaatgtgcagaggagacaaaaggaaaaagaatgaagatgaacaaacttatagaaaattacctcaaacgaccagatttaagaattattgagtttgtgaccagtctgagcaacagagtgaaaccctgtctctaaaaataaaaaataaaaaaattaggcatgtatcgtggtgcattcctgttgtcccagcaactcagaaggctgaggtgggaagatcacttgagcccaggagcttgagtactggtactgtttggcagtaccatgagaccagtctcagcaacataatgagaccttgtctctatgaaaaataaaaataataaacaaacaaacaaacaaataaataaattagccaggctggtggcatgcacctgtagtcttagctacttgggaggctgaggtgggagggtcacaagcctgggaggtcaaagctgcagtgagctatgatcacgccactgcaccctagcccaggtggcagcgtgaggccctgtcacaaaagagaaagagagagagagagaggagagagaaagagagaagggggtggggagagggaaggctaaaaaaaccctgctgataatttgggaacaatggttcatgttgacacattctaggggacagtgggtgggtaaactggttaactagcagctaaaagataggtcagtttgtccttgagtaggccaactaagtgtatcaaacaaacaattatagctgtttatgagttctctggaaaacttggagagagcagttgtggggcataggtgacaggctggctctgtgtagtatctactgttgacccatcataagaagctccatcttgcttaggccaggtctgcatctgtgtcctcagaatttctcactagaaacctctttttctgtcttcttacgtgtttgggaatgtatccttttgttctccaagtatttactattattctggtttctggattttaaccacatcctgaaaacatatttatttggttggaggcatcattattgtcctacaatatggtttttgtctgtaactgacatctccttttccactggcgtcccctaatttccatggttatgtgctcataacttctacacttcttcattattagagcttttctgtttaggcaggctagatttatgctctctatagtaccattgcctcaataaatagtcacaatcacttttcagtgtgaactttctgtttggacttggggttatttattttggctgctaagaggatgttttatgcttttatggtagatgagatggcagacagtagaatgtctgattaatgaactgtattgcattacatagttccttgaagcaaggaacctttagagttcacgaagttctttgcttggtctcttgcacagtgagtacctcggcagtgatctacagtctgtcctctaattcagtggctctcatcttttttttttagccctaaggcacctcctcaggtgccctccaatgaattgctggggttactatggcagggatgggatgtgtgtggagggacagtcccctagagccataacataatcaggaggagcacttaaagtctgaaaaagctcccaggtgggtgggggtgtgtgtgtgtgtgtgtgtgctgtcctcactaaaaatatcacctctccagccccataaactaagcttccttagataatatggcaagggagaacttaatgattttgctacttgtctagctaaaaggggagtaataaaaacgtacaacactcaatttactgtagttttaaacgaacctatgttataattctaggtttcgaagtataaagcattccgcacgacgggggatggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggtttgcttctaatacgatttttcatgtgtgccacttttccttatcaaatacgaaatacttttactttacaaagtatgaaacagtttgatattttttcttcagaattgcaatttttgaacttggttttcattccttaggcaagatttagagaggcaagggaaagccgaagactgaaaattgacccttcatacaaatatatatttgaaattctagcagaaaatcttggcctggacatagtaactgttgaagaattaattttggattgcccatctgtaagtttaagtcttatcattatattttaattgccctttgagtaagtgattaacttaagaaaatagagttgtcataaacagcaacaacaacaacaaaaatcattcagaaagacaaagttggggcagggcacagtggctcatgcctgtaatcccagcactttgggaggctgaggtttggggattgcttgaggccaggagtttgagactagcttgggcaacatagcaaaactcctgtctctgcaaaaaatacaaaaattagctgggcatggtggtccgtacctgtggtcccagctactcaggaggctgaggtgggaggatctcttgagcctgggaggtggaggatgcagtgagtactccagcctggctgacagagtgagatgctgtctaaaaaacaaaaaagaaagaaaaaagaaaaagacaaaagttggaattttactgactagaggagaaggtttagtttatataattatagccagttgaatggtatttctttttaaatttaattaattaattaattaattaattaattaattttttgagacagagtcttgctctgtcaccaggctggagtggagtggcaccatctcggctcactaaccttgccttccggattctcctgcctcaggctcccgagtagctgggatttcaggcacgcaccaccacgcccagctaaatttttttttgtatttttagtagagatggggtttcaccatgttggccaggatggtcttgatctcttgacctcgtgatctgcccaccttggcctcccaaagtgctgggattacaggcgtgagccaccgcacctggcccagttgaatggtatttctaatcaggtttactgttgtggaggaagaagagaaaagttagcaactagaattttggctaaacttctaattcagaatgatgtcagaagttagaggcatagttgagtggtgacggtaggtaatattttacaagtacaggttatatgaactacatatgcaaatcacttgtagagaaaagctgcataaataagtcaggaaacagtgactattgtatgagtatacggtagtagaaatagtgatgtgattgcaggtcaggttactatatgtctcagtgtgccagggacagttctggattatacctattttcctggcatgattaacagtacctcctgacactactaacagttttggatgataaattgatgcggtcaccctaattatagtaatgtatgatacacttgtgtcatagcttccctcgcgatagctctggttctaagataattttcaataaaactaccactaggttcttgggctttttctgaaccctaggagtggactgggctggtatgccagaaagaccagtgagcaggtgcagactgctggtgagctgattgtctcactgaatgcactggtgagagagttggggtgaggtggggttgtggtgaggttgtcaccatgggggccatatcccctgcttttataggggtcatcaaacatgggcaaaactctttagcttgctctaggagccagggttctatggaaccgtgcctaaaagagctactcccggccgggcgcagtagctcacacctgtaatccaagcactttgggaagctgaggcgggcagatcgcctgagatcagaagttcaagaccagcctaaccaaaatggtgaaaccctgtctctactaaaaatacaaaaattagctgggtgtggtggcatgtgcctgtagtcccagctactcaggaggctaaggcaggaggatcgcttgaacctgggaggcagaggttgcagtgagccgagactgtaccactgcactccatcctgggcgatagagtgagactccaactcatataataataataataataataataataataataaagagctactcccttgcttgatacagtgcattgctaaattctgcaaaattgtctgcgcttcatgtcgtccagtatccttataagaatgtggtcctggcagttctctgacagtatgaatgggattgctcattttcttggtcctgttgtgtagctgtaacagtgagatggggatgtgattgatgcaaagacttcaatagctctaagctattataatgacaaagtatagagaatgcatggagatgtgtacgtaaaacaagaggtgtcacagcaagcaaccggaagtaggttgtggtttcccaggtcaccaaagttccccgctggaatttactgctgtggtcaaggctggcttcatggatatattggctgtgtagttacagaggcccctgtgcttagaatgtcactatgcttggtttgatgatcttttgtcaccattttgaagttcttgataattttttggtaaatgtctcccattttcattttgcactatgttcatcaaattctgtagctggtcctgactgtggacaatgccaaccaaatagtaagaggattttctttgccattcacaagttgggtttgtttgtttaatggtttcctttccccagtgactattctagtttctgtggtgactttggctacatgtctttctagcctctctaagcaattggtgcaaaacaaccttatacacatccctgagatggtgacaatgagaggaagggaaggccaatttctaaaaagtcatttcttagtaggcccaggctttaggcctgtcccgaggatcagtcctgcatttggctagggaggaagccagatgagtgatcaattttgtttcacctgaaaattgctgggccacagatttggataacaccacaactggaatccctagaccttctgcaaagagtataggcataggcattgcggcctgatcactgccttcatgaaagggtaactgctagaactaagatgtgggggggagatgggcatctgcagaactggtagtccaactttaagtatttgccatctgtatttctgggttggtattctctgtttggaggaattcttactggctagcatgctagtcaggaagtagaagtgctatgtgcctacaaacccttctatttgctattcctggggtatgtctcagactttgggtccatgtggttagattctacctttaaggccattatggtccaggactgacactgcttaggctgcaaggaatgggaaatgtaggcattaaggaagaatcaagctgcaaaaggtatttccttaagagttgcttgtgagtgagcaaagccatggtggagggaaaatcgtgtacccagtagggaaaccagtgtcaaaacctgaaagattagaatgtttatttggttgaggggaaaaggcaaggatatatgataggttggatcaaggttggtgaccaggtgagtaaagagatggaacaaggaacaaggggtggcatgatttggtgtggtgcggtttaggaaattgggggtatatggaaaagtattctttagttttttttttttttttttttttttgagacagagtcttcctctgttacccagcctggagtgcagtggcacgatctcagctcactgtaatctccacctcccaggctcaagcgattctcctgcttcagcctcctgagctgctgggactacgggtgcgtgccaccacacccggctaatttttgtatttttagtagagacggggtttcaccatcttggccaggctggtctcgaactcctgacctcaagtgatccaccagccttgacctcccaaagggctgggattacaggtgtgggccaccgtgctgggcctggaaaagtattcttttaatgtgaagcctggcatgcaatccaggatgaaagcagctcagtaaaggcaccacaaaaaagtggacaacagagggtatgatggttactttgtttgcctctggatccattctccctttgtctctgccctgctctgtggcatagaaagctgaactctatggaatctatcacctgggctcccttgttctctggtttacacttggttcagccactgggaggcacagcaggaaatgggagggcagaaggggagagaagctccccacttggccctgttcctgactgtggttctctgctcccatagttatagctccctgagcagcctgcatctccagttctcaacctggccctagtcattctatttcctctagctctcaactcttcagtccttgggggatcacggttctccgttgttgctagtcccattgttgctgctagtgctgcagcttctcttaatcctcctctggcctctagaaatagtcttttattgtataaataaaatagcctttttatttataaagttttttcaaacacccctttgggtgtgactccttttcttgctaggaccttgaccaatgcagatgtttctgcaacattggcacttttaccccttcccactttcctgcccccttcattcagcactgctcaagatagtctcttttctggcttactggcaatgttttccagtgactgggtggcagggttgtggtacatggaaggagcacaaatttggacacccaaagctgaggtccaatcccaggttctgtgctgtgcgtgtgtgttttgggtccttaagttaatttttttttcttttgagacagactgtcgctctgttgcccagtctagagtgcagtggtatgattacagctcactgcagcctcaacctcccagactcgggccatcctccgactttagcctcccaagtagctgggaccattggcacatacctctatgcccagctaatttttttggtatttttatagagaggagatttcgccatgtttctcaggctggtcttgaactcttgggctcaagcagtctgcccacctgggcctctcaaagtgctgggattacagaggtgagccaccgagcctggcctacttaaagtctttttaccttaattttctcttctgcaagaagggtataataatgccactttacctagttgatactcagattaactgttggtaaaatgttatgtaatataagtgaatttttaatgcacagtcatgattttggcccatgatctcacatttactttgctagtctcatgagtacaatgtatctaaaatgcaaggattcattgcatttgatattttgatgtctttttatcctagtcatgtgcactgcttttgagaatttgtatgatttcaaagctaaagggtcagcaagaaagtactgatggagctgtgcaagaactatgtggacagcttttgtcccttttaggtggcaattatgtgagacccaagtatatacgggaggtggaagagtagagaacaaagggctagagttacgcacatcttggtggctctgttttatctcccagggtggtggttctcaaatgtggtcccaggaccagttgcatcagcatcacctggaacttgataggaatgcaaatcattttgtgtttttaaaaagccctctatgtgattctctgatgcacactaacatttgagaacactgtcctaggaggagtggctttgctacacttgggatacttccgctaggcagtcagtaaattaagagatactcatggccaggtgtggtggctaatacctataatcccggcattttgggaggccaaggcaggagcatcacttgaggtcagttcaagaccagcctggccaacatggcgaaaccccatctttactaaaaatacaaaaattagctgggcgtggtggcagaagcctgtaatctcagctactcgggagactgatgccggagaatctcttgaacctgggaggtagaggttgcagtgagccgagatcgcgctactgcactccagcctgggtgacagagcgaaactccgtctcaaaacaaacaaacaaacaaacaaacaaacaaacaaacaaactctcactacccaagagaaagccttctgtatgggaataagtgggattaggtgaatgggtatatgactttgtatttcccataggatatttcagggctttcgtttatgttatctatttagttttctatttactaagatattacactgactcctaagtaattgaataaaaacttcatgctcataaatatggaagaatctcagtatgataatgtgtttttacttcagtttggtacaatacaggtcaaattacaatagctaaaaacataattgctcaaataattggtcaacaacacagttaatcaataggcaagttttctgttccccaagtgagcttttaagaatagtttatcttaataatacttcttttttaaaaatatttacctcaagttggactcacctatttaacccctatatgattctgtggggcagggtcaggtaagtggctgcccaaaactatatatgtaggtcattaatgtaggttcagaaatataattcaaccattactatattgcacagtaattttggagttaaattagtttgggttctaatcttgcctttatgtacctttgaataaactctttgagcttcatcttcttcatctgcaaaatactaagaatttttccttagtcgtttgattatcattttctcttttatttaacagctggaagcatttactaatttttttgcgaaagatggttgtaagacactgaaatttttgtaccaagaaggagatgtacctggtattggtaagaattttctgagggcagtgtgccagtaattagttcatgcacgttaaagtgcagcatattttttctcttatacatagataatcctttatttataaagaaaatgttaccagaagtttatgtataagaaatatagtgtctcaagaacaatacattctcagcccaaatacatatttcaggccttgctataatgtcttcaggagaaaacatccttgtagaaatcactggcctctgctgggaatacacattttcattagaatttaattgcattttccccgaaacaggtggagccattttgtccagatgattagaagtggtggtgaaaccactccagagccctgcagctaccccctgtggtcctatctcagcatcttgtgcctgctgcagctgtcacttggaatagctggttttccctactgtgcatattatgcctgaactaattaacatgctaccagcttgttaaaactttgttttaataactagatatgtgggtttcccttttggtctgagactactcatcatcagagtcctgtggatttaccttcaacacatccctcccgttgcttctttctcacttggttcctctgctgccttaggctaggccttccctggtgttccagattgaaaaccagtatctctgtaatcagattctccctctgaaattcgtactgtgtattcctgccaagtatatcttttattgttctgctgtttattggattgggtccacatctcatttattcaaggcctgctgtcatctggacacgcagtacttgtctagtctgatctcctactcttccagatgtgaatttgctgctccttttaagcccctcttcattgttttctgcatactagagttatttcttttccctttctctcctcacctggctttttcagattgcctttcttctctccactcagcatcccctacccggctccttcagaacacctccagcagagcccttcccagggtgttccaacccatagccatcactgttctccagatccctatctcatttacagtatccatgtaaatatagtacttgattgtgttcttctaccttcctctaattgtttaatatatgtcttgtttcttcgataaaatatgtaaactcgcaaatagtgactaggttggctttgtggattttctgtctctcacagttcctattgtaggaggattattgtgtggtctatatttttataacttgttaaaaattaaaacaatagctgaaaattatagaaagataaaatatctataattagaagcaaaatacagttccactcagttggagaaagcactgttaactccttaatgaatatttctctataactggtttatatacatattttacaaaaatgggatccaattctacatattattctatagtggctgtttaattttgataatattgtcttctttatgccaataaatacatttatccaatcaaaatgttaacatctgcattttatttcattaggctgatataactgtaattttccaaactgatctctcagtagaatttaggttgtttacaactttttgctccctgaaacaatgcctgagtgaatattactgaatacaaatctatgtggattaggaataaattttaggagaaattctcagaagggaaattgccagagcaaagggtacacatatttttaatcattatttttgctacttacaaaagtacatttatcagtttggtaaatattcatctacatttctttgttgttgctgttgtttttgttgaagcagagtctcactctgtcacccaggctggagtgcaatggtgccatcttggctcactgcagcctccgcctcccgggttcaagtgattttcctgcttcagcctcctgagtagctgggattacaggtgcacaccactgcgcccagctaatgttttgtatttttagtagagacagggtttcaccatgttggccaggctggtcttgaactcctggcctcaggtgatccacctgcctcggccttccaaagtgctgagattataggtgtgagccaccacacccagcctacatttctttcttatgtgcatgtgttaacatgtaaatgcttattatcagttaaaaatgtggttatataatacattttattcttgacttggtgtttgcatttgacagggtagcctagacatttttctgtgtcattacgtaaagatttacctcattcaaaaaattcgttatagtataacattccattatacagctgcattgtgatttttagaaatcattccctattgatggtcacatctctcctcttcatcaggaaaacttaagcttgtcttatgtcttatcagacagaactgtgtcacatggctatcctgggggccagggaggctgagagagcagttttctttctagggatgaacacaatgggacaaagtcaggttttcttagcaaagaaaaaggggagggtagtaaatccctgtggagcctctatgaatgggcatttgggctcttatattgctacgtaccatgtatcagggttctttggctgcaagcaacagaaataggtctggcttatatgagtggaaagcagtgtttcgggaggcggaaggtggataacaaaatttagaactagttgaacaatcaggtctcgggaaggacaagaatagagcatttccacagatttcagggcagtttctttaggattcatcagtagacttccatctctcaaatccctttttttctttatgtgtattcattcaaggtttatattcttgtagagtctaattagtctagttcttacatgcccacctttacagagccctggcactcgtatcctccagaatcacagggcaggaggaatctcccaacccccgtgaaaaagaaaggctgggcagacaaaacatttctgtggctttgtgatgtggattttctatttctttccttttttatttttttttgagatgggtctcactaggttgcccaggctggagtgcagtggcatgatcatggcttattgcactcttgatctcccaggctcaagtgattctcctgcctcaacctcctgagtagttaggactacaggcacatgccaccacatctggctaatttttaaaaattattttgtattgacaaggtcttactgtgttgcccaggttggtctcaaacttctgggttcaagcaatcctcctgccttagcctcccaaagtgctgggattataggtgtgagatgctgcacctggccaattttctatttcttttattacattttaaattggctattgctgcaaatagaaggctgttgatttttgcaaattaatattgtgaccaactatctaacataattctcatatttttaatagtttttctaattaaaaaagattgataattaaatgtttaattttcatggaaattagttcaaggagggatttaatagaaggtggatacaatgagtgtatttggtacaggaactggaccttcttgggggagtcagtgaaggcttcctgagatggtggcatttcagctgagatctgaaagatgagtaggaatttgtaggtaaaaggttggggatgggataggagaacaggttgtataaggccctgaggccaggccaaaaggaacagaagtacagagttcagggaaaggtacccagaggaggctgcaatttaagatacaattattagctgggcacggtggctcacgcctgtaatcccagcactttgagaggctgagccgggcagatcacttgaggtcaggaatttgagactagcctggccaacatggtaaaaccctgtctctactaaaactacaagaattagccaggcatgatggcgcgtgcttgtaatcccagctacttgggaggctgaggcacgagaatcgcttgaacccgggaggtggaggttgcagtgaactgagattgtgccacagcactgcagcctgggagacagagctaaaaaaaaagactccatctaaaaagaaaaagaaaaaaaaaagatgcgattattggccaggcatagtggctccatctaaaaaaaaaaaaaatgatgcaattattggccaggcatggtggctcacacctgtaatcccagcactttgggaggctgaggtgggcagatcacctgaggtcaggagtttgagaccagcctggccaacagtgaaaccccgtctctaagaaaaaataaatacaaaaattagctggatgtggtggcacacgcatgtagtcccagctacttgggaggctgaggcaggagaatggcttgaagggaggtggaggttgcagtgagctgagattgcactactgcactccagcctgggcaacagagcaagactctgtctcaaaaaaaaaaaaaaagatgtaattattggcatcttctagtagacccccccccaaaaaaattattctatgaccgtattgaaaacttcttacaataaagtaaaacaggaaacaatagtgtaagagccacagtaacttatctcatttgattagttgtgtgattatacgctaagttcttgacttttgttttcagaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggtatgtttaaaaatttccccaaatacatagttaaacattgaatatatttttgtagtcacacttatgctttactttgctttccctttttaaatataggactgaattgagttccaagaaaataaatgtattcatatattaaaaaaaactgagaaattgactgtaatagagcttagttatattgatattttagatactgctttcaatttcatgaaaatttcatttcttgatggtgtgcaaataacacatttaattttgttgatgcaaagtattagttactttatttaacttcctcttcactcaatattttaactcttttatagttttaaaagaagaagggagagttgtcctagagcctggacattgctaagctagttctgggaaggcaggatgatggaatgggaaaagcaagaattttagccagagagaccgaaatttgcctcttagcttcaccactgactaatcacttaaatgtgtcctctggaaagttgctcatcctttctgcgacttagatctctacgttcttaaattgggaataataatacacacctggcaagattgtagtgacactaaatgataatataaataaattcttattatattgcctgacatacagtaggctctcgacaaatattagttctctttgttattcttagagagtcttaataccttttacaatgggaaagggaactgaagtctaatcttgttccttttctgttatgataaaagattgcttgaagagagcttgtttagcttggtttaagattttaggttggcagttatttttccctgaccccttgtaaatatttcatggtatttcttgtggatgatgagagcactcctgttagtgtaattcataggtaatctgtctttttttctttctgtttgcttttgcttgttgtcttcaaagtcctgtagtttcaccacaatgcctctatgtatggatgtttcctcaatctgccttccatttcattaattctttcttcaacttatccatgatttcatccattcatttttataatttagcttttgttttagttcagttatgtgtgcatataaagagagaaaaagtccttttatgaaatagtataagtctttcataaccgaaaaactgacttctatgctattctccagaagcaactattaaacccttttaatggattcttttatttacctgtatatctctaaataatatgctcagactgctccttttgtcagtttagacattatctgtggccagtcgcagtggcttaccctgtactcccggcactttgggaagcagaggcaggcagatcgcctgagctcaggagttcgagaccaccctgggcaacagagtgaaaccctgtctctactaaaatacaaaaaatcagctgggtgtggttgtgcactcctggggtcccagctacttgggaggctgagagaagagaattgcttgagtccccaaggcagaggttgcagtgagctgagatcacgccactgcacttcagcttgggctacagagtgagagaaaaaaaaaaagacattttctgtggacttttctctctggaaggtgataatttcgctctttttctgccttctgacccttgtttctccatccctctattcttccaacgtagttatattctagttaacttagctaaatatttgtttacatcattagaactaagtaaatgtaatcacagatgagccatgtggtgtaacagtggttcttaaagtcaaacctattttcatcagaatactaagatgctagttgcccttttcaccaatgttgacatttgactgatggcgcagaagcaatggtgggaaaaactactgataccttaacacgaatcaagacgacaccaaactgtatgagtagtaattttatacttcattgccacacactcacagttaaaaaaccagaaatcatttttttttgtgaccctagacaagttttttaatcttaattttctggcttgggatttctaagtcacttaagatgtatcaattgaaaggtcacgcatgggtggtgggcttttgatttctgggcttttggtttcttacggctggtaatttattccaccaaacttctaggcaagggcttttcaccagaaaaaaaaaaaatcatggacagggcaactttcaacggaggattttctttacgcaggtttggttccacgtccctcaccttgaataggctccaggctattgttcctttcctatgcagaaattaaagcatcaaatgaaacatcactttgatgagcaaatatgggaataattaaattgggggcagaatataagtttgttgactttagaactctaaggttcataaccacttaagattccctaatagtttataaaatgtattagttgtctatgtttattgcaatataaaacaggttatgatttttcagttctttagtgggattagcatgtaaaataacatttaaactccaccctttcaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtaagtataaaatttaatgtttagcaaattgcaaaaaagaagcaaattaactaagatatttcataaacagagaaaaagtttctatcttaaaagatgttaatccaagtaattatgagacttagaggcaagaaatgaaatcattagaactcatttttgaggatctttggtggagtaagatatattttctttttaattttacgttatagcaggaggaatctctttctataatattaatgaaaattttcaccatattaaaatatatactttattatgaactcttaaaaatctatacttttattttttcatattgttaaaatgtacaattttatcagtaaattatgaagtcataatctaatgattaattagaattatatttctgtaaagtattagatctttaacatttcagtaattagagcttaaaagtacacattgacttttaacacattgacattaaatacttcttactattaaatattatttaatatttttattaatatatttaaaatatttaatatataaattagtattaaatgtcttttttttcctttttaggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtgaattgactcaaacaattgcatctggactagtagttttcatgtgcatcctagccattgtattttgtctctaacagcaaagggaagaggtgtctcctttgactttcttccagaatctagtttgaaactcagccaatttttgggtctagagcaaaatcattcttctttgtggaccatttgaaatcaattttaagatatttctcacttcaaggaagaaaccataacaatatgggttgagaatgaaagaatgaagaatcaggaatagccaacatttatccccaataatgtttaaattgttgatactctccataaaagagagagggagaggacacagtgaagagccagagtgctagacactaaataagtacctcttgttcgatcagtggagttgtctgtgctgtcaaagaagttcagactaggctgtttcacatcagcatcacagtggcaagcctgcagctctatggtcaaattttttctggcagtaaggaaagtagtgataggaatacaacatatgtcaaaattatgagaggctccaacttacactataaacactgtgaaagaaaatcggatattacataattgccctaaacagaaagaggattctaggaaccgccccccagatctctagttcatcagcacaggacagcagaactaaacaagaaaatcttcagttatgtgaggatcaaggggaaaaaatcttgaccaggcaggaggtacagaaaagcgtttccagttttacctttctagaactatgttaggaggagggctgtgcagttagagtggcaaaaattggaggactcccctagggtctagagtgctggccacagcatttgcttccaggtgtcactagattattgaaatgggtaattgcccactggataactcttgcagccaccgtgcccagccaagacttcctatttttttttgaaaaatctttggttacacttggaattgtcagatttttaattgttgccaatatgttgagtgtgaaatgatatcttggtttacttggtattaccctaaatactattgaggttgagcatatttaatggctattttggtttcctctgtgtagaattgcttgtttatatcatttacctgtatcatttacccatatcattgcctgttcatatcatttgcctatatcatccctttatttttttggatggcttgatgttatcatactacatttttggaggttaaataatattttcctgatattaatcctatgttggtccccattgtgtcatgtttcatttggtatagtgcctttagtcatgtggaaatttaagtttttaatgtagataaatatattaattacaaatgttaatccagcctcaacctagctatccccagtgactataaatataaactctgtgctttttgtattttacttattaaatgctttcctactccagtgttacaaaggcattctcttaaattctttatttattttaaatagtgaatataacacaaaaatgaatatgatgaaaggaacaaactgtaaaatgaacacctgtgtaacctttgcacaagttaagaaatagaacatggctaggcatggtggctcatgcttgtaatcccagcactttgggagcccaaggcaagaggatcgcttgagcccaggagttcaggaccagcctggggaacgcagtgagacccagcctcaaaataaataaataaagaaaagaaaaaacatagaccattaccagcgccttaaaatgtccttgcgtttctcttcccagttttaaacagcttttcttccccctagtggtaactattatcttgataattatgcttttcaattccatgtttttctttctagttttaccctgtctcctacattttcttttagaaatgttaccattttatttttaacatttaggtgtttaatccatctggaattgtgcgtgtgtgtatgatgggaggcagaaatctaattttgtgtttttcatgtacctgtagttagccaattgtctcgatttaagattctctgttaaattgtttaatagtccatttttttctaacatatttgtaatataacctctgtcatatataaagttgttagacccttttgtttgtctcactggtgtatttatttattttttatactatgctgtactgctttaattctgtagcgttttactaaaccaacatttggcatgccaagtcttttctctgtttttcctcaaaattacattgactgttgcaggctaattgtttttcaaaattaattttaagactaatttttaaagtatcatgaaaaaccctattgagattttgattagaatttcattgaatgtgtacatgaatttagagaaaactgccatctttgtataattgaattttccatccatgaacatgatatacctccccatttaggtaggtcttctgtgtgtgtaaaataagttttaaaattctctccaaaaaggttttgcatatctttcattagattaatttctagttatcttatcactgtttttctttgctgttgtaaattgtatctttttggaaattaaattttcagattgcaagatagcttgtaaagaagtgatactaatttttatgtatagatctagcaactttactgaattgctcacgtttattaattgtaaaaagtttgtctttagtctttttgtttttttttcttttctttttttgagacagggtctcattctgtcacccaagctggagtgcagtggcatgatcatagctcactgcagcctccagcttctgggcttaagtgatcctccccgctcagcctcctgagtagctgggactacaggcatgcaccaccacatccgactaatttaaaaaatttctgtggagaaggggtcttgccttgttgcccaggctgatcttgaactcctgggctcaagcagtcctccacttcagccttccaaagtgctgaaattacaggtgggatccactgctcccaaccttagatatgctagtttaaaaatgtagcaaactatatcatctgtgattatgccatttttggttttttatttccaattcttaatgccttctgtttctttagttaccttgttctgggatatctattaccaggtggaatagaagtgggtggtgattgtggcaaacttatcatgtccttggttttaaagtgatattttctaaaatgtcacctttggccaggtatggttactcatgcctgtaatcccaacactttgggaaactgaggcaggaggatcgcttcagcccaggagtttgagaccagctgggcaacatagtgacatgctatctctacaaaaaattaagaattagctgtctgtggtagcacttgcccgtagtcctagctactcagtaggatgaggcgggaggattgcttcagcccaggaggttaaggctgcagtgcactgtgattgtgccactgcactctagcgtaggcagcagagcgagaccctgcctcaaaacaacaaacatacaaacaaaaaaaccccaaaaccaaaaaactacctcccccccgaccaaaaaaaaaaacccaaaataaataagagaaactgtcacctttaaatattatgtttgctggagaattttagtagatagtatctatcatattgaagacattctcctctagtcttcatttactgagagtttttaaacattatttggtattgaacattatttatactttcagctgccttcaaaaagatgcaatcagattttaacaaagaagaatgtaacatttctatattttataaatttttttgactgcaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaaggtaaaaggctttttatttaaagtttggtatacttcagaacaagcaactagaaaattatcctattgaactacttcttagtataatatactggaatcgtgtttagaagtgttagcctttgagtaaggcttttacatatatcacagttatttccagaagaggaaatgaagatttatttctcaggatttcgcagaccaattttgaccatactactatggggtgatttttaggaaagtgatcatcttttatttttaaattgtttttgaaattgtaaatcaatgaagaaatcaatataggctcactgaggtaaacaactgcatatagagtcaaaagtaaagtacatctcatccccatgattctacctcctttcctagaggtcatctttatttacagtttggcttgattctagattcttttcttttctttctttttgaaacagggtctcgttctgtcactcgggtggggtgcaatggtgtgttcacagctcactgcagcctccacctcccaggctcaagcgattatcttgcctcagcctcctgagtagctgggactaacaggcatgccccaccaccacgcccggctaatttttgtatttgttgtagagatggggtttcaccaagttgctctgggtggtctcaaactcctgagctcaagtgatccgcccacctcagcctcccaaagtgctgggattacaggcgtgagcaaccgcacctggcttctttttctttctttctttaaatgtatttctttctttgcacagaaaaataaactaatacttttttggtaatagatttaagcagtacgaataaaacaagtctctcttaatcacatacccttagccccaccacccacaactctgtgtcctgaatagtaagcacagaaagacaactgcacttttctattttattttttcctcaacatcttctgtggtatgtatgtgtgagtttactatgcacaaatgacatagtttagttttgtgtttctaacttttaaattaaataaatgtcatagcataatatttttcaacttcccttccccacccctgatagtatatcttggagagttatgcctgttagatcgagcttgagcggtatggttttccaaaaaaatgttgttgttgtgctttttttttttttttttttttttttttaaagacagaatcttactctgtcacccaggctggagtgcaaaggcatgatcacggctcactgcagcctcaaccttccaggcttaagccatcctcccacctcagcctcctgagtagctgggactactgtcatatgccaccatgcccgactaattaaataattttttaaaaatgttgtccaggctagtcttaaactcctgggctcaagcgattcttccacctcagcctcccaaagtgctgggattacaggtgtaagtcactgtgccttgcccaaaatgttaatgtagcatattaggttttatctgatcatttccctgtttgtggaccaattttcccctttctttttttgcaagtctgagttataattcacatactatttattttatccatttaaagtgaacaattcagatatttttagtgtattcatagttgcacaaatatcaccacgatccaattttggaacattttcatcacctcaaagagaaactctatatccttcagctctcaccttcccatttccaacattcccccttccccccagccctctgtctagatttgcctattctggacattttatataaatggaatcatagattctttgcctttcgttactggtttctttcacttagcataatgttttcaagtttcgtccatgttgtagcctgtatcagtatgtcattcctttttatggctgaatcatattctgttgtatgaatataccacattttgttgatcagtttatggacatttgggttgtccctgtttttttggcaattatgcataacgctgctatgaacattcatgtactgtacaactttttgtgttgatatatattgtcatttgtcttggttattatacctggggtggaatttctgggtcacatgttaactctatgcttaactttttaaggaaaatggttccttttctatgtgtttataaatattgctgcagttgaagcttttatatgtccatatgcaaatatttccttaggttggacactccacaacttttcagtactaattatcagttaagttattattattattatttttttgccaggcatggtggcctacatctgtagtgtgagctacttgggaggctgaggcaagaggattgcttgaactcaagaattttgagctgtagtgcactatgttgattggctgtccacattatgtttggcatcaatatagtagtgatgtcccaggagtggggtgatgagggtgcctaaggagaggtgaactgatcagggtcagaaacagagcagatcaaaactcttgtgctgatcaatagtgggatcatgcctatgcatagccactgcactccaggctgggcaatgtagcgagaccctatctcattaaaaaaactaaaaaaaaatttttggggggccaacctgacatatggagaatggcttgttttattttgttctttccttgttagtagtgaagttgttcagtttttgctgcttactggctattcatatttcttttgtgaattttctttttgtatctttcccttatttagaaaaattcagacattgttttgtactgatttataggagttctttattttttattttttttgagacaggcttctcttcgtcacttaggctggagtgcagtggcactatcatgattcactgcacgctcgacctcccgggctcaagtgatcctcctgcctcagcctcctgagtagctgagactacaggcatgtgccaatgtgcctaactaatttttaaacaattttttttatagagataggatcttactgtgttgcccaggctggtctcaaactcctgggctcaaggaatcctcctgcctcacactcccaaagtgttgggattacagacgtgagccactgtgcctggccacttggagtcctttatataatatggatattaatcactcgttatatttgttggatgaagtaattcactatgactcctgggcatctctgcacattttcactatatatgaaaagaatgcaaggcccatactgctctttatctgaacatctctcagagttgtgtttgcagtgagcaaccttgaggggtcagttcacgtgtcccccagacaaagagcagaattacttaccgcttactgtaaaaaggataaattcccctaaactcagtattcctcacctgtaacacaacctactgcaggtgcaagcatcagtgtgtggatatttagggtcatgggggaacaaatgcaacttaatgctcatgccatttgctgtgatgtaataaaatccttgtctctgaacccaaatctcatgttttctcccttcatccataaaacaataaaaggctaatgcattaacttctaagcagggtaaaatcccagacccccatatgcactttgacaattacaatgcaaactttttcctagtctgtggcttgtattttttaaaacttcaacacttgaaatcattttagacttatggaagagtcaaccaggatagtacagagagttcctgcctgctcttcatctagcttcccctaatgttaacatcttaaaactattgtacaatgatcaaaatgaaggggtaacattagtacgatactattaatgatgctacacacaatttatacttctccaggttttccacttatgtatttttatctgttctgggatccaatccaggatcctatttacatttgactgtcatgtctctttagcctcctccaatggaacagttccttagtctgtagttatacttcatgagcttgatacttttgaatagtaatggtcagttatttaggagaatgtctctcaatttgggtttgtctgatggtttctcgtgaatacattgaggttatgcatctttggtaagaatgccagagttgatgtgctcttcccagtacgacttaccaggcggtccattatattgatgtgccttattactgttttaaaattgatcatttagttagggtggaatttgccaggtctctgtactgtacacgtatcgtattttgtggaaaataaccttaaactacatgaatagctttcataggtgggtcttgactgcggccgtcattactgtgttatgccaatggtggttttctagttccctcattccttccacgtttattaatcagaattcttatgtaagaaaatgttgtctcttctctcactgtagttatgtatttgatcgtttattttcattaatatagcctcatgggtatttatttcatgcttttggttataatcgaatactatcattatttagtttgttgctcaaattgtttcctctttggccatcgggaaatctttcaggttggcttgtgtgtttccttctgattcccttactctgtttggaccacttctttactctctaacactagataaatgcttaaggctcattttgtatttgttctgccctagtcctgggatcagcacttctccaaggatcctgggtttattttattggagagtagtatttaggaaccaaaatctggttgccagatgtgcttatttgttgcttgtattttaatttttttttaaaatggaatcatttataatgaatttttttatatttagatgaattaattttttcagccttttattgcttttgtctttcatgtattgtttaaaaataccttcttaagaagaataaattggttgggcgtggtggctcacgcctgtaatcccagcactttgggaggccgaggtgggtggatcacctgaggtcaggagttcgagaccagcctggccggtatggcaaaatcccgtctctactaaaaatacaaaaattagccaggagtggtggtgcatgcctgtaatcccagctattcgggaggctgaggaaggagaatcacttgaacccgggaggtagaggttgcagtgagctgagattgtgccactgcactccagcctgtgtgttgggagtgagactccatctcaaaaaagaaaaaaaaagaagaataaattaaggttaacctaaatttaaaatagaattgcccttttcttctatttctagggttttatttctttatactttattcttcagttaacttggaatttatttgtgtgaatcatgtaagatttaataataatgataataatagcagctaacatttattgtgtgcttactatgtgccaagcgttgtgttcagtatcttacctataacatttcatttaatcctcacatcagctggatcaggtggatcttattattatcttccccattttgtatatagaacagtgagagattaagtttcttgttcaaggtcacagagttagttggaggggaagcaggatataaggtcatgcacttacctcttgagctagcattctttttcccaaatggctggctaattttctgggcactgtttgtcattttctttttttctttttcttttttttttttttttttttgaggcaaaatctcactctgttgctcaagctggagtgcagaggtgcgatcttggctcactgcaacctccacctcccaggttcaagcaattctcctgcctcagcctcctgagtagctgggactacaggcacatgccaccatacccagctaatttttgtatgtttagtagagacaaggtttcactatgttggccaagctggtcttgaactcctgacctcgtgatctgcccgccttggctgcccaaagtgctgggattactggcgtgagccaccgcgctcagccactgtttgtcattttcttgtaatcatcataacttttgtacatctactctttgttcttcttttccagatttgtcttaacaattcctatgttttcatcctttggtacacattttgaaataagtttatacagtttttttctccaaaataccaaattttgagacttagttttatatatttttgaaatgtatgtaaatggagtcatatcatatattctgcaatcaacttttactcaacattatttgtgagaattcatcatgttaatgtgtgcattattattcatttgctacctttgtttttattgctgtatcatattctgttgcatgaatgcaccacaatttatttatctattatcccagaatcgacatttggattgtttctagtttggggttattgcaagcaatgattcaaaggacattcttattcatgtctcctggtgcacatgtgtgagaatttctctaaggcatattcctaggagaaaatttatgaatttgtggatcaaaggcatatacaatttaagctcttggagagaggtctctaatgatctgccatagtgaccttcagacattttgtattaaaaatattaatctctagtctttagaaaggatacaaagcaaatgtggtagcaaatctatgaatgacattgaggagggagggaaagaaatatattggatgacaatgtaaagatccaagaaggtcttcagtggtaagagtgggggtgccatactgatatcccaacctctttgttggatgggtttgttgacaaactgtttggctcccattgtttttcaaaatggttttgttcagagcatattatttctgtttttgctgagtagacctctccatttcatgctctcttcatctctgaccaattctcaagcaggcacttgattttatcatccctagtatgtaagagtggtcagttaataataagataacagctcacgcctgtaatcccagcactttgcgaggctgaggcaggagaatggcgtgaacccaggaggtggagcttgcagtgagctgagatcgtgccactgcactccagcctgggtgacagagcaagactccgtctcaaaataataataataataataataataataataataatataacatttattgagaataggttaaaaatcctgaaagaatttgaaggagagaaattgatcaactttggataaagacttaacagttttagttgaatccattgatagaatgatattactgatgcaagtcaacttgatcctaggctgctttatgagaggtatagtttccaggaaaaaggaaggtgatgttttggcttttctcagcattgaccagatcacactgaaggcttcctttcattcctgaggcatatgtatttagagtgatgttgtgtgtgtcccaagtagaaaggccaagaggttgaagctattaagaccatgtccttggaaccaacccaaaagctcatcaatgatagactggataaagaaaatgtggcacatatacaccatggagtactatatggctataaaagggagtgagatcatgtcctttacagggacacggatgaagctggaagccatcatcctcagcaaactaacataggaacagaaaaccgaacaccacatgtactcactcataagtgggagttgaacaatgagaacacatggacacagggaggggaacatcacacactggagcctgtcagggggtcagcggggaaaggggagggagagcatcaggacaaatagctaatgcatgcagggcttaaaacctagatgaggggttgataggggcagcaaaccaccatggcacatatatactatgtaacaaacctacgcattcttcacttatatcctggaacttaaagtaaaaaaaaaaaaaaaaagacaatgtctaattaaatgactaaaggcacacagattgctcatctttgaataaaagacttagtgatgatatggtaaatgtcttcaaacatttgaagggttgctgtgtgttcactaggctccattatgcaaaactatacagatgagcagagattacaggaagaactttctcataatcagttatttaagcaggtactatttgatgaccacttacaagaaactgttgatttcagattgacttcactttgctagtaaggttttgttttgaataatgttcttttttattttttattttttttgagacaaagtctcactctgttgtccaggctggagtgcagtggcgcgatctctggctcactgcaagctccgcctcccgggttcatgccattctcctgcctcagcctcctgagtagctgggcctacaggcgcccgccgccacgcccagctaattttttgtacttttagtagagacggggtttcaccgtgttagctaggatggtctcgatctcctgaccttgtgatccgcccaccttggcttcccaaagtgctgggattacaggcgtaagccaccacgccctgccataatgttctgttttaataacttgacccattcttgaagacccagagtaatataatgtcacaaataattaacctgaaaaagtcattcctgttagaagcaggtccagttcaagcctacagacaggattttaattacaaacagaatgagtcttcagttttagtaattcatttaaggtgcttgttgtaactttgtctcaagtattataagaaaaacatatattaatcacacttaaatatctaccattttagtatatgtatgattagggaagactgaatttcccgagtaaactttagcacactgatatatttggatgtttcatagaattcttatacctttttttcttagaattggcgtgatttggatgcaagaatcactgatacagcaaatgaatccaaagataatgtcagatatttgtatactttggaaaaagtgtgtcaacctctctataaccatgacctagtaagtatgcttttaaagtacaattttaaactgagggcagtggctcgcatctgtgattctagctactcagaaggctgaggtggaaggatcgcttgagcccaggagtgcaaggctgcagtgagctatggttgtgccactgcattccagcttgagtgacagagcaagaagaccccatctatataaaaaaaaatagtacaatttaagaaactgacttgtataattaatgcattaaaaatctttaatatgtgtatattggggaaaaacatcctgccaaaagttatttaaaatatacattttcctcttatgtgtttatgaagaatgataaactatatttaatattttaacccatatttaaatatatagtgaatcattaatatagtatgtgcaagacaaatattaatatattacttatactttgctgcataacaaataacctcagaactgagtggcttaaaaacaatgagcattcatcatgtcagagtttctgtggctcaggaatccaagcaaggcatagctaagagcttctgcttcaaagtctctcatgaggttgcccacaggctaagtgggggaggctgactggggagagtcttcttctcagttcactcatgtggttattggaaggccccagtcccttgccacgtgggcctctccacctggcaacttgcttcccttggagtgagtgttccaagagtgagcaagagaatgagagaacacccaagttggaatctaccttcttttaataacctaatctctgaagtgacagcccatcatttctgttgtattctattggctagaagcaagtgaatctggttcactctgggtgggtaggggagtatacaagggtgtgagtactatgtgggtgagcatcactggggccatctttggggctgcctatcaaggtagatatttccccatttacagattaggaaaccaaaactcatcatggtgaggtgactttgccagcatcactcagctaatcagggatgcaggacagaacccatcttctaatttctagcctactcttctcataatatttccatagagatcctttaaagaacatgttagcactaccatttgcttttattttttagaagtttatattaacttcaaatttataatctggtatttcataatatttcatataaaatatgaaaattaaaaaaatctctatcctttatttaatagaaggagaagtcaaggaagctagtagttattgagaacttagagcaggatttccccatttttcctggatattacttcttttgtaaatcatttgtaggcaggagggctgcccagacagctgcatttttaaagatgttcccaggcttgagaatccttgaacttttgttataggcattgtgctacatgctttaaatatgttttcattctctatgcacaatgaccctcatttcaaagattaggaaaccgagtttgaacatttctatgatgatccgtgatgggaccaaattggaatctagctatctgtagcattatgggttgtattatttttccactttactatgttgcttcttcaaggtattctctaagttgaaatgcttcctctttccttcctccccccaccccaccaccccgggatggagtctctctctgtcacccaggctggagtgcagtggtgctatctctgctcactgcaacctccgcctcccgggttcaagcaattctcctgattcagcctcctgagtagctgggattacaggtgcatgccaccatgcccggctaatttttgtatttttagtagagacaaggtttcgccacattggccaggctgctctcaaactcccgacctcaagtgatctgcccgcctccacctcccaaagtgctgggattacaggcgtgagccatcgggcccaacactttcaaattaatttaatttgtgtctgatatctgtgtcagtattcttcactctaattttttaagaagtagtcaaatcttccatataggtggcagcactggccacatggttttgttgaccaaccttcttgggtcaatgtaggtttcatcccagaggcagggagaaggaaagaggttatggcctatatcacttagacttggagaagaaggaggtgtaaaggcagtttataatctttccaagagagtgttagtagtcaagaagtttaatatgaaaggggagggaaaaatgtcagttgagagtcttggacaagtgcatttcttactgccatgaggaatccattatccatcagggagcaccatgagaggggacaggaagactttagaagcagagtcttttaattgagtccataaagagattgtcgattttatttaaaacttattagtattatttgcaaagagatgactttttgaaaaattacagctttattttagattcgggggtacatgtgcaggtttgttacatgggtatatgacatgatgctgaggtttggggtatggatgctgtcacccaggtagtgagtacagtacacaataggaagtttttcagctcacacctctctcccttcctccccaccaagaattatgactttcttaaacttcattcttctcatttttacccctgctactagtagctggacttgtgttgtgaacctttgtaaaatttgtttaatataagaacatttatactatttcttaggtatttctgtgcacgtgaccccaagtaaagaaaatcaaattgtatatggtgttggagaagtaaggcctttgcttggcttacttggcagctcaatgacttaattccccaactttacaatgtgagcaattaaaatttctgtccaagaaaaattaaaattattacatgtcacaagcatttcagattgctcacaagatttgaagatgcaaatatgaaatacacataatacctaaagcctactccagggctaccgcaagtagctcttgatgtgaaaaaataatagatgaagtgaatatggcacaacgttcacgtttgtcaaatctaatgatgggagtaggtggtcattatatttttctctgtacttttctatatatttaaagctttttattataaaaagtaaacttgaaagaaagaatactcttcattgctatcaagactccaaattttaaggtatactgatttcaacttcttgattcaaaagacttgttttaattcatataatttaaaaatcatttagttctgatgtttttttcatcctagtaattttaaaaagctttgttcaattactctaaccatggatgtgccttattattgttattttgttgttgttgagctttttatattctctgatgtaggaaggtttcaagcatcaccttttgaaatgacagaagtactaatagcattgagtcatataattgcttcccactcatacacccactatatctgtactttcaacaattcctttttccccctcattttctttattctgattaaaagtaaccagcaattgctgtttagtttataactgtcatttgggtaggaaaagtgcaggggattcatgcttccatttctggttcataagttttatgtatgtttcatttttttaatcaccctggtattgtgctttaggcatatcttactattatatgtttgacatatgagatatctgagcactgtatatagatggacaagaacagtgcactcaaggagctactattgtaaataatgatgtttaaagttcagatgaaggacgttttcctgaaggacccatttgatgccatccctgagccctctttattggagtttagtggtactttgtagacatgacttaggaagggtggaagggactctttctaggcatatttttattaggatctttttgatctacagataccatatataatatgaattctggcctagaaggttaactataaagtaatggtgttaatttccataagccacataaaactgatttaattattccatagttataccccacacctaggacataccgtacagtaatcggtagttgtttttcttggctgtatttcttccatcaccattaaaaacacattttatatattttatcttgtcttatcaattaaaaggaaagttccttgaagggagggatgccattggctttgtctgttctcctgtagtgatttgcatcacggttagaagcagggtctcaaaatctccactatgtaacttacagctgttggatcttaggcaagggacttaacttctctacctctctgttttctcatttgcaaaatgggaataatgataatactttattttatagattctaagactttttttcacattttaatatccctgaactcaggacatactttagtcagttaggttttgtgaatcattgtggatgtgacttgatactaccttaaattattagttctctccttgagggtgttttttttgttttgttttgtttttgattttggtgccattcgtatgaattcagactgcagttgagtacctgtgcatacattctcaaagaagtttgatttctttcctcctcctggtagcatgtacattttgtttctctctttttctccatggttggtttatttcatgtttaccttaacagggaggacccactggtggcctagtattatgtaggagttagattcctcatcttgggtgtcttttttctttcttaatagcacagaaaataatggtgcaatcttacaatccgtgatgttttatatctgatgtaatcaaacctaccttcaagggttgttgtcagcatatcttagaataatatgctaacgctcttagcctagtgcctggaatatagtaagcagtcagtttatgttcaggattgttttatatccttgttgtacttgttctgctttgctctacctttttctacttgttttacttgtttgtgtttatctcttctgctctgttgtgagctactcatgaataggtttggatttcttccaatatcttcagagcctaatggcacttggtaggattgctaaaacacgaactgagttgcataaaagaaaatgaatgctagtctgatttctattttagctgggcttatgaccttaagaaagtcactttacccctcaaggtatcagtttcttcacctttaaaaagagcagaatgaactattaaccttaaaatggctctcacctctaaaatttaattttagataaacttttaagttcagatttacagaaaagttgcaatgatagcacagaattctctttacccagtttctcctgttaacatcctgtattaccttagtttgtttgtcaaaactaatgtcctgttatctgttccagggtctagtctagaatactgcattggatttagtaaaatttgactttaagctaaaaatgctatactattttgtgtacctttagagttttgagtattatagaatattggttattaaaactatatgcatatgatggaattcacttaatttgtttcaatgttaggtttccatggcacatggaatacaaaatttgattaatgccatcagaatgattcacggtgtgtcaaggtattataatacctcagagagaatgacctcattgtttatcaaggtaagtttctgtgggaggaaattacatgtcatcctgtgaaaaagttagcaaatctttccttctgagccctaggaagggaatttggaagcctaagtgcctctcagagttttaatacttccagtggacaagaagagaaaggcgttgactggactcagttgtacttaattgaagggagtaattggtacttttctgtttatcagatgtaagccccaatacttaaagaaaatgtgcctggtggttttttaatttattcatttcaaatagttttgattctacccaagagataggagtgtgtctactattaacagtgcttctttagctactcccatgaacactatagtttgtgtaaaattttcctgtgtagcgccgcatggttaattatttaaaataattttttaaaaatgattaaacaatatatatttaaatttgctagccaatgtcattcttttttttattatacattaagttttagggtacatgtgcataatgtgcaggttagttacatatgtatacatgtgccatgttggtgtgctgcacccattaactcgtcatttaacattagggatatctcctaatgctatccctcccccctccctccaccccatgacaggccccagtgtgtgatgttccccttcctgtgtccgtgtgttctcattgttcaattcccacctctaagtgagaacatgcggtgtttgtttttttgtccttgcgatagtttgctgagaatgatggtttccagcttcatccatgtccctacaaaggacatgaattcatcgttttttatggctgcatagtattccatggtgtgtatgtgccacattttcttaatcccgtctatcattgttggacatttggcttggttccaagtctttgctattgtgaatagtgccgcaataaacatacgtgtgcatgtgtctttatagcagcatgatttataatcctttgggtatatacccagtaatgggattgctgggtcagatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtatcttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagttcaattagatcccatttgtcaattttggcttctgttgccattgcttttggtgttttagacatgaagtccttgcccatacctatgctctgaatggtattgcctaggttttcttctagggtttttatggttttaggtctaacatttaagtctttaatccatcttgaattaatttttgtataaggtgtaaggaagggatccattttcagctttctacatatggctagccagttttcccagtgccatttattaaatagggaatcgtttccccatttcttgtttttgtcaggtttgtcaaagatcagatagttgtagatatgcggcattatttctgagggctctgttctgttccattggtctatatctctgttttggtgccagtacatgctgttttggttactgtagccttgtagtatagtttgaagtcaggtagcgtgatgcctctagctttgttcttttggcttaggattgacttggcaattttttgccagggctcttttttggtgccatatgaactttaaagtagttttttccaattctatgaagaaagtcataggtagcttgatggggatggcactgaatctataaattaccttgggcagtatggccattttcacgatattgattcttcctacccatgagcatggaatgttcttccatttgtttatatcttcttttatttccttgagcagtggtttgtagttctcctcgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaatgccctttatttccttctcctgcccgattgccctggccagaacttccaacactatgttgaataggagtggtgagagagggcatccctgtcttgtgccagttttcaaagggaatgcttccagtttttgtctattcagtatgatattggctgtgggtttgtcataaatagctcttattattttgagatacatcccatcaatacctaatttattgagagtttttatcatgaagggttgttgaattttgtcaaaggccttatctgcatctgttgagataatcatgtggtttttgtctttggttctgtttatatgctggattatgtttattgatttgtgtacgttgaaccagccttgcatcccagggatgaagcccacttgatcatggtggataagctttttgatgtgctgctggattcggtttgccagtattttattgaggatttttgcatccatgttcatcagggatattggtcttttttaaaataatttgagaaattactcaagcaacacatgagaccaggcatggtggttcaggctgtaatcccagcgctttgggaggctgaggtgggaggatcgctggagctcacgagtttgagaccaacctgggcaacatagagagaccttggctctacaaaaaaaaatttttttaagttagctgggcatggtggtgtgtgcctgtagtcctagctattccagaggctgaggcaggaggatcccttgagcctgggagttcaagaatgcagtaagctgtgataacaccatggcactccagcctaggcaagagagaaagaccctgtctcaaaaaacaaacaaacaaacaaacaaacaaacaaaccaccaccaacgaaaaaacccacatgaatagaatttatttgtaaattattcaagcataacgaaatatataaagtcatagtcacattttaagtttttttaaaaagcaaagtataggcttaatcactatgtcctaaatacgacaagactctcagaatccttcctctttacctgtctctctcattcttgccatatatgtcccacattgagatcatttttagttctgacaatgattctttgcttggcttctgaatcttctggtaggcccacctttgcactttctagtgaaatctagtttgagcaaagaaccctgctaagtcagtttagcaagaaccccccattcttgatatctgatgactctagatatctgatcaggttttcattccccccaaccccccaggtgttgtctgatcactttggcctgtcttcagcaagaatcctgttaggtcagtttaaccaaaatcccccttacctctgatgtttcctcttaataattttccacccactgactcccatcctgccccttggctatacattcctgcttgcccatgctgtgttcagagttgagcccaatctctctttcctgctacaagatcccattgcagtggtccctatacctatcacaatggtcctgaataaagtctcttgctttgcaagtatcactgaataattttttaacagttccatattattcttaacatttttttcaacattgtgaatcaacaagtattcagactaaaatccaagtattgctaatttatttatcaccactgttttgtgattcccacatctttttccttcttggattcattatttcttttgctgaaaaaattctttcagagaggtttcagggtggtgaacttcctggatttctacatgtctgaaaatcactttcattttgtctgatcactcaaatgctagtgtgacttggattttaaattcgacatcattgtctcctgggaagttgaagatattgctcaatcattgtctagtattcagtattgttgaggagaagcttggtgctaatatgattcttgtttcctttgtaggtaactagttttattctcccaggaagcttttaggattttttttctttatctttgaatttctaaaatctcaaactttttttttttacatttatcttgttctacacttgctgagttgtctcaatccaaagactttcctttctctttattcctgagaaacagtcctcttttgcctgggattatttctagctcactgatatggtttggatatttgtcccctccaaatctcatgttgaaatgtgatcctcagtgttggagatggggcctggcaggaagtgtctgggccatgggggtggatccctcatgaatggtttggtgccctccttgtggtaatgacttcatgcaacagctgattgtttaaaagatcctggcatctctctcttgcttgctctcatatgaggccagttcccactttgctttctaccatgattgtaagcttcctggggtcgtcatcagaagcagatgccggtgctatgcttcgtgtacagcctacagagctgtgagccaaataaacctcttttctctataaattacccattctcaggtattccttgatagcaatgtaaatggactaacacacctacccattcaatttattctctccccttgcatctaacttccatttctcttaatttttttcttccatctttgcccttttctggctcactcatttgctcttcattttttttttggattgtattttatttatttattattattattttaaattttattattattatactttcagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacagtccccagagtgtgatgttccccttcctgtgtccatgtgttctcattgttcagttcccacctatgagtgttgctcttcatttttgtaccaattgatggtcagttcatcaatagaatttgttttaaaattctgacaatgaaaattccaatttcaagttctctagtttttttttaatgttattattattattttttatttttagagacagggtctcattctgtttcccaggctggctttgaacttctgggctcaagttaccctcccaccttggcctcccaaagtactgggattacaggcatgagccactgcacttggcccataggtttattctttatcatatttttatgcttgtggtttgaaatttatatataaatgttatttctctttttacatataattattttgtacctatatttatttcaggtaacaaatcaaatggtaacagcatgtaaagcatatattactgatggaggattaaaccatgtatgggatcaggaaacgccagttgtactaaagaaaattcaggtttgtagaagtacttttattttcataaactaaatcttttcccatcctgcccaattttactttgtttattcacaaaatatgttaactgaaaaaacttcctacagagtagtgttgagaatataaaaagaatacaattcttattatctatttccctttatatttagtgcttctctgagggtaaaatttaattctcatctcctccatggctgcctgtgttagactcctgtgtgccatttcatacgctctggcccctacatctcattccagcctgttacaattaaaatttttgcctttttttgcattggttaggattaccatgtatccttaaatagacatggtagtagttgccatcctaattttgatcctggtttagaagacaatgtttctaacgtttcccccatttagttggatgcttttgtaagatttaaatatatctttgatcagattagtttagtaccaagagatattttttaaagttatgaatgggatttggaaaattttcttctgcatatatttattgagatgcttatagaattttgctcctcagtctgttaatgtgatagatgacatttttagactttctaaaattaaactgtcctaacgtttctgggtaaactcaacttggtcgtggtgtaattatctttttaaaaaacactcaaattcagtttgctacagttttgtttaggatttttggaagctgtattggtgagagagagaacctgtaattttcctttcttatgctgaccttgtctgtgttttggcatcaatgtctcagaataaatggagggtggggggaagtattttctattttctgaaaaagtttgtataaaattaaagtgacctgttcattgaaagtttgaaagaaatggccacagcaggaaggctccatctggaagtggttattggtcatctctgtgtgcaggttccctggtcttcgtagtgccaaggtgtgtggcttgaacagggaggtcaagtttgaaaagtggcccagtgccctccacccaggatgggaaccattattcccacaggcctggtgctgacctgccatcctggccagggcactgctatcacccttgctctgacctctgaactggaggataagaagaggaagaattgcagttagtgtttctcatgctgaaaacagttgatcccaaggactggaagaatcaggatcattatgcagttcttggacttagccatgtaagatacaaagctacacagagacagatcaaagcagctcataaagtagtggttttaaaacatcatggaaagcagccagtgaaccaataaaagaaagggataatgactacttcacttgcatcactgaaattataaaatgtatgacccagtgaaaagaggagcatttaacagtgtagatcatacatttggaaactcagttccttctaaaagtgaagcaagggatagtttctttgaagtgtttttcccactattcgaaaataattccagatggtccaaaaaaagtttctaaacctggtgttatgaattcatcattttattccttctggtatagtttttatgcttggacagagttttcttatttaaatacagaagaaaaaaaagcagaatattgtgacaagagagggattgaaaagaagaacagagcaacaagagctcaaagaaagaaagaagaaatgaattgaaaacattagttgataatacacatagctgtgatacaaggataaaaaaattcaaagaacagaaagccaaggccaggcatagtggctcatgtctgtgattcttgcactttgggagaccaagacgggtggatcccttgagcccaggagttcgagaccagcctgggcaacatgatgaaaccctgtctctacaaaaaacttagccaggtgtgttggtgcgcacctgtagtcccagcaacttgggaggctgaggtaggataattgcttgagcctgggaggctgaggctgagtgaggtgagccgtgatcacaccactgcactccagcttgggtgagagcaagactctgtttcaacattaaaaaaagaagagaaagccgagaaagaagcaagatggaagaagcgagaggctaaagaaaaacaaagacaagctgaattagaagctgcttgaatagctaaggagaaagaagaggaagttaaataaggagcattgttggcaaagaagggaaaagatatccagaaaagagttgttaaaaggaaaagacaaaccttcaaaattcaaggaagacctgaaatcactttttctgacaataagtggagcagcttaaaaaggtggaagaagtggaaaaactttgtgataggcttcaactagcaagtttatagcacttcagtgaaatacctcatctacaaaaacactaggaatggctgctctcctaaaaacggaagaaataaatgagccaattagaacagagaaagaggaaggggaggcttgtgtgtgacaagcatctaagaatgcagagaaatcaactgtcgaaggtggaaatggcagtaaaaattggtcagaggagcattggtctgcagttactaattaaagccataggccccttttctgcatgaacaaattcaatatgggaagttattaccaattatatgaacacacattctttttttggagtcaagagaactttttggcaaagaaaattgagcctctaaaaacttgaccctcacaaaaaaaagatgacaaaaaaggctttggataacctttaaaagaacatggaatagtctctcaagtacatgaagtaggcctccttcagatgtacctgaagatgaggaaaaatagagggagcagtgcctggcaggacaaaagaggacctcaggaaacaatataaggaagttgttgaggtggtaaaggcaatgaaatgcccaggagcaactgctgaatgcaaatggagccgagaaatgacttatggacagtctttgttgtgtatgcatttaaaaactaaaactgataattggagatgctaagcaccttttcaaatgcctgctggctatttgtatgttttttttttgagaaatgtcttttgaggtcctttgtccattttttaaatgtttttttttgagacggagtctcgctctgttgcccaggctggagtgcagtggcacagtcttggctcactgcaacctctgcctcccaggttcaagcaattctccggtttcagcctcctgagtagctgggattacagatgcctgccaccatgcccaggtaatttttgtattttcagtagagacaagggtttcaccatgttggccaggctggtcttgaactcctgacctcaagtgatcctcctgcctcagcctcccaaagtgttgggatcacaggcgtaagccactgcgcctggcctcatttgctcattttaaaatcaggttatttattttcttcctattgagttgtttgagttccttatatattttgggaataaacctctattagatatatggtttgcaaatactgtcttccagtctagaggttgtctcttcactctgttttcttttctgtgcaaaagctttatagtttgatacaatctcatttgttttttttgtttttgttgcctgtacttttggggtcacgtccaaaaaatcattgccaagtagcttttccccgacattttcctctagtaattttacagtttcaggtcttatctttacatgtttaatccactttaggttgacttttgtatgtcatatgaaacgatggttcaattttattgttttgcatgtggatatccagttttcctaagaccatttattgaagagactgccctttcctcattgtgtgttcttggcacctttgtcaaagatcagttgaccataatgcatggatttatttctgggttctccattctgtttcattggtctatgtgtctgtttctatgccagtactatgctgttttgattactatagcttggtagtatataaaaatatactacagtataaaatcaggcagtgtgatgcctccagctttgcaaattaaaaaccacaatgaaatatcagctcacacttgttagaatgcctactacagaaaaagacaaatgatagcaagtgttggtgaggatgtgcatgctcttggtaggaatgtaaattagtgtagccattatgaaacatagtatagaggttccccccaatattaaaaatagaactaccatatgatccagcaatctcatttctgggtaaatatttaaaggaaatgatataactgtctcaaagagatatctgcattcttatattcattgcaacattattcacaatagccaagatgtggaaacaacctaagtgcctgttgacagatgaatggataaagaaaatggggtatatagggtatgtatgtatatatgtatgtgtttgtatgtgtgtgtgtgtgtgtttgtgtatggatacatatatataatggaatattattcagtctttacaaagaaggaaatattgtcatttttgacaacatggctgaactttatttcattatgctaagtgaaataagccaggcacaaagacaaatactgccttttttcacctctatgtggaatctaaaaaagtcaaactcttagaagtggagagtagaatggtggttaccaggggctggagagggatggcacaatgacgagatattggtgaaagagtacaaattttcagttatgcaggatgaataaattctggagatgtaatgtactgtatgatgactatagtacacaatactgttttgtttttgttttttgagacaaggtctggctctgttgctcaggctggagtgcattggtgccatctcagctcaatgcaacctccgcctcctgggctcaagccatcctcccacctcagcctccctagtcactgggactacaggcatgcaccatgtattgtatacttgacatttgctaagaaagtaggtcacacccccaaccccaaaaagtaattcacaccccccaccccaaaaaataactatgtgaagtgaggatgtgctaattagcttgattttggaacatttcacaatgtatacatctttcaaaacatcatgttgtataccttaaatatatataatttttatttgtcaattatacctcaataaaactggaaaaaaataaaactggaaatactgaacaaaaagcaagtctgatagaaatcatctgttaagcatctaggatcgacattttctttgtgaaaagatttttaatttcctgcttctctttttgtataattaaaaatttttaattatgataaaaatagcataaaatttactattttaaccatacagttcagtggcattaactacattcacagtgttttgcaaccatcactgctatccatttcagaactttttcatcattctaaactgaaactctgtagccattaaataattccccaaactcaggccagacgcggtggctcacgcctgtaatcccagcactttgggaggctgaggcgggcagatcacctgaggttaggagttcaagaccagcctggccaacatggtgaaacaccgtctctactaaaaatacaaaaattagctgggtgtggtggcaggctcctgtagtcccagctactcaggaggctgaggcaggagaatcacttgaacctgggaggcgtagattgcagtgagccgagatggcaccattgcactccagcctgggcaacaagaacaaaactccatctcaggaaaaaaaaaaaaattccccaaactctctgccctagcccctagtaacttgtatttactgtctctctttatgaatttgcctattctaggtacctcaaataagtggaattaaacaatatttgttcttttgtgtctggtttatttcactttgtgcaatattttcatctacgttctagcatgtatcagaatttgattccctttatagctgagtaatatattccattgtatgtatagtccatatatttttatccattcctctgctgatgcacatttggtttgttactaccttttggctattgtgaataatgcggctatgaacatttggtgtgtaagtatctgtttgagtccctgctttcaattctgctgggtgtattcctagaagggaaattgttgggtcttatggtaattctatgtttaactttttgagttcctgccaaacaattttccacagtggctgcaccattttacatttccaccagcaatgcaggagggttccaatttcttcatctccttgccaacactttttattttctattattttgataagagccattctaatgtgtatggagtgaagtgacatctcattgttgttttgatttgctttccctagtggctagtgatggctgagcatcttttcatatgcttattggccctttgtatatctttggagaaatatttactcaggccctttctccatttttgaattgggttgtttgggttttttgttgttgttgttgttgagttgtaggatttctttatatattctggatattaattccttatcatatatatgctttgcaaatacactattgcttatttgtctatttatttattttgcttgttcgttttgagacaaagcctcactctgtcacccaggctggagtgcagtagcctgatcaagttcactgcctccttgacctcctgggctcaagggctcctcctacctctgcctcctaagtagctgggaccatgggtgcatgccatcatgcttgggtaatttttttatttttgtagagacaaggttttgctatgttgcccaggtggtctcaaactcctgagcttaagccatcatctgccttggcctcccaaagtgctgggattacaggcatgagccaccacacccggcctgtttattaaaaaaaaaactatttgactatactttctgtttcttcttgagtcagttttagtaagttgatattcttggggaatttccccaatttgtctaaaatttgtaatttattgacttattgttgataatattatcttactaaactttgtcttactatataagatgtctccttatttactaatattatttatcttctttctgttttcctaatcattcttgctcccctcatacccagattcaaaacaacttatcatcttcctaggagtttctcatttctgttgtttttattgctacttgcaggattccatgttttcctctagagcttctcttgttatttttgggaataggagtcagaaattactccccccaaatttgccaattggcaggaaccataactctttacatagaatttagcaatgtagtctcattattcttttaaggtcctaaagattactagccatttactgactgaattagaaatgggaacttggttttctgaattctagttcaatgtttctattacatctgaaatgttttcaggaaactttcagtgtatactttttaggaataatttttggatgagttggaggaaacaatgagaattgttactcagaatcttatctgagaactgttattcagagccaactcatttaaaaaaatttttttattatactttaagttctgggatacatgtgcagaatgtgcaggtttgttacataggtatacacgtgccatggtggtttgctgcacctgccaacccgtcatctacattaggtatttcttctaatgctatccctcccctagcctcccaagccagctcatttttgttgaatgagtgaaaaataatcagagacctcaaagagagcaatgataattgttttggagattgtgatagaggaaagaatgaggccaattattctcagatctgaatatttataggaatcactataggagagctagttaaaaatatagatttctaagtcccacttgcagaaattctgatttagtggctgcagtgggcagaataacggcccccaaagatgtctgtgtgcttatcctcagaacctatccataggttatgttacatatggcaaggggtgattaaggttgcagatggaattaaagtgctgatcagctgatatggggattacccaagtgggcccaatgtttaagggttcttatgtgggcaagaggaggcagaagagtcagaatctgagaaatggtgttatgataaagatttgactgggtattgatggtttcaaaaaagtttaacattaacaaaaaagatttggtgtttaggaaatgttagcttgacataatagttaattcctactctacccagcaatcttattctcttttttatttctattatgttcacaaaccagaccagtatatctgtagtcaaatattaggatttcagcaatgtactcatcaaagactttatgaccctcttttggaaaaatgattgtcagatgatagcttcgtatgacagaaacttcatattttatatacctgcgcataaagaatgctgattctaagatggatgcgaactgaatagagatgtcttgatagataatttctggacctcttgggagttctaattgtcatgaaaatgtaaaaacaaatagtatatggtatgctttgatgtaggataagagttaaaggaaaacaatgaggatgaataaaagtgaggttgaaatgaggatgaaaatatggtataaataaaaaaaaactatacagattttcacagtttgatcagttctgtgtgagggtagagtttttgaattttcgattcctgaacaaatgtctcactttcttttccctatttcttttacttttctcataggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaaggtaagcattatgcagtcatcgtaccccactccacaccacacctttttggtgattttgtactttatgtagtgccattgagaattattgttcctgatctcttgtccactattgttatgacttgtctaatattacttataggtcactgcattttattataacttattttttcattcctggttactgccttctgccagtaacacaaacgctatggtcaactttcacatctctcaagacctcagtttacctctacctatgaaacttcaacttaaaaggctctgcttttaactgttatattaggctgagaaaaagtatgagatgaaatacctgcaatgcctgatagaagtcagtagttgtggaatctccggatgtataagcatgtcctctttctgagccagtgtatatggtgtatacaaaaacattgtgcgggtgatatcttttctggacagacataggtttgattaatttattaggactggttgggaaggagtgacatttttttgggggatataggccagcccatatcagagacttcttggagtcatcctttgaaaagtctgtaaagatctcatttaggtattcttcccccaacttcgctaattccctggatcctgctagtatttagaatcttgttcatcatttgttggaaagtaatgcggaacattacataggttgaagacctagacatgtttggaagcctatttttattagtaacttcctgatcaagccaggacaggaaagtatgagtaatgaacagaaccaagttgctgagtgggatccttcatacatacttctttgaagctgttttttaaatttgtttctttaacagctttattgagacataattaatatactatttacccacttacaactgtacaagtcaatgttttctagtgtattaacagggttgtgcaatcattaccacaatctaattttagaacattttcactcccactaaaagaaaccttatgtccattatcagtcacaccccattctctcctctccccagttttaagcaaccactaatctactttctgtctctatagatgtacctcttctggacactttatataaatgaaatcatacaatatgtggtcttttgtggctactttcacttagcataatgttttcaaagctcatctatattataccatttttcagaacttcattccattcatcattgaagaatattccattgtacggataatatcagtttatttttctactcatcagttgatgaacattgggattatttcctctttttggctattatgaataatgttgctatgaacatttgtgtacaagagtttgtgtgggcatatgttgtcatttctcttgggtatatgtgcagaagtagaattgctaggtcatatggcaaatccatgtttaactttttgttgataaccccaactatttgccaaagtagctgcatcattttgcattctaacagcaaagtatgaggtttatgatttctttttttttttttttttgagacggagttttgctctttcgcccaggccagagtgcagtggcgtgatctcggctcactgcaagctccacctcccgggttcacgacattctcctgcctcagcctcccgagtagctgggactacaggtgcccgccactacgcccggctaattttttgtatttttagtagagacagggtttcaccgtgttaaccaggatggtctcgatcctctgaccttgtgatccacccacctcgacctcccaaagtgctgggattacaggcatgagccaccacgcccagctgaggtttatgatttcttcatatccttgccaacatttgttattatctgtccttttgaatttagccattctactgggtatgaagtggtatctcattgaagttttgatttgcatttccctgagggctaatgatgtggagcatattttgatgtacttttgcccatttgtatatcttcttttaaaaaacatctattcagattctttgcatatatttaactgagttatttgtctttttattgttgagttgtaggagttctttatatatgctgggtataacttccttatcagatatatgatttacacgtattttctcttatttttgggttatcttttcactttcttgatggtgtcctttgaagtacgatagtttttaattttaatgaagttcaatttatcatgtttttcttttgttttctttgtgtttttaatgtcatatctaaggaagtgttgtgtggggctgttttatgcacaatagatttttttaaacatttttatttattaaattaaaaaaattgagatggggtcctgtttgtgttactcaggctggagtgcagtggcatgatcatagctcacttcagccttgaactcctcagccttctgagtagctgggactacaagcatataccaccatgcctagctaattaaactttttttttttttttttttttttttttgtagagatggggtcttgctatgttgatgagctggtcttgaactcctggcctcaagcagtcctccttcctcagcctcccaaagtgctggaattataggcatgagccactgtgctcagccaatagggatttttttgggggcaaatgttcagttaggctactagcacaagtcaaattaataaataggtctcattggtcaggacaaagatgcttaatgttctgactccactagagcaaaaacctggaggtgggtctcagttacccctacccctattttcctggagccagaacccttgcccacctgggtgtcgctttgaaatttgtagtttcaggactaaaccttattagtggtaaagatctttgggggtgggtctaatgctgagtagaatggtcatccatctgtgaaatagcagcccaggaattcctctgatgctagaggaagtggtctgtaatgaccagctgcatcagctgcacccactctggtctctggagaagccctgcctctagtttgaagaatacaacttcaagccacaagtgctcagcaaccagagctaaggtagcaccccctagaggccttacctgaaatgcatcctgattgctaggttatcccagctcctctgtgctaagaacgacagaccggcatctttcccattggataattggtggatattggtgtccagactctcaaaggtggggctggcgaacttaaccctgaagtatgtccaggattttacataatccacaagaggtggttactgagctgcccaggtgggcttcctctgatgagtggggtacggaaggggcaactgtttgactacccttgtgaactcttgcatagatgaagaggagagccacaagtgtgcactaagagcctattagggaaggccgagattcgaagttggaatgaccaagtggcaaagtcgaagggcagacaagactgatgttggggttggagagctgagatttcagagttagacagatatgttggggcccttcgaggagtaagtgaagaaggctctagtgtgtcagtgttaggatgcctgaaacacatctttttatggcaggtatagacttgatggtgcactgaatcctaaatagcaagaacgaaatgtgtgcaacagtctttgcttcttcctcttcctgccatgtaaattttggtgaatattggtgtttcccagagctctatcttcagttttgttttcttctcaccctgaacatttgtgggagagaagagaaaaggtggagagctggtattgctgggggagatttgaggatctggagctagtaggtgaggtagggtctccactcatggtgatgctgagatgagggaatcacagcaagtcgagaactggaaagggtgcaaggttggtgagccggaggagagactctgcattggtggtgagtactgagagattgaacattgatagagagatgttgaaaaagccagggccaggacaaactagcaggagcatggtcttggttgattcccacagctggctttatgttgctctgtgtggtatggggacagagggtacactggctaagtttgaagggcaagcatgggactgaccaccatgtctgcctcagatgacccctcatccaaccaatcaacaaaatagaggacatgttagtgacaggaattttgtcctagtctctggctgttggagccaggtggtagagtaatgaggtaaggggtaaaggaaacagtcttagcaggttagaataacagagcaagccagtagtagtttgcttttgctctttaaagtaggtgagtggagtatatgtgttaggaggagacccagatagttcctgtgtttatatagagcatgcgcagcatgctgtaaatcccagtggcctgtatttcctccatgtttggagtggcttctaggatgataatggtttttggaagtgtatggaaatagtggagtaagagcaacagttgctttgaaaatagtccttctgggtggccatacacagggattcatatgaattctgctggctatgtaggaggatcagtggtggtgtcttcatggtgtgtgtggtatttggaagattctctgaaaataggtttattccctttctggccattggaccagccctggagagcattgagcattgttctctaaagcagaagtcaaaatggggaagcgtaaggaaggagtagcctgtggacatgaattttttgtttgtttgttttggtgaagtaggtggtgtcaggttgagacaaagacagccatttctgaaatgaagtccactgtgagggtttcccaggtctcatcaggggtcaggaatgattgctgccattattcaagcttcttggaccagtcttttaccagaacacaggcggatatgtgctaatgttaattgtcagaactatagtgagggccaaacagcatggtggagcttttgagtccagtaatccagtgaaatgattttcagaaaatcctcaagagaccacaggatgaagctatttagtcaagctccccgccacccttgaaagacaagctgattgaactctgaaaaaggttgtgaactctctctggatatgatagaacatcttctgtcttagtctaagagtaagaatgacgggtgacagagatttgtcttctgttttatctcctctggttggttttagcgaaattattctaggccctgtttaatggtttgtgttttatatcaatgattcattaagagcttattttagggaagttgcctgctatctcatttaaaaaagcaaaataacatttctctttttaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtaagtaattatacctacttttacttagtaaagctgaaaagtagtcagtagtactatctggtactttttgtaaatattcacatgtagtaagtgtttctatatttatgatttaagttcctctttcacattgaccaaacatatttgcagtgtgagtaacttttaaactactccactaaaggatttttttttgaatgaatagtgagcatatccaataaaagacatcagagagtaactagaagcccaaagggcttttatagctaggattcttttttttttttttttgtgagatggagtctcactccattgcccgggctagagtgcagtggagcgatcttggttcactgcaacctccacctcccgagttcaagtgattctcctgccccagcctcccaagtaactgggattacaggtgtgtgccaccacgcctggttaatttttgtatttttagtagagacagggtttcgccatgttggccaggctggtcttgaactcctgacttcaggtgattcacccacctcggcctcccaaagtgctgagattacaggcatgagccactgcacccagcctcatttttaatatacattaaaatttgtatttgcttcttgtgcctaggagcacaagagagcatttgtaaacattattctttatcaagtgtgatgagatttgagaacagattaggaagatggatcactcttcctgtggccttatgctttatgcctgcattctctctgcagctatagagggcagctctgaagaggcattcatatcctgtgtgtcatagattaagagacaccagatggatgaagggtagtcagaaagtatgtcagatgagactgtaagatgtttttctctcaccttttgggctatatgacctcagttactctctactgttaactgaaactactgttaacctacgtttagcccaagggaatggtttcctcttgctgcagaatttcctggagacacaagcagggagaagaatatactttgtacactttttaagtctgatatccttgccatgaaagtgagaaaaatcagatgtttttctcaagtatttaaaaaattctttaaaaactacattacacgtaacctgggcaatataaatacataagaaagatcctaaaattctaccattctaacgataacactttttgtgttttggcatagatttcctttcagtttttgaaacttagactctttgatatgaagatatattatattttaattattacttttagtgtttggctggttaggtagggtggagtttacttccaaaatgcttcgaaagttaaatctttatggcaatgggaatttttgaaaaacttgttatctcttaaattatttttatgatttattaagaaagattatatgttataaaggctttattgtggacttagattcaaattttagctttcagtaaattacagcaatattaaccttttaatagttaaataatttacttgaggcatcagtgttttaattttaatttttcttcgttttccaatgtttgatttatgggtgtggtatatattaatagaccataccaatatgatctatacatacaaataatttgcaaagaatggttcagttccatcttttgggtaccgggagtttggagttcactgttagggatggtgggaatatttatttatttttatttttatagagacgggttcttgctatgttgcccaagctggtcttgaactgctgtcctcaagctatcctcccatctccccccacaaaaggctgagattacaggcatgagccaccactctgggccaatggtgggactcttgaaagaacattttctacttcttgtacgtccttagcagtggcaaagaggtttctgagagcagcaatgtcagaaaatgacatctgctggccctggtgtctatagcgtcactacactactctacctgaagttctatatatcccaaagaaaaatgcttgtaagggaccttcactccttttgtaaattctctagatcagaaatatccaattggtaatgacctgcaaaggcaaaccacatgtcactttaatttttctagtagccattgaataaaagtaaaaagaagcaggtgaaattaattttaataaagactctattcaacccaatatgttaaatattttaatgtcattaatatgaaatctttaatgagatatattgcattctcttttttgtactaagtctttgaaatctggcatgtattttacatttatagacatcttgcttctaagtagtgacatttcaagtgctcagtagccacatgtggccaaagtccatcatactggacgatgcagttcttgatgcttagatggtagatgtgtttgaggcttgaggctatcttaattctgtaggaaaagcattaactgttgttaaacaaaaccaatctctttaacaccaaaaatcatttaaatattaatattttattttaggtacaaatacaggcatttatgaacagtagttttgggaaaatcttatcttctcagcaggctcttcagctacttcaaaggtattcataacactttaagcagagtagtttctggggggaataactttaaatctaaaaatacaatttcaaattaggatgttgttggaaatctgtcctacataaaccttaaaacttacaaacataaacttttcaattaccactaaatagactggtaaagatttgaaataaagaatgatatgttctaattgcattgttttggtagcagaaagtctttcaacaagaaaatgaaattatttctcatgtttcccctccctgcccccagccatgtcatatgtttggggttaattttataggtattgttggaaagggaacaaataatgtttacttctacatactgaaagaatttctgaaagtgagattatctaagaataatagattccaaaactttccattttccctcctgagggctcctgcaccttaaaagaaattgtgtatacttaaggtgtataacatgatatttttaaatatgtagtgaaatggttgctacaaccaagccagataacacattcatcatctcaccgagttatctgtcccccacatttttttgtggtatgaacagctgaaatcttctctcctttagcttcctttccctctatcctaacagcactactctctcaaagggcgaggaatcccagattagagggctgagcgggactagaagcctttccctttcagcacagggagggctcaagacctgtgtcagggacgcttgtggaactcttccctgagagccagcggatctagtgttgggtctggctttgcatggttccacggctgtaatgatggagacctggtgagaccattgtaaaaaaagtcaaaacagaaataacataattttgacatgtgacagtactgcacagatggcaggtaccattttcttggcgacttctgtctctgtctctctatttctctctgtctctctctttctgtctctctctctctctttttacctgtagtatgctgatgtcaattcattttattaccagaatgttgtagtttttagtatttcctgtgtgtcattcagtctctgaatggaagtgacatttagctgacaaagttgtttttgtgattatggttaaatggttatatggaattatatggaattaacactggcagagggagagtcaatgtgttctcttccatctttgctaagccatctcctcactcatcttgtaatctgtttgtcattttctcagggtgtcttacttgaatccccagacttgtctaggtctctcttagttataggcatttctgacccatttgtaatttaaataattatttttgttactcttggcagatgtctgtcttttccataagataattgtgggttccaagagaaccaggactgtacctcctatctcgttcattgctttgtcctaggacaacgaatgagggctggtatgaatatttgtcaaatgaatgaatggatggttagtatgacagcaagtcttaagtatatttctcatttactttttaaccattcagctttgattacttttaggtttcagaagctgaacattccctgtctgggattagaaataaaccacacaatagagcgtattcttcagtactatgtggctgaacttgatgctactaagaaggcaagtgtcatgtttataaataaaatggtacattagcacaaaaagaaaaaaaatctgaaaatatttgccatcattgtctcatgccaagcttttcagagtgattctttctctgctaaggagcattgacgctcccttctgtgtgggaaggtgcttgacagtgtatattgctggacagccagatttactcctctttgctgtgatcttaccagttatcccaccattatttattgagtaggaagtccttttctcattgtttgtttttgtcattgctgagtatgtacccaaaggaatacaaatcattctgtcataaagacacatgcacgcatatgttcattgcagcactattcacaatagcagagatatggaatcaacccaaatgcccatcaatggtagactgggtaaagaaaaggtggtagatacaccatggaatgttatgcatccaaaaaaaaaatgaatgagatcatgtcctttgcaggaacatggacgaagctagaggctattatcctaagccaactagtgcaggaacagaaaaccgaataccacatgttctcacttataagtgggagctaaacattgagtacacatggacacaaagaagggaacagtagacactggggcctactggagggtgggagaagggagaggatcaggaaaagcaactaatggacactaagcttaacacctgggtgatgaaaaaatctgtacaactaatcctcatgacacgagtttacctatataacaaacaaacaaacaaacatgtaaccctgaacttaaaataaaagttaaaaaaaaactatcatattgcccccgttttctggtgtgtgtatagcaaagcccgtttaagttagtatttttgcctatagaaatatgggctctagatactattatgacagatattaatatgtagctatgtgctccgtttgaatacctccttgaaatttgggataagggcagaaaaaaaatacatgtaataggaaataaaggtgaagagaaaattaagtgtcgtatatggtcaacatcattgtttcaaaatctcaggttaccttggatgtgcatttacatatttattgactacctactgtatataaaacatgaataatgataaaacaatacaaatatagctgtatatattttttgccttctcccttgtattgaattcaaacattaacatcagatttttaattacagctttatcattctcagaaagatgacccccctcttgctcgcaacatgccccctatagcaggaaaaatactctgggtgaggcagctctatcgccggataagtgagcccatcaattatttctttgtaagccaagaattaaattttaatatgtggattttggtggttttaatataacaaatatatcatatcctataatatttgtgtgcattaaagtagccaacaacgagccaattcttttaccaggcaaggaaaatttagtttataaatatacttgagagagacaaagtcaattccttcaggtttagtagataagccagtctaattacagttatctcaaagtcagtgaatcttataattttatgtcttttaataacacaggacactttgtaaagccttttaaaaagtaaaaataaaaaatttgaaaacaataaagtacaggcctagcacagaagcttacttctgtgtatgggcagataggtcactgatacatactcagtgaaggtgaagataaagccaaagagtgtattcctgtatgaagaactgccactgagagcggaatataatacagttgattcattctctatgtccttcagattattagatttctgaaaaacaggacagtcttgggccctgttggcattctgaaattgccagtttgtcttttctttgtccttattattttcttaaattttatttaagagacagagtcacaaggtggagttggtttgcttgatctcgtgccctttgctgaaatatagaacaatataactacaaaacagtagttttgcaagtaattgtattatttcagcattattaaatatgaagattctgttgtttctcttttgctgccatcatttgtgtcattgttctgaatatcaaaaaaaaattaaaaccctgagtccctactcgggggactcagttgctgattgactttgtggtgagagggcagagattgccctgtttgacatgtgaatcgaaacctaaatcttttgatttttaaataaagaaattttatttattttttaaatatttatttatttatttatttattatggagttttgctctctcgcccaggctggagtgcagtggcgcagtctcggctcactgcaacctccgcatcctgggttcaagcaattctcctgcctcagcctctggagtagctgggattacaggcacccactaccatgcctggctaatttttttgtatttttagagagacagcgtttcactatgttggcgaggcaggtctccaactcctgacttcaggtaatccacctgccttggcctcccaaagtgctgggattacaggcgtgagctacggcacccggccaagaaattttatttttatcgtttgatacatggttacctttttttgcgtgctggaatttaggaatttgccctgttattcatggttcaaggaacatcagtcaattatatcttgtccagaacagtgggatgggatcagaaaaggaggtagagacactgaatgcctggggcaggctgtggggctggaggcctctctctttctaaaccctttgtttccttttccagtcttccctctatatactgataacgtttccctacttctgcttcttgctgatatggccttccccatctctgttttactgtgaggcagaatctaaactggtagcataattatttgatatcattttacatataagtactttcattatttggatataaaaacattcagcagtcttttaaagtaaatcttttcccttaaaaaaacagaaaaactcagacattttatcaagtccggacggtaaagctgtcatccgtcagtataacaagatctcctatgtgctggtggaattcgaggtggtctatcacacagcctggatcagagagatttcacagttgcattacggtgtgtataacactgccatgagcctacaaagtagggattaggtgattttgaatgagttcatagttctggagaactttttccatcccttccacataatcttaggatagttacaatttagatttagggatgctacagtggtttatttgtttacagttgttaataatattctgattttataagtgaaaatgatcatgaccttgaagatgacatacttaacttaggactttctaccaaaaaccagtatttgaaagtaaaaatatctttagggatatttctccagactttatgaaagtgttcatattcagttgtatcatgatatagattcaaatctcagtcccattctggagagaaaaaattgcatcctgccttctttcctctctccctgcttcccttccttcctgtgtctctcctttactttctcccttttttattactgaatttaatttcaggtttgagctccagtaaatgaagcgttttagtgcactgtgtctgcgtgcctctgaggggagggcttatgtgttgccaaggctttgggcggagttaaatgtgagacgggatggttcttagccattatccagccctcctggatgttgtttttgtgtgggctcaatggttggtcagttcagattcctgctttgtctcatcttaaccttaaactcttagttataatctcaaccctaaactcttatacgtgaccttggtggaccccttactgggtcccttggtagaaaggtttctccctcccaaaccagcgtctccacctcagcagagcacagcattgcaggcgcaggaagcacaagttctgcaggtgggttgctggaacggtggtgagaggagtcactcctacttctgcctcttggttccagaactcatgtattttagctgtgtggggacacagcacttatttacaggccattgattcacagcatacctgcatcctagaggacagtgccccaacccccgcagggtgtcgtccctaacaggaaccgtaggtaagcctttaataagccacttttatcaggccagctgtttctgggtgctgtgctatatggtaggaccctgtggactctaaagaaagcctgtttatggagcagaactctcaaaggagcttcgagaggagcttaaaactcagactatggaaaaaggcaaaagagaatttttaacaactgaagcatatactggttttgttttggttctacaatgccgcgcacttaattttctttttctcctggtggtttttctacccccaataccctttctcttatctgcacatattcaaaaacaagctctacagtcacctgtttcatacagcctttccttattcttcctggcagaaaataataattcctccagagcccaccatatactttatctgtagctctttctcaggacacttactgctttatagatctaccttgtgtcccctacaccttccaaggttaccctctatgtctgtttcatctgatatcctttaaaaaatggtcatagctaacatttatacagtgctcaccatgtgccaggctttgtctcagcacattacatgtattatgcaaattactttaatcctaacagcaaacctacaaggaactattattagccttgttttacagatgagaaaactgagacactgacacattaagtggcttgcccaagatcacacagctcattcaaattcagatagtctggcttccaaatccgttctcttaaccatttaaaatactgtactgtttctaacagtgtcaagaatgatgccaggcatgcttgggggctcttaaaatattttaaaaatgtccaataagtagacattagacaatcttgatgagtaataattttatcaagttttcagaagagtttgttccccttgagaacatcagttggcctctattgggtgcactatactcattgcagtggattgatgtccaggagaagtgatcacatacaaacaatatgaagtagaattctttcatactttcaatatgaagtagaattctttcgtgttttttcacaagtaaaacaaacagtcagtagaattctttaacttctttcatttcatttcagaaatgaattgctctggaaggcttcctttgtcctagtgatgtgactgtacttggccacataggagcttctagtaataattggatatgtagcatcagcctcctttagttggttgctcagtaaagtttctctgatggtggttcacatacgatgaaatgcttgtcttgtcctggagcagacttcctgactgtcattattggtctgttttagttgtcttgacctttttgtcttttcaagcaagctcagtacagttttaaggaagacagatttaaatgttcaaaagttcttttggaatttccttggtaggataagtgatttatttatttatttatttttattttactttaagttctgggatttctgcacctgtccacctgtcatctagattttaagccccgcatgcattaggtactttgtcctaatactttccctccccttgctccccaccccccgacaggccctggtgtgtgccgttcccctccctgtgtccatgtgttctcattgttcaactcccacttatgagtgagaacatgcagtgcttggttttctgttaggataagtgatttctaatccatcttaaaaagattctaagcgagttggataaaattttaagttgaaattgtcatttagcttgaaaacctgcatcattaagggccatatcaagactaattttatctgatgagtaaaagtcaactaacttcaaagagatatacaaactattttattttactagaagtttgatgtggccacattcaacaaaacaatgtgaggtttggaagatttggtaattgtgataaaattctcatgttagtagtgtttgttaatacaagatgtaattcaaactagcacatgcttgtctataataagtgttttattattatgcctgtagaagttcttcatgttaagctaacaaataatctaaggctacccagtaagaactgcttgggcttatgtatttcaattcataataaaatagatatctgaaaatgcttgtttatatgaatgatgtttatgtgagatgtagtgtaaaacatcttccctcctttccaggatttcacaactcaatggtatttaataaatatttcttactgattttgagcctatttatcagaaatacaggatggagatttaatttaaataagcctctttaaagaagacagtttggggtctgagtgggaaagagtttgaaatgaggtggggcatcttttgtgattctaaccatcttctggttctttctcaggggtgaagtcataatccataagataaactgacatagacctattcaacccactcagaaaaatattgcaattcatagcacaaagcaccattcttggtcaatgtttctctccctggatctgattttgtggctttgcagacactcttcattcatttatcttagttttgagtattcactatgtgccagacgctgtgccttagcacctggggcatccaaaacatttcctttgccctcaagaagttagtaatccagggggcaagacagaaatataaacacagctggaagcagaaaggaaattcagaatgagtaatgtcaatcattatttatttgtagctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcaggtaagatagattatgttttctaattatttttgaaggagttttttggtaaaaaaaatatgtatatatatatatatatccctgcagttatgcttcatggcattgagggaaaatttgttaatatgttgattcttgatagaattaaaatactgacttgcaaaccaaagaaaagattggaaatggaaagcaaaaagtgagaagattatcagaaatcagatttaggtttctggataatgactgacgaaatagcaagtttcaaaaactattcttaatataattttatagatcttgtgcattaaattttataatatacttatcctagaatatttataagatataaattaataaagtggggtgactatacaatacaagtagaggtgattctcaacattgtggggcaaaaaggagcattatttcaattaaagttcactagtgcggcaaagtaaaatctaacaaaatgaaaatggtaggcaaaaactgacattaacatgtactgccgggtgcagtggctcatgcctgtaatcccagcactttgggaggccgaggtgggtggataacttgaggtcaggagttcaagaccagtctggctaacatgacgaaactgggtgtggtggtgcacgcttgtaatcccagctacttaggaggctgaggcaggagaattgcctaaacccgggaggtggaggttgcagtgagccgagattgctccactgcactccagcctgggtgacagagtaagactccatctcaaaaaaaaaaaaaaaaaaaaaaagtgccatcaaaggttgatgattgattcaatctttgattcaaaggtcgaatcaaagtatattcagatcctaacacattgtttctaaaatgtttgacaagagttaagtaacatgagaaattctttagaaagccagttaaaacagcaagctgcattaactcctcttctttgcttttcttggcaggctgtggacatgtattttggaatgcaggaaaatatataaatgcaaggacattttttttccagtacaattagtaatagcaaaagactggagtctaactccaacaatacagaactgattaaatatgagttataagataactatacagacattaatggaacagctgattattcaatgagaaaatgaactctattcctgtggtacaacatttataattttataatcaataatataataaataaatttcagacttttcctgtttttttttttgttgttgttggagtcttgctctgttgccaggctggagtgcagaggcatgatctcagctcactgcaacctccgcctcctgggttcaagcgattctcctgcttcagcctcccgaatagctgggactacaggtgtgtgccaccatgcccagctaatttttgtatttttagtagagacggggtttcaccatgttggccaggatggtctcgatctcttgaccttgtgacccacccacctcagcaacccaaagtgctgggattacaggcctgagccactgcgcccggcctattgtttgtcatttttatgatagccctcctggtgagtgtgaggtggtatctccttttgattttgtttcatttccctaatggctggtgatttttgagcatcttttcatatgcttactaaccttttgcatactttcgttcagcagcatctattcagatcctttgctcatttttaaattgagtatttgtctatttttttagttataaagttcattttaggttttaaatactatcccttatcagatatatgatttgcaaattttttctcccattctttgggttgtattttcattttcttgatggtgttctttgaagcacaaacattttaaattttgctgaagtccaatttatctactttgtcttttgtgtttttggtgtcatagctaagaaaccttttttgaatccaaagtcatgaagatttgtggcgtgttgtcttccaacagtttaatagtttagctcttaccaaaatagtatttaattgtcttttttttgaaaaaaactggagtaacgttggtattgtggaaactggatttggcatcaaaagccatgcatgagcttttttactggctagctgtgactttggaggattaggtttaaatgtactgttataaatcgaagctaatatagtttgcattacatcttgcaagattttagctagtattgaacaatatcaagaaagtcaaagttctttagccagtgtcaagtagaaataaaacttcaactacaagtaatgtataaaggggaaagaggaatcaagagctttgaaactattaggtaaaaattgaaacagtttgaaacagtttaagattattaatttggagataaagtaactcgaatctgcatttcccacaccacagtgtagtaaattacaaaatagtaaaaaattgatcatcatggatcatctctaaaacaacatctaagagataacataaaagcttattctgtttgtgtggaaaagctaaatttattttgactcgagaaagcaagtgtggcatcagtgataagatgaggatgttttaatgtgtcagaagataaggaacaaaagaggaaatgtgtaatgacagatatcacaaaaagataataattcaaactacttaatatacatctagaaagacaagtgataaatatgaaaaatgaagatgtagaaattgctactgacttgtttaaaggagatgctcaggtaatttacaggtacagagaaagtgtggtaaatcagcataagtttaaatgggcagctgtcatgatgacaggactacgaggaaactgggattatgaaaccttcctggaatgaatcaaaatgtgactgctactttaaaatgaattaaaataaaacatgccatttcaacttcctacagggtcttctgcaatattatgatgagttatgtcaggaagtgccttctgtgtttgtcaatctgatgaccccaaaaatgaaaaaggttggtattgctgaaggtttgtattgattttcctgttatttaaaattagatttcggttctataaactatggattttggaacatctattcttctttagaccctccatctttctagttcaattttatagctctgttttttttttttctgcagaatttcttgtctaagtttcgttgcctttgaaaaaacaactaaatctaaatcatgagcattttttctgaaaattcatgattgtttcctggacagccaaagatggttaaaaataaaaagtcatctttattaggtgtaatagagggaaaatacatgtaagaaaatataacatataatatttgtaggtgataaatcctcttctataagtgcagatgctcctgttgataatagaagcagttgtgtttttaccgtttctaggtggaatctgtgttgaggcaaggactcacagtgttaacatggtcgtctttaacactggaaagcttctttcaagaagtcgaattagttttggatatgttcaatcaacttttaaagaaggtatgatctatacatttaaaaagctatcaacatatatactcaggatataagtaatagtttgattattatgaaagctctttaaagggtatgacttttaactaaaaggacatccgttaggtttaaaatatcatgttttgggctgggcacagtggctcacacctgtaatcccagcactttgggaggccaaggcggatggatcacgaggtcaggagtttgagaccagcctggccaacatggtgaaaccccgtctctactaaaaatacaaaaattagctggacatggtggcgggcacctgtaatcccagctactcgggagtctgaggcaagagaatcgtttgaaccagggaagcggaggttgcagtgagccgagatcatgccattgcactccaacctgggcgacagggcaagactccgtctaaaaaaaaaaaaaacaaaacaaaaaactttatatttcttttactggattggggtcttcatttaagtttgctttattcttatccctgaattaccttgcatttaatatgttgaaatgatggttcaacttcacactgtagcttagaatatggggtaattatagactgtcaaaagtggcagaggagagtgcttaaatattaatattaatgtatttaatattaactagatgagatgatcatcaaattgaagattgtctattgatttctgacatattggctacatagaacaagcctgtcattttagatgtgctggtctgtgtgtcatggcagcatggtgtagtaaacaaactcagaggctttggagttagataaacctgggtaggattctctgcctgttactagctatgtgttccttcccaggttgctttacttctcagagccttggtgtctttagttgtaaaactgggatatcagtgcctcctgtgctggaatcaggattaaaggagataacacaaataaggttatggcacatgttattgctcaagaaaaatttagttttatgtcaagctttctttgcagatgtcctcctaaaatgttcaccaaattatgcttggctcaagatgcaagtttctagacttagccttctaaattaatttataactcaagcctcttttggatgaaaacctagctctaaaggaaagaagagtttttttttcttacatttttcttccttgtagatcagtgacttgtgtgaaatgcatattgatacagttctgaaggagatagccaaaactgtgttgatttctctgcctgaaagtggtgctaccaaagtagaagatatgttgaccctcaatgaggtatgcatttgttcattaaattagaatcacaaaaatattggcctataaacctaaaatgtgaaatttcagtctaaaagtagaaacctgggtcagtagcatttagactttttttttttgttttttgtgaacattctctgctccaaggactttcatgccttcaatagcaagagccctggccacaacctagactaacattttgttgatatcctcagcctaatgctggcgtttcctggggctctgtaagtggttcacagctctcttccactgtgcatggctaccagggccatatcatttttctcatggctttaactccaacatactttccctctaagtcactcagaaacctgggaatcatctagacttctttcctcaccccttcatttcctatatccagccagtcctgagaggcttagccaggacttttttttttgagaggaagtttcactcttgtcacccaggctggaatacaatggtgtgatcttggctcactgcaacctctgcctcccgggttcaagtgattctcctgcttcagcctcccaagtagctgggattacaggcctgtaccagcacacccggctaatttttgtgtttttagtagagatggggttttgccatgttggccagactggtctcgaactcccgacctcaggtgatccacagctttagcctcccaaagtgctgggattacaggcctgagccacaactcccagcctaggatttttttcttacttagattttgcttgagtttcagcctgttctttccctttctaggtcaggtcgttactgctcattttgactttagcaattcatttggtgatccaactggtctcgctgcttccatgtttaccctgacacatccatccacattgccatcaaatctgattgtgaaatgccccagcttaaatccttcttggcagtggcacatagtccttgcaggataaaatgtaacctcttcagcattgttatgttgaaactatttagatacctgtttatcctccattgactcaaaagcacaaagacaggaaccctgtctaaacattttcaaggaccagcacataatgcaacctctcttataaattcaagacatacatttatgttttgaactgaactctttctttttttgagacagggtcttgctctgtcactcaggttgttctgcagtggtgtggtcatggctcactggagccttgacctcctgggctcaagtgatcttcccatttcagcctcccaagtagctgagattacaggtgcataccaccacaacttgctaattaaaaacattttttttgtagagacagggtttcaccatgttacccaggctggtcttgaactcctgaactcaagcgatccacccactttggcctcccaaagtgctgggattacaggtgtgagccaccatgcccagccttaaaattatttgttctcagttttggggtcttgactataactgagacaacactaaacaacccattacattaaattagttaattaatttagttttttgagatgaggtctgccacccagcctggagtgcagtggcaagatcatggctcactgcagactagaattcctgggtttatgtgattctcctacctcatcctcccaaagtgctgggattataagtgtgagccaccttgcctgtgagatgacccgttttaacatcctgttcttggtgtgttcaagtttaagatgattatatcttctggattgggtgttcctctatcattattaagttttttatccttaagttattttgtttgatattgatgtaattataccagcttttttcaggttactatttttcagatgtgtctttttccattttatgactttcgtcctttttggattctcctattttagattttgttcttgtaaagaacatttaactgtgttttatttttaatctattctgaaagtctgtttttaaaaaactggtaattttgacctatttacattaattgtaactattaattaatatttttggaaatacttctactccctgccctctttttaaaatttattaacttatctatttctagatgttattttatattctttttcaaatatatgtgatctttttctcatgtctttattctatttttctttagacattaaaaaatattttatattttacaacataatttcactatctgaaaaaaatgggggagtctaattctgctctgtgctgtttctaccaactcttgcccagagtggcttgtttcttcctgttttttacagttttggattgggagctaatgcacacacatctatttgtgggaatgctggacagccttggttgagaacctgtttctttttatttatttctatgtgatgcctaggagttttaccaagttgggacaactttatgttggtttctcagaggatagaatttctaaagcttcatagattgtataaactcaagccccaaacctatgtaagggtaaactagttgtaaattcccaagggagaatttgctccccgccagcccagagcctcaaccaaggtagctgactttcctttctcgtccactctttccctgagggcctagcccttgatttacctgatattaagcaagggtggggatggggtaggtctcatttctagcctctcacccttgtgagggatccaaggccttaattttttttttttttggttatgaaaaaacaaagcccatagaagctatggtttcaggttgctttttattttagtttctatgctttaaaaaaattgagatgtaacatatactcagaaaagtgcacaaattttaagtgcaccattcaatgaacgtttacatatgatacacccttgtaactgtctccatgatcaagatatggaacactttctgtatcccaagtgattcctttgtgctttactccagccagttacacttccttcccacccctaaaagtaatcaccatttgacttctatcactgtatattagtttcgcctgtttttgaacttcatgtaaatggaatggtgcagaatatattctctatttctgacttcttttgctcagtgttatatgtatgagattcatctttgcagttgtgacacattcgttctttcatttcaacttctcattgctgtatagtattacataatacggatttagtacagtttatttgttcattctactcttgagggcatttagattgtttatagcttttggttatatactaagaattcttgtaaatttttttttgtggacttaagcactaatttggtggatatataccccaaagggaaattgttgagtcatagattatgaatatatttagctttaatagaaattgtctttttagagtttgtctctgaactaggagccagacaagttcacgcattacatttgattgaaatatctctttaagttttaaaaatcatttcccactccccactctttgttttggctgacaacttttttattgtgataaaatatactaacatagcatttaccattttaaccattttaagtgtacaatttagtggcattaggtacattcccaatgttgtataaccatcacaatgatctatttccaaaactttttcatcatctcaaactaaaactctctaccaattatacagtaattctccagtggtagtgctaagactcaagagtgtaagttgctgggcacggtggctcacgcccgtaatcccagcactttgggaggccgaggcaggtggatcacgaggtcaggagatcgagaccatcctggcaaacacggtgaaaccccgtctctactaaaaatacaaaaaaattagccaggtgtggtggcgggtgcctgtagtcccagctacttgggaggctgaggcaggagaatggcgtgaacccaggaggcggagcttgcagtgagctgagatctcaccactgcactccagcctgggcgacagagcgagactgtgtctcagaaaaaaaaaaaaaagagtgtaagtcaagatgcaggaggcagaattctgaagagcatgcttgtcaagcagtatgcccagtcacttgccctggagtgatctaagatctagtaacagttgggctgtcttctcacaaacctaccagcaagtggcgttatagtgaagccagagtatgatttgtaatgacagggcaagttggatcacactcctgactgcaatcagttttggaaacacaatatatgtaacattaattttttgagacaaagttggtttgggccaaactgtggtttcagatcgtatttgggaatcagggctatttgcagtcagggcagtgttccttgtcttggcgcatccaagggtggtttaggacagattatgcgaattattaaaaagctttcttctgttagtttccagttgttctttctgtcctgtgatcctagggctgatagtactttcctccttggccagctgggtcccttttaggatttaccaatgggtgtgctagaaggatgctggaggagagagaagggacttgctctttcctgatttgcctcctgttcctgacactactgcacccacaacaactcttcactctgccaacagcacttagtcacagccctggctttcccagcccttccagagccagccccgtgtgcctttcacggtaccagcatcatgaggtccctctctgagctcctgagatagcagtgctggctgggcagccccctcacttctctgctccaggttctaataactccatcctcatcccaagtcctagggatgctagcttcttcctgctgtaactgttatatctctgtgtgccgtcagtgtccctgtaagcattttgggtccttttaagggaggagaccacccctcatattgtcttatgcccaatttctgcctccaaagaaagaagtaaaaactaaaaggcagaaatgaaatccacaggcagacagcatgcaccacaccctgggcctggtagttaaagatcgacccctgacctaactggttatgttatctatagattccagacattgtatggaaaagcattgtgaaaatccctgtcctgttctgtttcgttctgattaccggtgcatgcagcccgcagtcacgtacccactgcttgttcagtcaatcacaatcctctcatggggacctgcttagagttgtaagcccttaaaagggacagcaattgctcactcggggagctcggtttttggagacatgagcccgccgatgctcccagttgaataaagccctttccctccacaactcggtgtctgaggggttcttgtctgcggcttgtcctgtacactttaactgtgtttaacccatcctccatattaaattctctaattttatttgttacaatagctggtgtgtcttccgttttcctgactggagcctaactgataacttctgtctcgatagatctaccaatggaatagaaaatcaaggaaatgttatgatccaagttaaacactgttaaataattaatgagtattagcaattctgtcaacaaaatcaacttggggctggacgcggtgactcatgcctgtaatcccagcactttgggaggccaaggcaggtggatcacttgagcttaggagtttgactccagcctagccaacatggcaaagccccatctctactaaaagtataaaaattagtcggggggcggtggtggtgcatgcctgtaatcccagtgaaaggagaggccagctaggcttcttaagtcgagtaaaggctcagaaagctgtgaaactcactcatttcctgcctcaagccttactttagtcctagataaataatagtgaagatatatgcttaaaatattcctaacaccagggtttgtgcatgttttcttccctaagaaagctataaacagtgaaaattttgctgtaagcttccctgtgtcctctctccctctctccctttcccctcccctgaaactaaaaggaattttaattgcccgtttgtttgtgaccagcagaccttatctatgcttccaattccaattccttgtaaaaatactgtgagatcctgtctcctttactacgccgctgcaaagtcataaagtagatgaaacctaagttgcaattcaggttttcctcaagatctaagacatgttaattgtctttgtttctcactctagtaacatctccccgctgcacatatttcccaccttaaaaagtttaaaaagtgatcaaagaaggtaacgctggctaccggctgaagaccccttccacgctgtggaagctttgtactgtcactctgctcaatcaagcctacagctttttttctcttagtcggtgtctccatcactcgcagctgccacgccaattcttcggcttggctaaggcaaaaacctttagcattacaccagctacttgggaggctgaagcaggagaatcgcttgaacctgggaggcggaggttgcagtgagccgagaccgtgtccactccagcctgggccacagagcgagactccgtctcaaaaaaaaaaaaaaatcaactttgctctatagagacaaaagcacattagtggttgccagagctgtggagatggggaaatggggtgactgctaatgggtatagggatgctttctgaggtgatgagaatattatggaattagatagtggtcatggttgcacaagtctgtgaatatactaaaaaccagtaagttacacacttcacaaggttaattttgtagaatgtggattatatcttaattaaaacaaaatttaaaaatcaatataactgtctcctagtccctggcgtacccctaaggcacttctttagtattcagtctgtttcttactgagttttaagaatggtcttagtcctcaaggagtagcgagtcttctcaagaagagatggagtccttattaggacaggatgctttactttgtgtggcctcaactgttcatgacgtgttatagaggtagtatttgcagtgacattattttgccacttgttgaacataagaggaaggtggctgagccattgggttgccagctgacacaggacatctgtgcagtggaatgtgtatgtctaagtttcttacccttggtattgatggcagtgtgggtcgttgtgattatctgaagtggcccaattcagcaaggattaatgaagtttgttttgcacgtgttctttgatcagagttcagacacagggttggagttgaggcacagggattgtgtatgggacagtatcagtgaagatcccagcagggtgagataccgcaggagtcccagtggtgggaagtcatcaccaccactagggctgaagggaccagggaagaaaattgtgctttcagagcccagtaaaagctgaagccatgtggcagggctctaccagagatgcagcctccaagcaaggagggaatgggaaagaaataccccaccttctctctcctatagctctcctgtcttctcttggtgcctcctcttgggttaaacccaactggaagtcagagaatgagggagtcccacaacgtagggcgtggcagagaaaagtagagaatggttggcaggacatggagtgtctggcaatatggctttgatggagtgacagggattattcataattaaaatcatgtaaataatttccacaatcagagctcttggcacattgctgactgctgctgcatccatttttccttcctttgggttctatggagaaagtttccacctctcttcaaaactgaggtcctccaaatgggctgttgattccatgcctacctgtcttctcggtgaccttgttccgccagttttcctttctcctgtatcctcagcgttgtcctctccactgggtccttctctccagcagtatcatatgctctcatgctttccttgccgacagacactttcccacttcttcctttgcttctcatttacaaccagacttctccaaatgctcgcacatgctatcttcactttcccatctcctattaatttttgtttccccaatttctggctcaaattatttctggcacaaattattattttttagcagccttattgagataaaattcacataccctacaattcacccatttaaagtgtacatctcaatgcttttcagtatatttacagagttgcacaaccatcactgcaatcaatttagaacatcttcatcacccaaaagaaacttcgtcctcattagtcattctccatttcctctcaaccctcccagccccaaggcaaccccaaatttcctttctgcttctatagacatgcctattctggacatttcatacaaatggaatcatacaatatatgttcttttgtgactagcttctttctcttagtggagtgttttcaaaatttattcatagtagcctatatatcagaacttaatttcttttttttctttttaaagaaacaacaatgtcttgccctgtcacccagactggaatgcagtagtgtgaatatggcttactgcagcctctaattccaaggctcaagcgattcccctgtctcacaaaacttcatttctttttattgctgaataatattccattgtatggttatgccacattttatctatccattcaccagttgatggacatttgggttgtttccactttttggctactgtaaagaatgctgctgcgaacataagtgtctattttttttttttgtggacttaagttttcatttctcttgggtatgtatacctaggaatggaattactggctcccaactccatgttatactctttgaagaactgccaggatgctttccaaagtgactgtatcatttttcattcccaccagcatgtatgagggttccaattgctctacatccatgccaacacttgctattatttgtctttttggtgacagctgtcctggtgagtgtgaagtggtatctcagggtggttttgacaaatgtttccctattagctagtgatgttgagcatctttcatgtgcttatttttatgtttttgagacagggtctcactctgtccctcaggctggagtgcagtggcgccatcttggctcactgcaacctctgcctcctgggttcaagcgattctcctgcctcagcctaccaagtagctggaattacaggtatgtgccaccatgcccggttaatgtttgtatttttagtagagagggggtttcgccatgttggccaggctgggctcaaacccctgacctcgaatgatctgcctccccctcaagtgcctcccaaagtgctgggattacagacgtgagccaccgtgccctgcctcctgtgcttattaaccttttgtatgctttccttcagaagtaggtattcagatcatttgctcattttaaaattggatatttgtctttttatttttgagttgtaataatgttttatagatactagttccttatcagatatatgatttacagttttttttctcccagtctttgggttttcttttcaatttctttatggtgttctttgatgcacaaaagtttttaattttgatgaagtctaatttatcaatttttttcttttgttgttctgcttttggtgtcacatctaagataactttgcgtaatccaaggtcatgaagatttatgcctatattttcctctaagagttttttttagttttagttctgaaattttacgtctataatccattttgagctaatctgtttgtatggtgtaaggagaaggttccgtttcattctcttgcaagtggatattcagttgtcccagtaccagttgttaatcccattaactttactattatatggtattggaaacgtatggaaaaatttgtatgacattctcccatttgttttgtgggtatattcttttcaaaagattactgtatgttattttgtcgaggtttctggatatatcatggggatgccaagataaacatgtgtgttcattctgccaagttaattagtgtgtctggttcctgaggggatttcaaagctgggatgtataaacacatatgtccaatctgccatgatcagctggaattgtctacttgcttaacacttattttccctgttagactgaagtggcttccagcctccgttaccattccagtgtttagcactgcattgaataaattgaaaaggacaaactgaatgaatgatggagcaaggtcagaagagtcggtgggtgtggagaggatcacagaatatccttggatagaaggagggacaccatgtctcctgggactaaaaaatgatgagaatgcattcagatacagattagacagtcaagaaaggaacacataacacatgggggcaaaacatggggaatatgggacttcccaaggcttttctggagagaagtttgcatggacagacttgggatcctctgcagttgtgttcttgaaggcccaaagtggctgctcctatgtacatttttttttttgagacagggtcttgctctgttgcccaggctggaatgcagtgaacatggctcactgctgcctcctgggctcaagcaatcctcttgcctcaacctcctgagtaggtgggaccacaggcacgcaccaccatgcctggcaaaattctaaaaaatttattgtagagatggggtctcgccatgttgcccaggctggtctcaaattcctgggctcaagcaatcctccatcctcagcctccaaaagggttaggattacaggtatgagccactgcacccggccctgatttacttttacgttttttttttagagatgaggtcttgtgctgtcacccaggctggagtgcagtggcgcgatcatggctcctgcagccttgaactcctgggcatgagcaatcctcttgcttcagcctcctgagtagctgggattataggcacaagacactgcatccaactacttttctttgtcctaaaatgagtgtattttgtgggcatgtcaaaagacttattgaactttataaactagttttcttttctgaatttgactagttctcaacttcttcctaaagcatttgctagtagaagagtttagaaagacaaagtgcaggcattttgaatcagacaaaactggtttcaaatagtttttccaactactgtgtgacctgggaaaatttcttactctttctgagcctcagttttctctgctgtgaaatggggaccataatattactcaccccattactcatcccaagatcagtgtttaactaaatgagttaatatgtgtaaagctcttaaattgatgcctgttatacaacaccatgctcaattaaaaactttatctaatttaactctccaaaccaatactctggattgtcttcttttgaaaccacatctcagtttcaacttctggcatcatcttctctccaccccttcagccttctttcttttcacctatgtgaatatcaaggtagatttctatgtgtgattgagtcagggataggtcaaagatggactttttcatctttctgctgttctttgggccttagcagctatgcttttagccattgacaattttgaatctgaagcattatgccattttcagctatctctagctttttttttcaagtgaagttaattatagttttataaattaaagtcataggactaattttcacagtgttacttttaagtatctggaaaataatagtcatttctttatttaacagacatacacaaaagaatgggctgacattctaaaccacaaaagtaagcatgtggaagaagctgtcagagaacttatatcaatatttgagcagatttatgaagtgaaatacactgggaaagtaggaaaacagtcaggtaacttttctcgttactgtgtttgaattacaagatctacagattcgttcttatgtaagcaccttctgcttagcaggtactgaattccagaccctcccttccccagaagcaaagaaggtgttcagcataaatcacattgtttgtaccaacagtttaagcccagagagttctttttgttagttcgggaatggtgggaacccctctcaaatccaagttcccaaccccggtccagcgttgcaagttggccttcctatggatagcagtctcaggcctgctatgctaactctatttttttttttttttctggtgcagcattcttatcaagtcactttgactatttgatttattttactttttttttttttgagaaacataaaccaggaaaaggtaaattctataattttcttgaatctggaaaacttaatctgggtgaaaccatgttttaagactttttttttttcttttcctagatccttctctgtgtagagtaagctatgaattcctacttacaactatctttggggtttgggtacagataaatggtacccagttgaagagtgcactctcaaggaagaaaacatgatatggaagcatgtattctccaccatccattccccctcccatgattaaaggatgccctaaaaggctcctaacttttgattctgcccacaccctcataaccttcattcagttggcttgactgggactaagagaaacttccttacttcatcacatctgttcaggcaaatttgtatgacaaggtgcctgcattatttaaagtggatgaaataatttttaccctattgaatttcctgttatctcaataggttctaatagtttcagttttattaataagcccgagagagaagctgttgaatttgaatcccctttatcaggggcagggaattttaagaaaagattccctagtaggggagtgttttgcttcctagattatggtttaagaacacgggacttttagctttgctcagattattgtcctgtcctagatataacaaatctttggataaattggaagagaaagacatatttcattttaaagttttgttttcaagctctaaataagaactgattaggtaaaactttgtagttggaggttttacttgttagtattgtaaggggatgtgcctgtcagtcacgatccctgtttactacgcacctgctcttctccccagctgctgctcagggaagtagtgtgaggctggcttcgagcaaggctagccattgactgcaccagtagtaggtcactgacacagagtgtgccacccagactctcgaaggagacctgagagatggcactgccttacagggatgaagttaattagctaattaccaacatatttgaagtagggaatctgtgggaagctggctttttggagtgagagaacattccagtcaagcagagatcccatgaaagtgacatagcaagaagagagagagagagagagagagagagagagaaagagaaaactgtgcctggaacagtggttcttaatgggactggaagggattttgcccccaagggaatatttggcaaggtctggagacatttcagttgtcacacagtgtgtgtgtgtgttgggggtggccgggggggagggggtgggtgttgctactggcttctggtggataagggccagggatgctgttaaacatcctacaggacagcccccagcaacaaagaattgacccacccaagatgtcagtagtgctgaggatgagaaagcctcagcctagaatgagtatgcacatcacatctttcctcttagagtttttccacttagtttaattagtttcatcacaagcgtcaaaaacacaaaaatattatttcagtcaagttggaaaactcaaaagatagacagataatttacaaagataataggtaaaactctcttaaaacttttctgaattctagattgtatatttacagagtgtatttcttagtagaatgacaattctattgaggtggataatttaaattgaattcaaggatgactcctagaggaacaaatgcgaaaagcatttttcaaaaaacagttttaaaagtaagagctttttaaaaaggaacttcctaagaggatttggccatgtagaatacagacaatgctaaaaagtcaaatgttatatttttgttttgtcttttgtctatagaacagcggaaacacgttgtttttggaagtgaaacaggagagggtgaaaacaatgactatgaagctaatattgtgaatgagtttgatactcatgataaagaagatgaatttaaaaaggtatttattgtggaacaacttcatgcaattcacagaattatggtttataggattatagataaccccatatggtgctttttccaggcagttctgcaaccaatctaatttctaacaaaatacagaaagtataattttcaattttatactgtaggatcaggcaatcctttaagttttccccagtatcacagcttttgatgtgattctgtcaattacagtttatgtagtcacctctcctcattgtgattgaccatgttttctcatatagtaaatgtgacgtcagggattggagcagctgatccgtttgactcagaatggagaactttgttctcagttgttgtgtttaatggttatctgtattgcaagtccagattgtggttcacttggggctcagggatctgcattttaaactagcattatggatgaccactctggactctcccccaggagaagccctagataggcagattttcacattgagttgaaatgtgttgagaatgaaggttcagaagggggactggggtttctttttccttcttagtcctcacccttctggtcatgcatgagctctgaatgtcactgtcacatttgcactcattcctgctttctcctccccgggtcagttttcttttaatccttcatacccaccttcttttcattctttttctattttacccacttttacacaatctgatgcagttttagaaataaacagcacccatttattccactttcaccttcttgctcaaggatgatattgccagataattgggaaacacttttctgcagcatctagatttctgcagagtttaggcttctcagtaccatgcaccaggcagctgttagcaaccagcaggtgtcagctggagcactcccctctcagaagtgcctgtctttcagttgcattaccttttgacactggctgaagtccttagagcatgactgagtaccctcagaacctctccagttgggggatcactggagctgtgctagtggtcacctcataaatagcctctgcctcgcaaattcatctctcacattgctgccagaacggtctaacataaaaatctgattatgttcaggaggatgaggcaggagaatggcgtgaacccgggaggcagagcttgcagtgagccgagatcgcgccactgcactccagcctgggcgacagagcaagactctgtctcaaaaaaaaaataataataataataaaaatctgattatgtcacatctgtgctttagcttgatagttcactagccctgactgtaccccactgccacatggaaaatcttgatattcctctttgttcatgccttattactctctcttctgcctcaccaacccagtctcagaggggccgggttctagagcagtgaggaacagtatggccagagccttgccccgatgtatgactcattgtgtaagcaagacatgggcccacatctctgcctaccaggctcaaaacctgtcctgtgctctgatcaataaacttggctacttctcccaagggaaggaagggtgtggagagagggtcaaaccgctgtcccagagggtggaattttcatctcatatatttgagtattgcacattttaaaatacatttatccaccaagctgagcttcttgaggatggagactagttatcttcttgtgcccatgccgttaatcattgagaaatgtaccacatttaaagtgcttcaattttgttaggtgaaaattgagtattgagcaagccaggattactctgaacatactgtttgtgaattttggtttttgaataagtccctctggtttgctagggtgtttatgcaaacacatttttcatgtattcttatttgtctaaaaaaaacagacaagtaatttaggactgaatttatttctacaatatcattgaaattgtatagtttattatttgttgcctttcacatgccacatctaatattctgtcattgttttggggatgctctaggttttttggaggagagataccaaatttaatctgatttcttattacaggagtgtaaagaggtctttgcttttttctctcatcaattactagacagtcttcaaaaagctacacggttatctctggacacaatgaaaagaagaatatttgttgcaaggcaagttgaaaatatgctaattatgtctggtaatcatacttataatgtgaatagcacctcttataaatttattaattaaaaaaactataaaatttaaaatatagcattcattaaaagactgtatgaaagtatttgtgtaatactgcaagaactgtagttaaatgaacacccatattcccaacaccctgcctgagacaaaaaaaggctaccagtcccctcatgggtcctctcccttctcacctaaaagtaaccactatcctgaacttggtgtttatcattgtcttggttttcttcacagtttactatgcttttgtatccccaatccacgtatcatttaattttgcctgtatttgaactgtgcttggtataatgtttttgagattcatccatggggtatagttttttacacttctatgtagttggagtatacgtagtctgtttatccattctactggtgatggtgatttgggttgcttcagtttttgctatcatgaataaagcttctgtgagtacctgccacctgttgcacctgctaggagtgggtttggtgggtcctaaggtatgtgcatgcctcattttaccaggcagcacatagtgagagtacccatggcccctcatccctacagacagtattattcggttaaaaaattcttgccaacatacagggtgtgaaatggcatctcatcaggattttggtttgcattttcctggttactgatgagattaaatatactttcttgtgtttatgggccatttgttgtttctcttccttaaaagttgtgttcctagttcaaccactgtggaagacagtgtggcgattcctcaaggatctagaaccagaaatactatttgacccagcaatcccattactgggtatatacccaaataattataaatcattctccaataaagacatatgcacacgtatgtttactgtggcaatgttcacaatagcaaaggcttagaagcaacccaaatgcccatcagtgatagacaggataaagaaaatgtggcacatatataccgtggaatactatgcagccataaagaagaatgagttcatgtcctttgcagggaaatggatgaagctggaaaccatcattctcagcaaactaacacaagagcagaaaaccaaacaccgcatgttctcactcataaatgggagttaaataatgagaacacatggacacagggaggggaacatcacacaccagggcctgtcagggggtgtggggataggggagggatagcattagaagaaatacctaatgtagatgacgggttgatgggtgcagtaaaccaccatagcatgtgtatacctatgtaacaaacctgcatgttctgcacatgtaccccagaacttaaagtacgattaaaaaaaaaaagaaaaaaaattgtgttccttttttggcctgtttttctatcgaattggattaattcataagtattcttagtatattacattattgatgataatataacaaatgtcttttgtcagttttgccttatcttttcattttctttattaattttcattttccattgctgagttttaaaaatattcaaatttatcagttttagtgatttgtgatctgtttaaagaaaccaactcttccctacttcataatgtcttccaaaacttttgtagttttgacctttatatttagggttttaatttacatggtattgatttttatgcttagtgtgaggtagcaaattaatatatttttttccatatggttaattagttgaccaagcaaaagttgttgaaaaatcaacttacttgtgaggtcaggtgggggagttatttaagttgcattgtatctatagatcaatttgaagagaattagcatccttacaaatattgagtcttctattcagaattatgtattacctcttcattgatatgtcttctttaatatctctctgtgacgttttataaatctctgtgtaaaggtcctgcacatttttgttagatttattccttggctattcattgctgatttttaatttaattgtactgttcaattctcccagtgtgattgtggatttattaaactttccttttgtttcggtcagttcttgttttatgtattctatggctgtgttgttaggtgcatacaaggtcgtagtagctaaacctgcttaagagcacttttccttttatttttatttggcaaatccctttatctgtattaattctgattcctcacaatttagtttgtcattactttaccaaccttttttgtgtaattgtttcagtctctttacttaagcctttctctgtactttttagttttacctcttaaaaatattttatacctgataattttccttcagtctcattatttctgtcttagtgagttcaatttgtttgcatttattgtgatttttgatatagttgcacttaatttatgacattttattttgtgttttcttctcaacattctttttctttgattcatttcattatgactgttgtctttgcggtggataattttcaccatttattctcttttctgtacttcagttctttaagtgattacccttaactttagaatgcacatattttgctccaactaaaagaagtactggccaggcgcagtggctcacctctgtaatcccagcaccatgggaggccgaggcaggcgaatcacttgaggtcaggagtttgagaccagcgtgaccaacatggtgaaactctgtctctactaaaaatacaaaaagtaggcaggtgtggtggtgcacgcctgtagtcccagctgctagggaggctgtggcaggagaatcgcttgaacctgggaggtggaggttgcagtgagtcaagactgtgccattgcattccagcctgggcaacagagtgagactccatctcaaaaaaaaaagaaaaaagaaaaagcactgtccttagttttgcagttttctagtcttatttctgactacaagggccttggcaggctttactcactgaactgtacatattttattcctgtttgatgttttagttttacttttttgtaaacactcaaaaataatatattaaaataatttatttactggcataatttattaaaatctccaggttctcatgtagttttttgtatcccattggttctttagtgaggatctgtgagaggtagactcttttatccttttttgtaagtctgaaaatgttttgccctcatactttcataacattttggctggatataaaatttttctttgtcttttagtacttggaaagtatttcttcatttttttctgagttttgttgctgctgatgagaagtctgcaagagtctaactgaatattctcttttaatccttaatgtttctgcagttttctttaccccgtgtggatttgtctttatttaatcctgctttgttctcagagtgcactttctatttgagggtttatagctttccttaatgctagaaaaaacctcagcaattttccctttagttattgcttctaggatattctttcattgtcttcttctggaactcctattaattgaatgttgggtagaatgaccacataacttattgttccaactatggaacttttgtgagtgaaggagcactgtccagatgaggtgccaggacacagtgaatctggaactgtcctgggcacactggacatgtggttatttcatatgttggggcttctcattctcttctcgttgtctcctaatgactctgtcatctatgttatctttttgcctttctgaactacattatgggcagtatctctgtatctattctaaagattttgtcatctgtggcatcttaaatatttcaagaaaaaatactttttccttatcctccagatatggtattatttctgcctttttagtttagcaaattttttatttttttggaagagtcttcatatatcactgaacattttcccttactttagagcttgttatctggacattaatttttatctagagtgagtttctgtttcgtttttggatttcgttagctctctttcttacccttagacatattcacgcatacttgggttttaatgtgcaggctctctttgagcgagagctttgtttttgtgtttctttttccttctctctctccctatctatgagtttcacttttgcctctaaatgacacttggaaccctgagtacagaaccaggtcttatttcttcacagttactggcccctggagagatactgggggtatggcaggtttggctagggagcacacgggtagcctaacttagttacttatcagggaatttgtggatgtgcttcttttgccccaggtctgcatctcctggaaaagccatagctgcaggaagtaagttgacgcattttgtcttgcagcatcatctgcaagacagatgggagagcatcatcttagtttttggccttaagtagtgaggctggccgaggccccatccctcattgagtcctgtccatcctctatattccaccagagccaacctccccacggtcactgcctctttccagcccggaaccctggctaggctgtccttgagtttctctccatttctacttcatggagatgcttaccttgtatttgagcattctcatgtcctttatctcccatccatgattgtgatgagtttggcaaaaagaagcttttttgaagtatgaactcactatgctacattgatttacaagttctgcggcaatttagcaatttttgaggaggcatacatgaggatagtactaaaaacccttacttgtctaaaatgtctttctcttatgcccacacacgaacgctagcttggtcttctgggatcagaatccctttctgtcacgctctacagaggctgctccattggcttctttggtttcagtttttagaggagagttctgctgcgaatccgattttcctttccaactaacaacttgtatttgttttgatgctgacaggatttctcttttattcttgaaattcacaaattgtatgtttagatgcaggtggatttccccccattaatcctgtcaggcacctagagaatctcttgaagatgaaaaaaaaaagcctattcttaaggttaaaggagtgctttgctttaatttcccatatctacacagtattcacgtgccgtatctaggtagtaagcatctctgagcggagtgactctctggaaattacttagcctctccctaccttggtttccttatctacaatatggaaagaataataatcgtagggtctgcctcacagaattaatgtgaacatgaactggtaatctatggaaagtggctggcatacattaaaacattcaataaatgttacttattcttaccttttctctaagtattttctctctctttgtattttgcacctgaaattttggagaataccttcagctgattctctaatttgctatataaggtaccaaatgatctagtgcactgttcactgcctttattattcaactgttcctttatactttatgaaaactctttcttattctcaaattacacactttgaatcaatgcccacactaattttattgcaacatcttgaatttcactgggacactatgaattgaggggttttgtttgcttgctttctttttgttcagtcctttccaataatacgtttatctgggaaccattggccctgagtgctaaaagttgggtcttcacttttgaactgtggcctctatgtttcttgtgatcccctcccaccccccatctgcttgtatttagaaatggaggtgtaagttttcagtaatgacggtatttcttgcactcccagagaaaaagagaatggacagtttacatttattataattttgcctgggataggggtggaggttaagacagagggagctatgctagccagactaatttgcagctctgcatgtgtccttcataactggactcaggcgtctgtgctgctgtctgtgcatgagtgatattgtttaacaacgcggtttttggaaagcatggaccagaaacttcctgtttaatcttgtgaaaatatagataaagaagcatataaaagtatatgctggtgatctcatcttgtatctgttgcagggctgggaacaaagaatgcctttagtaaacattgttaaaggttattactgagaaagaacaacattaaaatagtagaaaatgtatatgagattactattttacttctaagactattgggtcattgtattttcttagttctctgcaatttagggttctgttataagtaatattctctttgtgtaatttggccttttaaaaatgatctttattgttcggactgaattttgtagcataataaactaacaatgaaattttagggtaaggttcatcagctaaatgtccatctcattgcagcctttatgggcgaaagcagtcagaagatattatttcctttataaaaagtgaagtacatcttgcaattcctaatgtggtaagtattattaaatacactgataatttgataaggtgcttaagaagtatagtactagaactgagctttcatttaggtaacattttggtcctatgtcttttttcactttccctcactatttaacaaattggaaatgtcatttatatctgttatgaaaaagctacttctgggatgggtgcagtggctcacgcctgtaatcccaacactttgggaggccaaggcgggtggagcacctgacgtcaggagtttgagaccatcctggccaacatggtgaaaccccgtctccactaaaaatacaaaaattagccagttgtggtggtaggtgcctgtagtcccagctacttgggaggctgaggcaggagaattgcttgaacctgggaggtggaggttgcagtgagctgagatcatgccactgcactccagcctgggcgacagagcaagactctgtcaaaaaaaaaaaagttacttctgtattagctcatgatgtattgaaggactcgtgaaagaattgagttaggcatctgttctgccagcagttagcaagcaccctacaaattgccttgctttttcttacttcagacattaaattatctaaataaaatcatcacagttgtccagatccctacctcaaacacatgactgtgaggcaacgcactaaggtaaggatggcagaagagaaagacaaaaagagcctgtgccctgagcatctgaatcacccgtgtcttcccatggcacttatctttacaactaccccagctgctgatgggcatctggaactccaagccacatgggatggctgagctgcattctgcgatgggtcaaaggataaggccaggcagaaacggtccgtgactcacctaaaaccacctttacatggtctgacctcctgaaggataccttcttagcttatttggcacatttcaaagaactgaggtcagaatcttggtggtgtagcttcttcagttactttgtttcatagatctctaacacatagtctgtaatttcccactgcattctgccaccctcatggggaaaaggatgacaagtactagtttgacctttttaacaaaatcaaaatgtcatttctatctgttattaaaaagttacgtccgcattagctcgtggtgtaatgaggcttgcaggaatcgatagcgggaaaacttcaggatagagaaaatctgcatcctccccatcttcctctatcattctccccctcaaatcagccttgcactgggccagccgaggcttgccccactcagtggggaatggaggtggtgaaaattgagggatggactgtatgtgccggcagtattacacatttgtttcttctttccacaggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagtaagaatgtaaaattagtcaatgatcttactgatcctttttggatttgatagcatatagatttttaaattattttatatgtttgataccttttgcatttaaaaaatagtatgtttcatcttaaacataacgtgcaggcattttttcctggctttgggtggtgggtgaaaaggatttttaaatcacttttctactatgatgatcttaagttaaaaattaaaataaaccttagcactaattttactttctgcatgatagtaggttggataaacttaaggtaaacataaattcgtcacttaagtagttatgaatatgatatgatagtgacccaaaatgttatgaacatttttttgacacttcctgtatagaaagaaactggtttcttttttattttattttattttgttttattttattttattttattttattttagttctagggtacatgtgcaggatgtgtaggtttgttacataggtaaacatgtgccatggtggtttgctgcacctatcaacccatcacataggtgttaagcaagcatgcattagctatttttcctgatgctctccctcccttcacccccatcccccaccaacaggctccagtatgtgttgttcccctccctatgtcaatgtgttcacattgttcagctcccacttacaagtgagaacatgtagtgtttggttttctgttcctgcattagtttgccaaggataatggcttccggctccatctatgtccttgcaaaggacatgaactcattctttttttatggctgcataatattccatggtgtatatgtaccacattttctttatgcagtttaccattgatgggcatttgggttgattccatgtctgctattgtgaatagtgctgcaatgaacataggcgtgcatgtatccttataatagaatgatttatattccttcgggtatatacccagtaatggaattgctgggtcaaatggtatttctggttctaggtctttgaggaattgccacactgtcttctacaatggtcgaactaatttacattcccaccaacagtgtaaaagcattcctatttctccacagccttgccagcatcttttgtttcttgactttttaataattgccattctgtctggcatgagatggtatctcactgtggttttgatttgcatttctgtaatgatcactgatgttgagcttttttttatatatgttttttggccacatgagtgtcttcttttgcaaagtgtctattcatgtcctttgtccattttctgatggggttgagaaactggtctcttcaactggtctctttaactttttaatggggttgagaaactggtctcaaaactatgtcacttccactgtgatgcagggaaaggcaaattgaaaataacaagataccaggtaaggcccagtgtggtggctcacgtctgtaatcccaacattttgggaggccaaggcaggtggatcatcttaggtcaggagtttgatatcatcctggccaacatggcaaaacactgtctctactgaaaatacaagaatattagccgggcatggcggcacacacctgtaatcctagctactggggaggctgaggcaggagaatcacttgaaccagagacagaggttgcagtgagctgagattgcaccactgcactacagccagagcaacagagggagactccatctccaaaaaacaaaaaacaaaaacacccccaagataccaggtaagctacacaaccaggtggctcagacccctatggcacctttctatgttgcactaacattgctttctcagcttacatctgtggtctcatggggtgttccctacaaccagctaataaaggatgaaaaatctcaggactggtctatctgaattggcttgatgtgttggtgtcagctgaaaatggacttctgtttcactacagcccactcaggagtggccctaaaggagagtgaaaaggggaattccccccagagggcagagcttcaagtagtataccttttttataaggagagtggtctgaagcaaagatatacatggactcttgggcagtgacgaatggctggactgatcattcaggacctagaaagagcaactttggaaaatcagaggcaagaagagctagggaaaaagcatgtggatgtatctatgaatttacataaaatacctgggaagataaatattagttccttcaagggctgatcatgatcttgaaagacacaatccaatgccataatctcaaatgttgaaatcccaaaagatcaaaatccaaaaaatataattctggaaaaaataattattattttaataaacagttcttttaaatatatttatttacatttttaaagggggatttgattttcagaattttagacatggattttatactttcgggatttagattttagggattttgagcttttgggatttctgagattatggtgtttgggattgtgttttctgagattatgaatcaaacccagttctttcttcagagaggttaaataatttttccaaagtcacaaacctaataagagggctgggaattaatccatacaagaagatcagtatctaatttttttatgtttagtccaatgtttgccattattctttattctctccctagtccattctatatatttttctattattgtagcaggctaaacataaaactataaattgttagatgcaaaaatctccttggacttatcaacaatcttgcaaataagaattctattatctgcaaaattatcaaccaagtacgatgtaaatagacattttcagacatgcagtgtcttttaaaatgtaccatcaacacatgcttttccataaagttactgaaggttgtagtcttccaaaataagaaagcaaaagcaaaagcaaaaaaaaaaaaaaaagaagatatgggatattggaaacaggaataaaacacagcagacaggtgaagggaatttcaaggtgaatgttgaagggtgattgtgcagtgatagttatgttctaagcatagagggcaaccagtgtgacttaggaaacaggtgagttttgactgctctcaacaaatgctggatgccgttatatatactgtcttttaacttgaaggcagaatgcctgggtaaacctggtctgtattcttgtctggactttcttattctcaccatgtgctgatgaagttgttgctctacactcattgctctgggtcagctgaggaaacttattcattcctcagaagcgttctgccttgaccaactactgagaactggaggcaggtaattgtgatataaggaaatagagattagctcactatcctggccattttcttgctggacatttattactcggctcacaaacacagtgctgccagatgccctgattgtcatgacacatatattttctaggacttatttatgatcctgccccatagcttcccccacaaagggcttttgtaaacttgtagaaaagatgaagccagaccagtcccagagactcttttcttgtaggagccttcgtctcacatgaacaattaatgttctttcctttatggctagttttgtgcttactgctcagcttttaaaaggtgtttagggatacacatgttggtttattgtaaagtttatcttcaaagaaaattcaggataatggttgcctctgggggtaagggcagggaatgggattagagaggtacctagagaggactaatctattggtaacattctattcttaacttggtggtgagtacattggaattcatttttcttcttatttaatatacattttacctatttcttgtgttttatatatgtttctgtaagtatatttcacttacccacacatagacttaaatacagcctcctatcaaactaggaataagacagattttccaataatgtcatctgtaaaaatatttagaagtattgcattatcaataaaatgaagaataaagaaggaagcccactattatcatttttatttgatagtttactagagatcttcattatgaaataagacaagaaaaaatgagaagaattggagaggaagactgagattgtccttatttaaagattatatatagaaaatccaggaaatctagaaataattgttacaaccaataagttcagtaatgtttatgtataaaagatcaacatacaaaacccccagtatttttacatttaccagtaatacaattaatgtataatagaaacacagattttttttattagccacaaaccataaggtatttaacaaataaatgtaaaaaaaatttgcacagcatttttggagaaaatattactgaatgagataatggaagacaagaataagtccacatcatgaagaagtcaattctttgattaatctataaatgtaatacaattccaaagaaatcataatagatttttttctgttgtcaacttgatttataaatttgattgtaaaattatatagaagtgaaaagagttaaaaatagctgagaaaaattggtgttgaagaaaagcaaggtagggggtcctgccctgccaaatagcaaggagtgttacaaagccaggctaatgaggaccgtcttttagtgatccaaagatagataacatacagcagaacaggacagagggtgcagaaatactcatgtttatgaaaatatatggtataggtggatttacaaatcagtggagaaagaatgtactatttaataaatgtggctaaggatttgtttccatgtggaaaaaacttacagtagtatcttgaattagatacacatcatacccgctattctatatcctataacactattccatctattttacaacacttttagaataaaacagcacaatatatttaaaccaccagggtagggaaggattctcaagacatacaaagctcaaaccatagaagaaaagatgtttaaatttgacttctttatatctaaaaacatctttaaaggactcttaaatttaaatgaccatgctgaagtccataataaaatgttagcaaactgaatccagcagtgtataaaaagtgttgtatagtttgaccaaatgaggtttatcccataaaagcaaggttggtttaacatcctaaaatacaccatatgaatagaataaagggaaaaaactcatgattatctcaatagacatagaaaaaatatttgacaaaatccaataccctttcatgataaacatgctcagcaatctgggaatagaattgaacttcttcaaccttataaaaggcatcatacttaatgttgaaagcctgaattttttccccctaagattaggaacaagtcaagaatactagctcttaccacatctactcgacattatagtggaaattctatcaagtggattaagataagtgaactaaattgaagatacacagatgggaagggaaaaagttaaaccatctttattagcagatgatatgattttgtatgtaaaaataacctaaggaatcaaccctcacacacacaaaaaaaccccattagaactaataaatgaattcagtaagactgcaggatacaggattaatatacagatatcaactatatttctaaatattagcaatgaaccatctgaaaatgaaataaaacaatttaatgcacaaaagcaaggaagaataaaatacatttaacagaagtataaggtctgtacactgaaactgcaaaacattgctgaaagttattctatgaagagatacatcatgctcatgggttggaagatctaatattattaaactggcagttcttcccaaattgatctacagattttatacaatctctatcaaaatcccagaagactttttttgcggaagaaattgataagatgatcctaaaatttgaatagagaataggggaattcaaaggacctataatggccaaaaaaattttgaaaaagaacaaaactggagaacttaccactacttggttttatttatttagagatggggtcccactctgttgcccaggctggagtgaggtggtgcaacctcagcttactgcagcctctgccttcttggctgaagcaatcctcccctttcagcctccaagtagatgggactaccggcacgtgccaccatgctcagctaatttttgtattattgtggagataggattttgccatgttgcccaggctggtcacgaaatcttggactcaaacgatctccccgcctgggcttcccaaagtgctgggattctaggcatgaaccactgtgcccagccagctggagtcaaaatttatcttcaaaagatgtattttcaagttagccctcattattagaactgatgcttagtccacatgtctcctgtcagcctggccacaattcttgtattttggattcttttatctctatttgaatatgcatatagtgaatatacatatagtgatacacaggccgattcctccactggccgtcaaacagctaaaactataggtgaaattctcttttaggttactgtgaggaggggcttatctctatttgaatatgcatatagtgattcttcaccaagaatctttgggatctaatttcttcaaccagtttattttagggtcatttttagagtaggtggatctgcctagttttcaatttgacaccctagaaaaataaaagcattggtgactattgaagactgtatcaaactgaacagtctaagaaaactacacaaatactgtatcagtaaaaataccaggtttaacaagcaggaagccaagatgccagatgctgaatatctacagcgctgacctttaaacaccccagcagaggttgtctcatttaattctcacaagtatatccacgaagactaaatacttggcccagggtcatttggataataaatgtaatgtctctccttgaaccactgcgctattcctcagggtggaaatttcaacgcttttaaccttttcttaaaggactttaacattttggggtgttttaatcagtgtctttcagttatcctctccgaataacagttcttctagattaaagaaatctagagctcaaaatctgacaccatagtttaatgagaatacatgaagatagcaagagaatagctcttaattactcaaaatagctcttagtttcttggagggagaatctttaagaaaatacagtttgaaaaagaatcacaaatattaaaactgataatatttaaagttgaatatagaagttatttatagtgtaaaaacatctgttttcaggatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggtgtctttctgctacttgtgatgttgtttgggttttgtttgtctctaattcttgagggtggaccaggaaaatatcagggataatgacaggaacccatgagcagaggccaagaatctataaataccaagcacctgtcaccttctagctggtgtaattctcacatggacacactgaggcaattgatattactgaggctcagacagattttgttcaatttccttaaacaattgagtaccaattatgtgccaccacggactagaggctaggtattcaagggtgcgtcacacttatgtagacccagctgtatttcggttagagacgcaagggaactttagaactctgaataaccatgccctgcagactgtgaaattcctcgcttcctggtggacaccctatttcttacccagccactggccccattgcacacacaagtgtaaatgtgtatgagcaaatgcaattttctaatgtaactatggtaagatttatactgttaaaaaattaaaatattgactattttcttaccacaggaatttttggctaacaacccctctctgactgaaatcagatcagaaattctacactatgctacttttgaacaggagattgatgagttgaagcctattattgttgtaggagcacttgaattacatacaggtattttaaaaatgtttattatgtaaagtatctgtactttcacatgaagtgttactttatttagcaagcagttattaagttatcttggtacaatagtattataccaagatataataataataatataccaaggttataataatagtattataccaagatatattataatattattataccattaaaagtaatggcaaaaactgcaattacttttgcaccaacctaatataaatgttaaatagttctgggccattgatattctttatacacacatccgtagacacactacacaggacgattcctccactggcagtcaaacagctaaaagtataggtgaaattctcttttaggttactgtaaggaggggcttgtatacatgagatgggactcaaacagtttgaagtctgccaagaagttgatccatttgggattagagtatcaaaggatgaggagacaatcattaatgcttgaaatagaaagatgactttattgcttgctgtagtgacagagagctgtactggtcaggcacagtgtacctggcagggcagactgctagtctcatacagggtgtctgggcagcatggagttgaaggactgtggacgtagacaggttgacatcatctgtagaaggatgcttactcaggtgagactgttgtaggctgattggcactcagaggcgggtttattggagtaagtctttcttgactagttgacattcagaagaaagggcctggcactgatagggttgtacacatatgagaactgatgttgacttggtctatggtttgggtttaaagctggttgtggtggctcattgttaccatggttacataacaatcagtcttatcctaagtttgtggaaagattttattctcagacaatatttgaatgaggtattttacatccattatccaccttaagtagattttcaggtctgttatcaagaagttaatgtaactgtggctcttgaatttggccacttgggttacttgacctctttaatctccatttcctctgctgatgaaaatgacagtatccacctcacgaaatgctttatatgagacgcttagcatagtacctggcgtatgattgatgttgaataaatattaaatattattattatatctaccaaggaagtacttgtgattctctgaggaagaatcacaagtaccaaagaattacaagtacttaagggggactatttacctggaaatcagaaactatgcatcagtggcaataattacaagaacttctgtagcgttttggaaactgtatctattattttttaaaagttcacatttgtctcctcataatggttagcactatgatccacaatacaaaaagcaactgtagtatacagacagagtgcgctggggagcttgtttttggagagtggcatctaaaaatggaagaggtgatggtagttataaagagaggggagggtgggctgaatccctaaggcctgagggaaaagggtcccctaggggatctcatgagatatgatctcacagcctcaatcaccagactggctgcatggttgttcttgggccacgctttctcctcagctccacaggcctcttaagtttaatggttggaaggcaagagcggtgcagccatgtttcaagcttggcagaattggggagtgtaggggtactgagaggtaaaaggggaaggattgataaggcagagttgactagttagagctgttttgttttcaagaaatagaaacacatttgagctatgttaagggagaaaaggtttatcccagaatccagggtgcaactgagccttcagaatagaccagaatcagggacagtataggaagctgaggaagttctttctctatgcctctcgtttcttcttccctctgtgcatgagtttttctgcttcccagactatgtggctcctcctcaagcctcatttcaaactctcaagaaaagactctgattggtccataatataggtcatgttgacctgggacaactggctaggtccagggtccagggtcagggtagacggatactctgaccatgtggatgatgtggtgagtagaaaagcaagaaacctgtgaagtcatggcttgacacacaaaacaatagatttcactccacctcatgggatctctcgagaaaaatgcgagaatgaatgagggccgctaatgggatggtcagaagaagtgcaagggtcacacagaacagtgatagaactaatttcaaaaatgctcccccatgggctgtggtgtcaaactcatgcacatttccacggggatacatgctctgtgggacaggaattaagtcttcaaaatctagtaaccttatagcacatgtaattcatactaaccacatttcaagtgttcaaaagccacatgtggttagtgactactgaattggacagagcaattatagatgcccttatagtttcagaatgccagttatattctaatttaatttcttcttgtcttcatcagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagtaagaaatgattgcatttttttttcttggaatgcttttttgttttttaaagaaatagagacacactaagaaagtgattctttaacatattcatctattatgtagcacagtctgcctatttctcgtctctgatgttgatgtctttgggagaattttggcaattatcaacagtgaacagtatacaaaagacactgttgtaatacaaaggaatgttaatatattaataatgctatagtggggtaggtagtgtttaatttttgatactggcaccaacattttgtggaaagaaataattgtcccttgtcatgtcaatcccaacatgttaggcaagttctcccaagatctttggcttgccttagaaaccaattataggtctcactcatgaacggtggtgtaccacaggcagtatggcagaaacagttccctcaggctccatagtaaactgttggaacttacatcaatgaaaaatgtttttaggaaacagtatgagttttctattgctgctataacaaatcaccaccaacttaatggcttaaaacaacacagatcgtttattttacagttctagacatcagaagtccaaaaatggatctaatggggctaacatcaagatgtcagcagggccatgttgctcctggaggctctaggggagaatccattccctcctttttctagcttctaggggctgcccacgtgtcttggctcatggttggttcccttctagtgatgccatcacttctacccccatttctgtcattgtgtcttctctcacacctactttcctgccacactctttctcttatgtggacttttgtgattacatcaggcccgcctgttaatccagggtaatctccccatggcaagctccttaacataatcatatctgcaaagtcccttttaccatataaggtaatatgttcacagactttggggatcaggacttggatagccttggtgagtttgtctattactaatatttagaatgttttaggactaatattatttagaatttctgatacatggtgataaaaatcaagcttttgattctttttattattggttttgttgtctataaacaatgcactgcctcattgcctacaatatctggggaattgacaccactactgcctctttatggtacccaatatttatgactgttttatgctttcttgaacccattgagagtttatactctttggtagctaatgaactttttacttttactgctttaaaaaaatcgtggtatttggggattttggatgctgaccagccagacttcaagatataataaattattatatcaaattttccctgactgcaaaagcttaattctttaccaaacttttttttttttttttttttttttttttttttttttttggtgaagacaattactggtcatcccttggagcctggatcattcaagtttcttttctttggagtatctcccacatcatttcattctgttccttgtatagtcaacccctgttttaatacagtctgtatcttacgtggtgttgacatagggtcaaggaggaaaaagagacatatacatctccatcagaatcacctaggtgcttattaaatgcagatttcagagcctgtgatccagagttagtatctggtagtcagaatctaaaggtgcttttcatacacttttaattttggaaaccacttttctagaacatgctgtcttcttctaagacataggaatgtgtttctagaaggcgtctaaatcatttggcaatggctttcccttgtgatatttctaaactccaccttcatcctgcaggaagcctatgctattttaaacagatttgaagttgaagtaaccaaagaagaatcagaagcagttgataccttaagatattctttcaacaaattgcagagcaaagctgtaagtatgaatttaactacattattttttcttaagtcactatctccagaaaaaaaaggtattttatacctttttaaagcttaatatacagtcatgtgccacataacaatgtttcagtcaacaacagactgcatatacaacggtgatctcataagattataatactgtatttttactgatccttttctatatttagatacacaaatgcttaccattgtctagaattgccttcagcattcagtatagtaacatgctgtagaggtttgtagcctagcagcaataggccataccatatagcctaggtgtacagtaggctatccctctaggtttgtgtaagtacactcaatgatgttcacacgacaaaatcacctaatgacacatttctcagcctattaccatcatcaagcaatgtgagactgtaaattattttaatggctttattgagatagaatacacataccataaagtttaccattttaaagcatacaattcagtgttttttagtatattcacattgttgcttaaccaccatcattgtctaattttaaaacattatcaccccacaaaggaaaccccgtgcccattagcaatcactcctgattctctctcttgccccagccctggcaaccactaatctactttctgtttctgtggattttccttttctggacatttaatgtagactaaatcatacaatatatggtctttcgtaacttgattctttcatttaacataatttttcaaagttcatccatattgtccatgtgcgaggacttcattttcctaatgcctaatgagatagagcatgttttcatgtggccattttattggtcatttgtatatcttatttggagagatgtgaatttaaatcctttgcttgatttttaaaaattttgttgtctttttacttttgagttgtaagaattctttatatattatggatacaagtttcttatcagatatgtgatttgcaaatgttttctcttctgtgggttatcttttcgctttattgatggtgtcttttgatgcacaaagttttttactttgatgaagtctagtttatctttttattgttgttgttgttggtgtttttggtatgttatctgggaaaccattgcccaatctagagttacaaagatttactgccatgttttcttatgagagttttataactttagcacttaaattttgatttctgatacattttgagttaatttgtgcatatggtataagttagggattcgacttcatataaaagcatgtagataatccagttgcattgacattgtttactgaaaaaactatcctttcaccaacaaattgtcttggtagccttgctgaaaatcaattgatcatagatgtaagagtttatttcagactctcaatttctattctttttatctatatgcctatccttatgccagcaccacactgtcttgattatagtagctttgtgctaagctttaaaaagaaaatagtggcaaaatgcatgtaacataaaatttaccttcttaaccattttagtagtgttaagtatattcacattgctgtgcaaccaatctccagaacttgcaaaaaatcttgcaaaactgttactctatttaaacaacaactctccattttcccctaccatttctaggttgcctgttcactctgctgattgtgtctttatagtcctttctatttctgttaggctggtagtgatgtcccctttttcattcctaattttagtaatttgcatcttctctcctttattcttacttagtttaggtaaaggtagtcaattttgtcagtcttttcaaataaaaaactttggtttgttgattttctctattgtttttctattctctctaccatttatttgtgctctagtttttatcatttcttttcttcttgctctgggtttaatttgttcctctttgtttaatttgcaaagttgaggttactgatttgagattttttttcttttaatgtagaacttgatagctacaaatttctctaagcatttttgaagttgataaacatttatacaccaaaattagacattaaaaatgaactccaaggggccaggcatggtggctcatgcctgtaatcccagcactttgggaggctgaggtgggtggatcacaagttcaggaggtcgagaccatcctggctaacacagtgaaaccctgcctctactaaaattacaaaaaaatcagccaggcatggtggcaggcacctgtagtcccagctacttgggaggctgaggcaggagaaagacgtgaacccaggaggcggagtttccagtgagccgagatcgcgccactgcactccagcctgggcaacagagcaagactctatctcaaaaaaaaaaaaaaaaaaaaaaagacctccaagggatgacctacatcctttaattatactgaattttatagaatattaattaaattggacattggctttaacatttcttatttatggaaatatttgtcacttatactgaagcaagacataacagcaaggagacacaaaactgaagctgaggtcacagcttgtgactatagctccactaccagtcaactggatgattttatgcaagttaataacatttgtttctcaacttcttcttggggtcatttaggaaggataatttttttatgtgtctatgaggcttacttgaggtaatgtatataaaatacttttttgaaagaaataaactcatgtttatttaaattcatattcaatattaactaatagcttactcctcttgctggttagtcagaggagcgagtcttagaaaagaaataggaaatctctgttgaggtttagtgaaacccagttttctgctattatatcaatggaaaagattcatggctgagcatggtggctcacacttgtaatccctgcactttgggaggctgagatgggtggatcacttgagcccaggagttccagaccagcctgggcaacatgtcaaaaccttgtctctacaaaaaatacaaaaattagctggaaatggcagcacacacctgtagtcctggctatttgggaggctgaggtgggaggatcacttgagccccagaggttgagactgcagtgaactgagattgtgccactgcactccagtctccagcctggtgacagagtgagacaccatctcaaaaaaaaaaaaaaaaaaaagaaaaaagaaagactcacttaggttgttcctctatctctttaatggttagtgttaaacccactaacccatcctttagcagaaatagattgttctatactacagtcaccattaaacttgaggtaatatatgttccaatctaaagatagctgctattgttgagagcagttaatagcaggggccctggaactacacagccaggttttgaatcttgactttgcctgatgctggtggtgggactttggagaagttacttagcctctctgtacctcagttttctcaactgtaaaatggtaatcatattagcatattacaattttcttcatagggttgttacaaagattaaaagagttaacatatataaagagcatggcagatagcaagcattatttaagtgctggcaattattattgaaggtttaagcagagtatttcaggaccattgtgtagggtatttgctatttttttttaatacctagagtaatatcactttcttttaggaatttgctccaatgactgcaggcatgtgaccttattagagattgctaatcccaagtcttggcctagccccacagacaacatgtgacccagaccatgccaataatagtatctgtctcccatgtcacagtgatggcctgaactggatcaaccagaaacagttacagagaaattggctttgcctcttgagtcaggctagaatgatttgagtctcctgtaggttcatttgggttattaatatattttattacaagcaaacagagacttccttgttcatataggatatctgtgagatacacttgttggaatagaattgtaatttttgtttttaatatgttactttcactctcaggttgaatattcttttttattgtaggtttcagtacaagaggacctagttcaagtgcagccaaagtttaaaagcaatctacttgagtctgtggaagtttttcgtgaggacgtgataaactttgcagaagcatatgaattggtaatttaagtattttcttgctgtatgttgaaatgttctgtgatgtgtttatatgaaatgaaagtgatgaaccctgaggaataggtacgttgcatgtatgtggctatatttgcgtatttgcagctatcagaaaaaggggatagctaatcctttaaaccagggatgtccaatcttttggcttccttggccatattggaaaaagaagaatttttctgggccacacataaaatacgctaacactaacgatagctgattagcttttaaaaattgcagaaaaatctcatactgttttaagaaagtttatgaatttgtgttgggctgcattcaaagctgtcctgggcttcatgtggcctgtgggctgtgggttgggcaagcttgctttaagcaaattttatagagaaagaaaacagattttactgttaaaaggagcaacaactttggagattgtggaaggaacaaagggtctggttttgtcttttctcgggggctgaattctcatggtagaaaatgtaatatagttgttggaaggccgtgagaaactataaacttctaataccaggatattatgccattgattttgcattctcactaactcttagagaaccaaaaaggtccctaagaataaataatagatgtcatactgggtcagtcccgtatgctactcaaactggtattctgactgataatgttgaccttgaagttaaactcaagactgaatatgttcccctgaaatattctttcttttagtggtcacagtggatctgtattcataagatgatttaagcccttggtgctacttatataatgcttttttttttaacatgtgctaaacatatctgttgatttgctgcctcattctattgttaaagtaaatctaaaatggagaccaggtctgaagagtccctgaacagacacagccagtcacttatataatgttttttttttaacatgtactaaacatatctgttgatttgccccctcattctattgttaaagtaaatttaaaatggagaccaggtctgaagaatccctgaacagacacagccagtcaggcttcttaagttaccttgcccttccacaatttgcagacataagcaaatctgaacacactatttcttataaatgcctatattagaaacagcttaactaatcagaagccgcaaacaagcccataattatataactggggactttccagcagaatagaccaaagaagacaactttataaatgaaaccaataaaatgttttctttgcattacttctgtgctcactctgtaaaagccttctgcagtggagaccctgaaccaagtctagttgggagtttcccaatttatgaattactgtgtgctcagataaacttaaaaaaaaaattattgggcctcagtttactttttaaacactattatattgggaatctagtctattatttagtatatctatcatatcatgattgaccatgttaatatacttaatagccttcatttttccattgggagtagcccctgttattttaatttgttgctataaattcatttattcctttgcttattttggggagtgtttttgaggattattttgcaactgtgttctggttcatagccaccagacactgctttctgcttcttccaaatattcaatttacatgtgtccctatttccatattgggctgaacagttattaaaaagaggatgttctcagaactctgtatcagttattctaatgcacaaacacagcatcatcatttgtaatcataaatgaaatttggcagagcccttggggtacacactccatatagaatgtaattttgtcacattttttattagctctgtcaaggtcctttaaaaatgaatggaagatagagtgatgaaaatgttctaaatgattgtggtcatggttgcacaaccctgtgaatgtactaaaaatcattgacttgtacactttaaatgaatgaattgtatagtatgtgaattccatctcaataaagctgttagaaataaataaaagcttcaagtacaggacacaattaaataatttaaattaaaaaaatgcttgtttacttaaatggaaataatagataaacccaataaactgacaaatacatatgattaagaatgaaaatggagattatattcttccttacaggaaggacctatggttccaaatataccaccccaagaagctagcaacaggctacagatatttcaggtgaaaccacattttttttgttacatcgacaatgtgtaatttaaaaaattattttggggaaagatggaggttttactttttaatagaaaagtttgtatttcaagtacatcagtccttaattgtattctaatctgctaaatgatgcaattgactcctctgtctccctccatgctcctctccacagaatagctctctgtatttttagagaataagactgattctcaacttaagaatataacttattttagttctaagcatttcatttgatatgtaaagtaataagaaatcatagtatagtaaaatttatcaaaataatattttaaatattggcaaatgttttccctctgtattcattattttgtcttccttttgcatccatctctttaagtttccctacttctttgtcctatctcctctgcctgtacaatactcattggatcaggccaaccattcaccatctttttctacactcggattgctgagcgcgtctagagaaagttcacacatccacatggattaatactttgcaaattcatggattcctatgtgaacttcctcctcaggagcatcaagcaattctcttctttgctcctgctctttttcctgtttcccacagtggctgaatagtgtgattagttcttttcatgtcccctttcccacctgcattcttagtaatcaaaaaaaaaaaaaaaagatcagatgcctactgtgtggcttgctcaggagaaatttgatgaagaagtggttcttacctctaagctgctaaaatctgatagagagatagcaagctagagagaaaactgcaagtgcgatgagagctgtgacctaggtatgtgaaattgtgtaatggaaacagatgggctgttagagcagatggagaaggcttcctgaaagaggaagaatctaagctgcatcttgaaggactaattagagttagccaggggaagacggaggggaaaaagaaagttaggcagaatttgcagctcatacaaaggcccggcagagaggaaactagtagggcaatatggggagatgtaaggagtgcagggtggggtcgtgtacctttgggatgcggtactaaagaggatagtggtgaggaacgaggtgacagagtgggcagcgagcaccagtggagggcccggtaggcaataataaggagtctgaattctatcttgagggttggagggttctaagcagggagtgatatgatcatacttgaatttttaaaatagttggttttttaaagatttttagtggtactaatgtagagactggtttggagagaggaagatcaaactgagggcagttttggtagtaaaagcaagaaattgtaaagagggagaccaagcaagtgacacctgtataatgaagaaaattggatggatcatgaatttattaacgaagcagaattgacgggcctgaaacctggtttgagggaaaaagttaaaggtttccaacttgggcatattgacgaaggtagaactacttatcgaaggagggcatgtagtaggaggagtagctttggggcttgtttgagcggatgaccttgttttcaagtttgcagagaaaatttagggcatgtgatgtaaaccaactgattagtcagcaactgggacattatgtgccaagattttacccaggggtgtggttgctaatgtagccaggtattgtggcatgtgcctgtaatcccagctactcaggaggctgaggcaggagaattgcttgaacctgggaggcgaaggttgcagtgagccaagattgcaccactgcactccagcctgggcaagagagcaagactccatctcaaaaaaaaaaacaaaacaacaacaacaaaaaaacccaacaaaacaacaacaacaacaaaaaaaccatctcaaaaaaaaaaaaaaaggcaatgtagggcacatcttttgcctttctgtaccttctgttctgcctgtctctcgaggtgtgagccaaacaggctgtttggcatgcacttcactgggatatgtgacttgaggtcagatttgtagacacaacccttttcaaaatgagatgtactccaaccccctaaaaaaaacaggtgccaaaggctggatgtgtgaaggcagaggtgccttatattgggccttgggtcctgatggtgctctctcatgcaaatttattttggggagttcttgggcaccctgctggcctgttgacaaagctgatactttattcctgttcagctgatgctgtgggtgtttttatgttacttgcaacctgaaggaaaaaaaaggtgagtgattagcatccatcaatagtctttacacattgatgagtttttaaacaccattattttaatgtattctaactttagtgttattgtttatccttccttagtgttcacatagtcccactcttcatagtgaagagtcctatggactcttcattcagtacatttattgaataaccaccatgccaaccaccaaggaatacacaaagtacaaaatatggcacttgccctctaggaactaagagttcattcgagttcacctggtatcttcatgccttcctgatctgggtcctgtaaaatatactaacgtatctgtcagatctgtatttttgtctaagccttgtgaggtctgatgctggatattctccagggctgggaatttagggttctcgggaatatgctgtaccacttacacagagtgctcatatgtcctcacagatgggttacttctgttggcatttgtgctttgaacattgctaatatttagcatcccaaatataggatattcaaatcccaattcaaaaggaaaaattaaaagacatgtgcattaactttggtgatttaagttgttagaattatttcaaatggtgttaaaattggatcttcttttttatagactcttcattgcatgtacagaaaacaggactgaatggattagactaacactttgctcatttgagccctgtaggatagagatggccagtctaaattactgaaaaatcctgaattgtagagttttaaaaatgcagctttattacttttagatgtacttatgggaactcgaaatataggccttctggagaagaagaagaaataattttatataaaatgaatgcttttagaatgcttgaaagcgaactttcctaagtgtttaactttttctctgatagcttggtatcagtataaatttgcttcacaaatccttattttatagctattacttaataaacctcaacctagcttttatcccaatgaaaataaattccactttaattctactgaattaattgtattttagtacaatttaaaaacctttgttacaggccagtttcgatgatctgtggaggaaatttgttacgtattcatctggtgaacaactttttggattgcctgtgactgattatgaggttttacacaaaaccaggtaagtttagaaaataagcaagtattacatgcaaataattaaatactatctattagaagaatcatgtcaccattaaatcctttatcatgcagaggacactacagcttggagcacaactgaatattctccttattccagctattctttacaaattggacacacagtctcctatacaaaagaaacgttctaggggagtaaaaaatatgttgctaaaattttgagcatgcatggtctatatttagcctatgctttactttttcttttgactgtttttgcatagtgtcagtgattatgcagaagcacagcaattttgagtaacttttgtttatttagaggaataaccttcctggctccccttgccttcttttttttttgagacagagtctcgctctgttgcccaggctggagtgcagtggcgcaatctcggctcactgcaagctctgcctcccggattcatgctattctcctgcctcagccttccgaatagctgggactacaggctcctaccaccatggccggctaatttttttgtgtttttagtagagacggggtttcaccatgttagccaggatggtctcgatctcctgacctcgtgatccgcctgcctcggcctcccaaagtgctgggattacaggcgtgagccaccacgcctggctccccttgccttcttactccatttgtggtaaaatgctcttccccattgggtagacatagaatttattgagattgacgtccaaataagctaattgattataaaccacacatataaacaagtgtatttcaatcaaattttagaatattcttaaagaatttgaaatataactttccttaaaagcaacattaatacagtgatagtattagctcattagagtcttggctttagaaaataagtttatgttgacttccttcaaagccacaacgtgaaaatttcatgaaaatagacatgaaattttctgaagagaaatgaatgcttcagccatttagggtaggtggtttgtattctctttctaaaacagtcattctccaaacgtaatccattagccaattgtgttagaattgcggatgtctggccctcatttctgatttactgaatcagaacctctgggattgggtcccagaaaatctgcattttacacactctccaggtgactgtgatgcacactcagcctgagatccaatgcgttcaccctcaggctagcaggagaaatcatcatcaccatttaccatctggaccaacagaccattttcattttgatattttaaattttatgaataattttagagaatggtgagaatggtgagaagctttgaagttttttttttgtttgttttgttttttttttgagacaggatctcactctgttgctagtactggagtgtagtggtggaatcactcgacttccgtagttcaagtgatcctcctgcctcagcctcccaggtagtggggattataggtgcataccactgggcccaggtaatttttaaaaaattttttatacatacaggagtctccttatgttgcccaggctggtcttgaactttggggctcaagtgatcctcccacctcggcctcccattgtgttgagatttcaggtgtgagcacccgcacccaaccgagaagcactttttttttttttgagacggagtttcactcttgttgcccaggctggagtgcaatgacatgatctcggctcacagcaacctccacctgctgggttcaagtgattcgcctgcctcggcctcccgagtagctgggattataggcatgtgccaccatgcccggctaattttatatttttagtagagacggggtttcatcatgttggtcaggctggtctcaaactcctgacctcagatgatctgcctgccttggcctcccaaagtgctgggattacaggtgtgggccaccatgtccggtgaagaagcacttttattagaagatttaataataatttaagcagagtaaactcaaacttttattctgtaatatcctagtttgaagatgtatatatacaaaatggggaccagcactgaatgagactaactcctcatcggctgtcatgtgtgaacctggagcatatccatgctgtaaatatggatttcatattttaaatcatctccaatggatctgtggcttatcattaattctgacttttcttgcacttgcattgtcaagactcaaagctgttgaaaactcggacagtcatcatttttttaagagaagactgtcatctgttttgcttcataaatattgaagactttacttttagatttgaatgatcaattccaagaaattttaaatttctaaatcatctatttccttgaatacacatctgacttcaacatttgtccacttatgaaatgtatcaaatacaacttatgtaaatataaataatgaaggaacactgtcacttatctttttcacaaaatggaatagtttaggttcttgttgcaaaatattgcatgataaggcccttatttctattgaagtctacggaaatatattgtttacttataaattactggattttataaaattcatctaggttatgatcatctgaagacatagtatgagatttcacatattaatcaatttcaccatcaaaagggaatgctgctttctctttcctgtttaatacttgggaaacacatttctttgtcaattttcttctctttacccttttaggtagaaaatgaaaaattctgaattcttaactgtattaaatgaaagcaactgtattaaacaagcaaaaatcaaaagacaacaaaaatggtgtctctggcattctttttatatacttttttgaaagattttgcaatactttatgttatacagtaagaagcctggaggatgatgcagtagtcatttttttttcactgttgcattaccctttaggcaatgtcatcattctcttttcttattttttttagtcatttttagcatagttgagaataataataagtggtaatgaaataattctaagaatgatgaaaaatgaatcaagaattgaaaaaataggacaactaagatcgcagaatgtgtcttagatttgtaaaatctactacgcctacatggtaattacaagatagaatgggctgggtgccgtagctcatgcctataatcccagcacttagggaggctgaggcgggccgatcacctgagatcaggagttcaagaccagcctagctaacatgatgagacctcatctctactaaaaatacaaaaattagccgggcgtggtggcatctgcctgtaatctcagctactcgggaggctgaggcaggggaattgcttgaacccaggaggcagaggttatggtgagccgagatcgtgccactgcactccagcctgggcaacagagtgagattctctctcaaaaataaaataaaataaaataaaaagatagaacgacttttacttcattacaaaatttatttttggtttttgaagtatctctgatgaagaataaaagttgtgaatgtcaatccttataaataaacttgaaaactaaaactgaatccagtagaaccttatggcatactaagggctgaggaatttctgggagaatccacaaattctgttgagtggtcaatttggtgttttacacatttaagaattttcctttacttggaccttttattcttgttttaaacacagtaacttcatctgggcacatgtgggatttttttttttggataggatcttgttctgttgcccaggctggagtgcagtggtgcaatcatagctcactgcatccttgaactcctgggctcaagcagtcctttcacatcagcctcccaagtagctgggactacagtcacatgccaccacacctggccacatgagggaaaacttctggtaggaatagggtgtttaagctcaatcttaaaggcagatcagggcttagtcaagggaaatgttctcataaaatccagcttgtatttgaaagaaaaaaaagtcaaatgaaaccttagccgcagctatgaccttatcattaagttttggtcacattgtttgcaatgattggtatagtaagtttctcattaaaaagtagcaagattttttttctttacagaataaaccatttgctaatgtcaagttatagtctgacttggaatatttgggagcagtaaacttggccttaatgacagatctttaacgaagtctttgtattgaaaatggatatagttgtatgcatttggtatctataagacattgtacacgcaatgtatgaaatatttgattggatgaactctgcctttccaataatggactttattaaatattatacatgatgtgataacttagttactttgtttcccagaaaagaactcaacttgctgcagaagctgtatggattgtatgacaccgtaatgagcagtattagtggttattatgaaatactttggggagatgtagatattgaaaaaattaatgcagaactgctggaatttcaaaacaggtgagtttcaatggaattttttataatgcctgtcttcttaggatcctataggtatttcagaagctaatttattccctaatataatagtgtatatacataaaaccttcctcaaataaatgtgaaggtggcatattttttttctctttctttctgaaagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggtacataagtgtatacgttcttatcaatgatccattaaagaatgtctgctttttcttttctgggagttgtacagatattttatgagaggttggactaattgccctctataatgcaccctcaaaatttggaatgatcctgaacattcttgacttttatgaaataatcttgtaactcaatgagattatatgattatttgaaatacattatttgaaatacatttgttctggaacccttcaatacatcttccttgtccccagaatgcacttccacttaaaaaaaatttgtttatttatgtattgtgttcttggtgaatccctctgaactattttccaaatttctaattttatgctttttcctgttcagtctattaagtttttagaattttctattattacatttttcctttccaagatttttaattcattcttttttgtggccaatctttttttttcattttttcattaaaaattttctgtcccttttgtagattcttagatctacagtcttaaatctatatatattcccagatctgtaggtttcaaatctatagatttatagatgtcttcgcttatctctttgagcattttaaacataattatttaaacatttttcattagggaaaattttaaacacatacaaaagtaaagatctccttgctctagcatttatcaactcatggccaatattattttatctatactatctttatctatacttcaacaactccaaattaaacataaagatgttttcagattcttctttaagattaatttcacctggactgaatttttgctgtgattgttttttatgttggctatcctctgagccttagatttttttcatgggttttgtaatttttattggggtggctgggaggactcattttgaatgggcaggatttcaaaaattctggcttatataatgtgttaaaattgtctctgtccgtttgtgtcttcgttttccttgtctagtggctttgtggttgcctcctacactgtccatgtcccctcagccccaagttgagagccaggtgttgtaatagcggtctccttcctctactgtgctgtggtgtgatgatccaggaatgtgctgacctatttcaggtcctggttgtggggctggttttgtgtcaccccatcccccaggtccacagttccattaaatctagttgcctagatggcagctagaggcagtgttttcagcctccttccatgaatggagggctttagaccccagcccaggtactccttttcctatagatcatttttactcttcttcaccccatgggaaccaaaggcctggccccagtgtccaggcctcaggcctgtgtttcagctccaccaactggtttgcatagcttttccacttttggttcatggatatgtttgtcttttttttaagtctggctctgtttgcttttttacttactttaaaaaaattattttatccattattctatgtttttggagttgagaaaatgcaccatgtgaccagaaatctcccaaatatatggtttgggttttctgccttcccctacctctttttaacaacatgtgtgcacaaaaagcttttctttcaaagcatttttgtcctatttgtaaatatcactaagaaacaaagaggtagaaacactttggtgaccatctccttcttataagtaggtttttatacttaataatatagccattcgtaggctgtgctttattatacaatttcaagtaattccaggcttctgttaatgactcttggtacacaaaacagagtcttggtactgtctaccccagatacatctagttgctcagccacacatgctgtaccattagccaaattagattcctgctgttactggactcactgcctctaaaggaaggcttcccttcagtacagaatttcctcttcctcccagagagtctctgctggaatctcacctcctcctctacgaagctgttcctcctcagcacagacctccctcctcagaaatcaccatggttcacatcattcttaggacatttattacacagtaatttgtgttaagatcatttgtggaaacatctcacacctttaaattctttttcatctctgtgattctaactatgaacacacattgaggcattgtggggaaaatatgttacttttattttctttcgtgagtctttcttattaagtattctcaaaaaaaaaatatagaaaaacccataagaaaaaaacaactgatgcttaagcaaatgagatattcatattaggaccagaacaggcagaaatatagtaatatctatatgttacttgaaagagttcaaaagactcttatgtatattctcatttgaatctcatagctaatctctgggataaacagggcagctgtgattatccccattttagccaaaagttcgaattgaaaacataatctgaaaaatgatgatttaagttccattgtttcatgtatgtggtacagaaaaataattagtagtcggcgattagtaaataattagtaaggctctagtgtcaagttgcaacacaatgatctgaagccttttcttggctgtaaaatgactaaatgaactgggtgacttacaggtccctttcaagcaaaaaaaaaattctatgatttgatgatgcacttaatttgtagttgaaaacatcatgacatatactttgcttttccttcaaaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacaggtaattttataatttgagagagagatttaaatgggatatttagggttataaaattctaagtaaaagctcagttttaaagctctttcattggatggattctgcactaaatttggtattatcttgtctgttcctatacaaactgcccgttttccctaataatcatggcctccatctcttctttaatggtactcatctccccttccctatttttcctggtgggccccatcctaattattcctccccagactggcatcttgtcctctgaaggtcttggctccccactgagatgacctcttcatttcatcttttctctcctttgttcctctgacatcattgacctcttggctaatcctgttcaaacattcacccaatggcccgggaaaagcctgctggccacccgtgagagcaatctaccactacagcaatctacccattaggggcttggcacttacttagagactttcattttttatggtgaaaagagcctgagaccattatggcctgaatgaggtcacctgttcatcattgaactacgaaccagcttggaggtgcctatgatcttgagtgcagctttaggaaattcctgtaggactcagattaaatattctgtcaggtctttggcactggcaacctctattcctctggccgactgtgcagtagttctcaactattcttcacctgaacacacctaagaaatagctaatatcccttttccacgttgggatcactggttagtgagttgcatgctgcatgacctctggctccaggggcagtcttgtatttgcataatgacaaagctgccagtccagggagttctgggttgaatatataaaggtcaaggtcctcggatgcatcctctgtgttcagagaatcctggcaaagatgaccataggatattcagtacttcctagacttcatgggcaactgctgccctatggttcattgcaaattttgcccatctgacttcctggatgatgacctcttgatgaagggctgtagattcacctgggcagtgtctgcagccaagaaattcaggatttgaaggctttcttcaattcatacttacttggacataacctgatgagtaaaatacctatttgtgttattagtaaactcaatgtttacaaacttctaggccctgccagaaagagtataaggatagctaagaagtcatcaaattctgggagattctcttcctagagaactttgcagtgccaagtaggtctggaaagcctgttccagaactaaccacagactgacctagtagtgagtcatacctgctggatccctaggactactttgatgtgacttcagaaggaagctgtatgtctccttcggtaagacttgactgtaggtattgcctggattgtgacacttccctggtggatccctgattccatgggacttcatgggccatggtgggtttgaccacacaaagttgtacaatgcaggtatctagccaaaggacagaaactagctatgctcgattttatttcagatctcccttttccatctttagaagttatacaccatcaaggatgactcttttttttctgtgcagaacaattttggcctatctagttgcttcatctccctaaatgcctgcccatgccatgttggtttacatgtccttatttggaagatgtttttggcatattgactgcctttcagctctcgaccagtggccagggaaacagcataaactgagtattgggaaaaatgcttcttactgcctgaacaactggattacctacctccttagagcaatttatgtacaactccatttataacttcatgtataacataggctttcagggaaattatgagttgtattcaggcatcagaccgtacccagaaaaaaccccattctacatgtgaatcactctgtcctagatcagaagaagtttgaagatcctagtcaacaagtgccactcaccagcaaatgtcactgcaccacattgaaactgcttgcccttgctacacactgcagtcggcttcttgctctaactgtaggtagttggggtttttacccagtagcctcccattgcttcctccatggcatccattctatttcttgtcctcctttgttgtgctcagctttctggaccccttgtattctcataaacacttcagcaagccctgatgatcagaaaacaggagccctgctatatgggggtagcaaccctgggtctctagctctgcagaatctagttgtagtacctggtgtaattctctctctgtgggtgggaagagcacacctgtaagtgaacatcagacttcaagcttgactctggctgtgcggtcatcttctccaggtgaacctggtgatacctaaccctctcctgatctttagggatctgatttgtcctgtccctttagagatagtctgtctcttgctggatgaaaccttcaagaccattcataaaaggaaaatccctggatagtgttctcttttcctagattcagtagttccacagaccagtaacagtgtctcacatgttactctcacaagcagaccccacttggatttggttcacagactttttggaaaaccatcttattccttgcttggcatttactcccagaagcaaccagcacagttcctttgctggacctatgcaccataaaactaggcccattctcctattctatgactgacacatgggaacaataagtaaaatcactgcagttatatgagttttattcatgaaaagcaacagtttttattagctgtatgatatctattaggaactgccctttaaggacaaaacattcattcccaaagtaatatttcttctggaatttacttcggtaaggccatactattttctgaatcttctttgaaatgtgattttttccgttcttaccttttagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggtaaatatggcttttgtaattactgataaaataatttggtgtatgttgtctatatgtctctgtaaaagtcttcacaaagacatatggtcaaggcttgactatgatggggtttggcaaactatggcccacttgcctgtttttgtaaataaagttttattggaacacaaccacatccattcttttatatattgtctgtggctgctgtagcaccacaacagcagagttgagtagttataactgagattatacggcccaaaaagtctaaaatctttactatctggcccttcacagaaaaagttttttaggaagtgctgacctctgattagcagaaagaagaaacttacatagttttaaacagtgaataatctcgaggttgtttgaggatgtgaggtacattcaaatgcagtactattatagtagttcatgtcttctaagagttaacctcataatattcctctgagaataatattaaaattaatctatattctgtaagcacagatcaactttagttaattattactaagtctactactagcagatcagaacatgctgtggagcaagaaaacagccttgggaggctgtaacaaaacctttaaaacagctctattggggccttttaaataaatgccaataactgtaataactgataggtttagtcgatgaaggtaactttgctattagaaaattaagcctgatcttcctaaacttctgtatttacaagcaagatctatataggttaaaaatcaaggataaaagaggttttttttttgctttttttttttttgaaaatggccgatttcctttgtactaatagcacatttttaaaacattaaactgaaatgtatcatttttgttttttaatcagaagtctgtatttttaaaagaggaaagattatgccaattgctagaggcatttttgcagctaagtacaaagcttaatatcattcatagtaaatagaaaattttcacttgcgaaaatgtaaatgaaactttgttttgtggctttactgtcttttttctttttttccccgccttggggtactattgagctgtaattattccaaggatcctgagatcaaattattttcatgcttcttcagtttgctcctcaaaccaaaacacctggggtgctgaaacactagattggaactttaagttgatagctctgcaaattaatcatgtggtactttgaaaaacatgttaaatgcaatgaaacaaataagcaataagcctcattgtgataaagaagcattttaatatgcagttttataactttgggtttgtgtcgctcagaattaattcaaatgaaaaaaaattgtctgtttaaattatgcagcctgagactaatagaggctggtttgaagaactatagaaaattccaaggtgaagactttgctttttttcaattatccaaatgctaatctttactggctatggatgcattttcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtaagagtttaatttttaaatcacatatcattttgtatgtgacagtgttttatcccaaacttactagtattgactacatttctggtttggtagtgatggttaaagtggggctaggaacttaaaatttcacatagattgaacttttctgtgaggaagacacctttgacttgggggtggttaaggcattgtattagtttcgtcaggctgctataacaaatttccacagacagttggcttaaagcaacagaaattcattctcacagttgtggagacaagaagtctgaaatcaaggtgttggctccctctgaaggctctaagagaggatcctcccttgcctcttttggcttctggtggctctaggagtttcttggttcatgccttcataactccaatctctgtctctgtcttcacttggccttcttctcctcttcctgtgtgtctcttatgacgacatttgtcactggattcagggctcttcaagatccttaacttcactccctctgcaaaagccctttttccaaataaggtcatgcttcaggatttcagggaataggacctggacatgtctttttgagggctaaaattcaagccactgcaggcgtagaatagaaatgtgcactaagagaacaactcaccaaactcaaatatcatttttattttattttatttttactgtcacaagaggatggtgtcaggataatttttttaaggcagttcattttcaatctctatttgaaatagggtgataatacatcctggtttgtccaagtttatgcgtctgtcctggcttaatggttagttgtcctccctttcactctcaaaatgtgttggtttggagatacggtttgtgctccccctgggtttaagccatgagctttccagcagtctcagaaaggtcataggagggcatctgatgagaaaggagaggacagcagatgatggggcagccttgctctgaatctcttgttttcccaagtgtcatccatggtggagcatggactttggttttcaccaaacattgcaggggtaggtgataagtgactttaggtgtttgctattatcttagcaaagatgttagtgattatgtcttgactaaaaaaataataatttaggggaaaaaaaaccacttggtaacatactgtcgactttatttgaaggtatttggagaagaaacgattactgtttccaagattcttctttgtatctgatccagttctcctggaaattcttggacaagccagtgattcccacaccatacaggtataatctaagaatctgtgatctaacttgcttttcccacgacatacacaatgaagaataaaagtgaagttaaaatcttaaaaatgcaggcaggaaagaagagtattacaaattacattgatcataaaatttcatattttctgtgtatttggagcctgtcatcctgatgcagtccagcagtgttaagtgactatgcactgactatgccattcctagctgtgtgatcttggcaggcttcctaatttccccatccctcaattccatatctgtaaaatcaggatattaatggttctcacctcacaggactgtcatgaggattatatgagatcatgcatagcagagtctctagcacacagtatgtgtttattaaatcgaatttatcattatgagtattttattctaaatattcttagaccaaatagggattatattttggatttgtccttttttccttcctcaatacttctcaaatgcttttagccatttcctagagcaatactttggaagaggaaaagaaaaaccgtagcaaactgagagtgggaggcacagaaggtcccatcccagggccaattctggtctggggatctgggaaacggctaatgtagtttccttgttggtttccagggacttgtaacaatgagaaaagagaatagaaaggctctgtgaaaggtggaggtagagctaggagagatggcaggactgagctgtatctgtcgggggaggaggggggaggcggtgtggtccagtccccatctggtggaaggtgacagtccttagtctaatctgcatagcatgggaggggccatttgcaggacttggagaaaacattcctctggccttgattttaaaaagtagacctccaagccagttaagggtcaaagcagagtctctctctattttttgagacaataaagtaaatacttaaccttttaaaaagatacaaaatattaaggcttttaaaaacatctcagcggcttttgtgtccagcctcatgtgtgacgttttcctctgtcttacagccgcatctccctgcagtatctgacaacatcaatgaggtgacatttcatgcaaaagactatgatcgcatcatggccgtcatatcaagagaaggagaaaaaattgttgtaatttaccttgctttaaatttttttattagaatttctttaaaaacttaggttgaggagaatacagttctcttacagaaaaaaacaggaggagagggagttctcattctacagccctgggctttgttaaaaactagtttagataaatcctttaacttctctgagactcattttgtaatttatgaagtgaaagttttggactaggtgatctgtgtagttccttccagctatagtattaggtgattttacccatatttaaaatattttgtataaaatatgaaactgtttgcttggcatagggcactatgatttattaagtgtgcatggaacgtctgtaaaaatgccaaattattatcaatttataatatccttgtaattttgttttagttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggtgagaatacacaatgcttaagtaatggtgaaaagaaatggaaataaaggggaaggatgcttagcaggtggttgacctgatggtgtgaggcaattgtagctttgaattaggttagagtggcctactcacactcattttagcctcagctcccaaccacctgcttgtcaacctacaccattctagaccaacccatcccatgtcccagaggaggatatgccactattttcccatcatgaaggatacatacattgagtctaatagatacatatgtaagcgtgtgtgtgtgtgtgtatttgtatacagaaactcctcgacttatgatgggattatctcccaacaaactcatcatagttgaaaatatcattaaccaaaaatgcatttaatgcatctaacctaccaatcataagcttggtctagtatgtcttaaagatgctcagaacacttacattagcctacagttaggcaaaatcttctaacaccaagcctattttataataaagtgttgattgtctcatataatttattgactactacactgaaagtgaaaaacagaatggttgtgtgggtactcaaagtacagtttctactaaatgcatattgcttttgcactgtcgtaaagtaaaaaaaatttttaagttgtaccattgaaagttggggaccatctgtgtgtaagtgcacgtgtgtgtgtgtgtatatatatatgtatatatatacaccaattcatagatatgatgtggatatagatatggatatatgtaaagggaatgagcataccttttcttgaaatgaaatccatcttgtctttaattttcccttcaagcaattaaaaatggacataaattgttgagaggctttttcatgcaactaatgtttagaaagtgaagacctcaaagaggccaagattggagcaggtaccaatggtttcattacactttcattcaagagaaatgaaaagtgatgatttgtgatctggccagagagagcatgggataaaaggcaagagatatccaaggaaaacgtaggcaatttttgcccaaatggtatttcttctccaactactcctcccaacctgagctccaaatcctgaattagtgcacacaaaatgaagacagctgaaatgatgtatcatttattcaaaccacagaaggacagagatataatcaacctttattggagagaataatattgtgatttttatattatataataccctgggaaactttagtattcttattagcattattacctttgtgataaagcttataaaatactttgttaaattgagaaaagagttcctgaaactaaatccacgtattttctttctccagaccctgtatatcctgaaggagaggcttggcctaaattaggctgaggatttagcattaagtagagagttgagagcaagttccaaacagtggtgaagttgaacaggatgtagtaggaaagatgactagttttcaggattttctctagtgtatgtgtgtatatatatatgaacatatatacacatatgtataaaatactttgtatttaatatatatacatatatacataaatacaaagtatttttacaatgtatataatacatattttacaaagtattttatacaatgtatataatactatatatataatacaaagtattatatacatatatacatatgtgtatatatgaatatattcacataagtatatatgaatatattcatgtatgtgtatatatacatgtatacacatatattaaattttttaaggcattttttcaaatgactgaaatctctaactatcaagttaatttaacatttttatctgaaattgtttaaaattccacttctgctttcttttaaaacatgttttaattgtttgaatgccatggatccttgctgcaaaattttggaaaatgcaaaaaatataaaagtggaatacataggtgatgggttgataggtgcagcaaaccaccatggcacacgtttacctatgtaagaaacctgcacgttctgcacgtgtattccgaaacttaaataaaataaaaataaaataaaagtggaaataagaatttcccatatttctaccacctggaaattatgactattaatattttagtgtattcccttccaatacgttatttatgtatttattgctgttttctcctttgttctttttttaaattgacatataacaattgtacatatttatggggtgcatagtgatgttttgatgtgtataatatgtcttgtgatcagatgagagtaattagcatatccatcatctcaaacatcatttctttgtgttgggaacattcaatatcctccttctcgctatttgaaactataggttattcttaactatagttatcctacagtggtatagaacaagggtccccaaccacccccacccggcccggccacaaaccggtaccggttcatgggctattagaaactgggtcgcacagcaggaggtaagcggcgggcaagtgagcatgactgcctgtgctccacctcctgtcagatcaacggcggcatgagattctcagaggagggcgaaccctattgtgaactgaactgtgcatttgagggatcaaggttgtgcgctgcttatgtgaatctaaagcatcctgtgacccccgtccatggaaaaattgtcttccatgaaaccagtccctggtgccaaaaaggctggggaccactggtatagatcactaacacttagtcctcctacctggctataattttgtgtcctttagcaaatccatccctatcctcttctccttacccttcccagcctctagtatcctccattctgctttcacttctctgaggtcagctttattttagtttccatgtatgtgtgagaacatgtggtgccttctcatattgtttaatgtgcttattataggcatcgagtaatattgatgagaatgagcattcttgttttgctgttttgttttttaatgagacatcctctggttttcaccactaagtcgcatgcctttttagactgagtataaaaacataattttaagctgttcttggtgactcaagataatgattgtaaagacttgcctttggatagacataattatgcagtggcttttggggtctgctggtctatttgtctttaagtcaggcagccttacactgctatgcttttgtagtttttctctttgtctttccccccttggaccatcatctgctgctgaccagaatctgcttgctcttggggggctttctgacactgcttgttttctccagatcccattgctcacttcagccaggtgctttcatttatctttagctgcagccctcaggattggccactgctctagcaggaaaagtatcaaagtccctgataaggcagggacagaaagagggttttattctttcttttctcactgttgagcccatgccaagcagtatccacatactgcctgccccgctttcagtcctcttttttggtccaaatgatgttggatctgtcattcgactctggatgaatgagagctcctgaagggacaaccctttcagtgaaggggtgagggtggggcatgctcagaccacttttattaccttttctggggcagaaattgtaggttaaggtgacatcctctcacagtttctttatgacttcatcaggatacaaagaatacaagcttctccccttctcattttctgtctccctctctcttctatagataagtatagagacagaaaagtagacgtagataaaaacgtggatatcagagagagggagcaatcaagaaaggagataggcagtgtattgtttttagaagagcagagagacctttgggaagccctgttcaagaacaagcagataataaagagttcctttgcttttcttgagaaagaaaaatcgttgcatggaagtatccaatagtctcaggccctctgtagaaaaatttcctaaccatcttctataacacacatatagttcaacaaatggtagccagtattttaatcatcattaatctatctactttgaaataattaaatattaacggttaaaactttaactgtttccctcctttgggagtgaagaaatgcaagtcaatctcatttttagtttaaaatgtgaataagtgaccaccaaattttattgcagatgtgctttaaatatttggcaaattttaatatttttctgctggatctgtaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaggtatctttttttttaatttagtgtactaactaataatgaacagctaagaattgtatatgttgcctaacttacatgaactttccatttacttggtcctttttcataactgtccatcaatatcgtgtccacagtattgtatttctgtattggatggcttaaacaaccatattatatattcatttggcactctgaaagtttggaaccaactgatgtgatatgagccagctaattgttccattaaaccaaataaccaggaacatgatataatttaggtcataagctatgctgggtcgattggaaaaggagcacagatggaacggaatcaggcttcagagcactctcacggctgttcgtccagttgatggtgatcatgggcttgatttaggcaaagttctgtagggtgggactaagaaggataagtgtttgaattcctttagaaatgggactctaaccagtggccttgaccaaggccaacttctcctaaagcaaggatttttctattacaggtggttttgaaatgccactatttgataatctttacctcccatttaactcctattgctttagtctacttgatttgatacattttaaaggtatctctttccttcatcagagacacataattcatgcaggttgggtcctgttttagagaatgtgatcacagactgcctgttttgaagttttaccaaaagttctgatcagatagtttgtatttattgaagattatttgaaggacatccagtcagtccgtccatccccctgcaacccagatccttgcttctcaaagtattacatgctgaccagtgctttggtatcacctggaagttggtgaaaagagcagaatctccagcctccctcctcccatccaagacctactgaatcagaatctgcattttatcaagattcttaggagattcatatgcatattgaagtttgaggaaaaactgctctaggatttatctctggattaagctactatcagaaagctgcacacttatattgttttggccttccacggactagcttttactaattgcagttactattatactttgactttaattgatgtccacctcaagaagcactagtatggagttcattattgtatctgctgtcagcatacgtttgaggatgttgtctatacgtctctcactggctcctaaaactgaagtcctgtgaaagaaatttcttttaaaattaagtgctgagcaaactttactttacatccagagggattaaaaaaaataaacctgtacataaggaaaactatgaaaccattttcttttatcttaatcaccattgaactgtttgcatcccaactaaatgagatgtcatggccaacatatatgcattttatttttccatgtacaattattagaacaacctgatatacagcaagaactcaataaatatattaactattcttcttttcttctccacctcctccttaccatcttaacagatggttgaaagtagctggctgagagcatccccatggccttgagtcctgtgttacagagcattccctgtgggtggggccagactgtgttacctgaaagtaactcaagatgatgaatacaaactgtgctttaggtgggaagccagtccttaactagaggaggaagcaagatcataaccaaacaacaaacaacaatagcaaaaagcaggactgtaaatagcaaggaatatggaggcctggtcagatggagatctgaacattgtatagtagccacgagtccattttttagtgtcagttgaatgacctggaagtgggcctactggatttaagagcagtgaaggggaccacttgccacttcctgtgttgattcctctgaatgggcaggactggtgtttcaccagtttcactggaaagtcacgaagctcctcagaatgtggttatgatggaatggaattcctaagtttgcttacctggtttctgtctctttgaacagaccaggtactagagcttgcatccatggctatgagagcccagtacctcttgcctcacttgtatatgctgatgactaggcagattgagtggcttggctatagtgctggtgcagggagacatgggcatatataaccatgtgtttccctgcttaatccctttagtggcttccgactgctatgaagacaattcctaaaccccttcccatggccctgtgaaccctcaactctcatgctttctctagatcccgggatgcccctagctgtactgaccttttttcaattccttgaagatgccaatcagatcttctagacatttgcctatagcacttactcttcccacaccctcatgatcccttttgttccccgctcctggtggccctggctaattcctactatttatctgggttttagttgagatgttttcttcctctgagtgcccctctcagatatcctggagtagttaggtcctcctgctccatatattcatgagccctgaatttcggtggtggtgccctttgtactttattgcaatgatttgtttcactgtttgccttttgcccttttctgtaagctctggaagcctggaaccatctctgtctttgtttgcctagcacagtgtcaagcataggaagaaactcaataaatatttgttaataagaatcagttcatcaaagagtgaattttaaaaactgcccacatgcttatgttttatgctattgcaattcagtatataatttttttgtattttatgtttttaaggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagataggtaggaaacccagttttcgttttttattttgtaattttaaaatgtgcataacattatttatagttgaatttgaaatattaacaaaagcagatttctgtcatgctgggtagatgctagctcattaaagtcagcctaacaatgaaataaccacttaaatatacatgtgcattgaatttttatgaagtagaaaaagataaaagaataaaagcaagcttgaatgttgactgtgagtgatttaatggtgaattttagattgcaagatggaaaaatattcctagaatcccaaaagaagttaaaattgcaaagaaggaaggtcccttggagatcatttaatttagtctttttttcagatgtggaaattggcacctaacgtacattttcatggccaatatgaataattagtcaatggcagatcccgtcacaattctttccattatatgacactaggcaattactaggtcttttttatcccatgacacccagttaagtatgctgtgcatagaaaacattcaataaatgttgttagaattgacttaaattgcgttctttaatattaagtgctgctgttactttaagtagggctgcctccaggtgaaattatatcaaatcacatcttcagcctccttttgatttattgaacctatcccttttatatgcccagtgccatagcaacataaatttgtcagtgttttctcttctattggtgtttacatattaagcatcgtgtctcatgaagctttactaagatctttactaagttttacttagatccaaaacaaatacaacagaagctggatcatggatacaaagagatttattatattagtattctttgcacttttctaaatgagcgaattatttcatagtgaaactatttatttacagtggtgtgctggagctgacttgcatcagcctgtggtgcttacctggtttctttttttgttttgagacagagtcttgctctgtcgcccaggctggagtgcagtggcgcgatcttggctcactgcaacctccacctctacctcacaagtagctgggactacaggcgcatgccaccacgcctggctaatttttgtgttttttaaatagagacagggtttcaccgtattggccaggctggtcttgaactcctgacctcatgatccgcccacctcagcttcccaaagtgttgggattacaggcgtgagccaccatgcccagccttacctggtttctgtctatgtgcattttgccccgactttgtgatatcacattggtagcttgccattgaccacagtggaagaatttatacaatagatattggcaaacatgaaaaccaggttttttttttttttttctggagagccagttgttaaacatttgccagcacaatactgctcatttggttctcctgactgtaatgggaggaaggcctgagggttttaagtcagggttgaggagttttgaaattagtctcaagaaatctttgggctcactgtagtacttttaatgaatatcaagtaccctaaccttgtttgttcacttcttttatgtgggctactcagactctaaaataaataggcccattccaatcacattggatttttgcttgcgccatcctgtaacgtgtcatcccatactcacaatgctttattggatgaacatttgcagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggcaagtgtcaaataatgtagattattttaggtgaatttatttttattgccttttaatgttattttctgatataaatccaaagtgacgtgatctcatataatctacattagtatgggttgatccgtatgatattgccatttttctaggtcaaaaatggctggatatcaacagtttcatatggttcaatactattgctagtgttatagtctatgcatggaatgtgtgttagattacgaaaatggaatcaatctataattgcctgaaataatagtagagaggatcaaaatagcaaacaggggacacatgtggcttccctcccacagaaatgaaagaattttagaaagcatagcaacactggaaaataagaagggggtggccatcagcagatggaaaattttgagaaaatcctgaaaggtacgtagaacatgttttcagatggacagagaaaaaaatatttgaagacacatcaacctcagagctcagtacttggcgatcttctcttttctatctacatgcattctcttggtgatcttatgtaggtccaaactttaaatgccatctgtatgatgactccagaattatatctctagctcggacttcttgaaactctagattcattacgtacaactgttgatttagcatgtccacttaaatgtctagcaggtgcagattcactatgtttaaaaccaaactcccggccgggcacggctcacgcttgtaatcccagcactttgggaggccgaggcaggcggatcatgaggtcgggagttcaaccatcctggccaacatggtgaaaccccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctaccaaaaaaaacaaaacaaaacaacaaaaacaaaaacaaaaaaccccaaaactcctgatctctaggtgctcagacacaacaacaacaacaacaacaacaacaaacaaaacaaccatccccaaacaacttcgacctatcctttactccgctctttctcttatactcagatccaatctgtcagcaaacactgttggttctactttcaaaatacccccaaaatttgtactttcatcttagcagtgtactgtttccattgttttgatgaaaatatacaaataattaaacctctctttatcactggaattaaatatgtatttatcaacagccagatatgaaactttacataatcccgtttcaatgtataatggtttgggagcactggagaaatgattgttatcaagaaggtatattatagagtaaaactttacaaattaactgtttttcatgccaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatggtgagaaaaaaggctttaaatgcaatttaattagtttaattgttacagacataaataaaacaaagcatgtgttaatgggtagatgaccaactatccaggagttataagctgttctctcttaccatatgattttttttatgtcattataacccagacagaagataaaatagtaatttttttcaattaaaaaaaattcagatccagacctacagaggtaatatgctaaggataataatagatactgtttattgaccacatagtataatatgtgtaaggtgcaggctaaatgttctatgtgctatatcagatggcataactcatgtggttctgcagtaacaaacaatccctaaatcttaattgcttaaagccacaaggtttatctctctgtcatgccacatgtccactgtgggttgactagggtagaagtaggaggccagggctgctttgtatgtctttactctagtactcggcctgacgaggtacctactatctcaatcattgctctttgctgtagcaaaggaaaaagagaacatgaagaattgtgctctgactcttagagtttctttccagaagtgacacaagtcctaagacattggctaaagcaagtttcacgacctaacttcagggggtggtggggtgggggaaaacgtgccatcctatcgtgtaactagaaacaggaaggacctgaaatattctctcacatgtacactgtatcttatagctatgatagccctctgaagtggatattatatagctgacttacctgaggctcagcgagacttaaaaacttcctaggtcacccagccagtaagagaaagaagaagttgttgtctctctaacataaaaatctgactgcttaacctccacacttggtttttctttgacaccgaataaaaggaaataaaaataaaatttctgcaataatttaacaaggtcctatacgaaagaattgtaacaaattcagttaccatgtgattaagggtgagctttgagattcagtgttgtaaagataggaaaccaaaggcatgaataaacgggagtttttatgcttttatgtatcaccagttttaaagcttttatgtgttttccataaagttaaatctcgaagttgcaagataacacaaagcactctgagtttttaaatgtccccatggataaagatgataaattataggaagcaaaatcagaaatgtttctgatacactttattgtaagcaaacatccagtaaagcagttagggggaaataagaataatctgaagtattgattataagtcaggaagtgggatgaagaaatgtactcagtgtaaaactgtggtctagaattttacaaaaagcttaacatgctccctggattaagaataatattggaaatagcaattagatattgcattaagctgtgagtaactgaaacctaaaaaaaattgtagtttaacatgtaaggattctcttaagatccttttatggttctactccatcatgaattccatcttcaaggtcaccttatgaaccaagatgctacagaaagcatctctattgtgttgcagccaattgactgagtcaactctcttcaaaaaaacatcaaggatatttagtacagtgtgcccctttgcatctcgcagtgtagaatataatcacagcagctgcaaggcaggctgggaaatgtagtttttaatctaggtgttgctgtacccagcttgcaggtgggctcctgtggctcaggaaggttaagaggagtattgagaggcagcctcaatttctgtatttccagcccctagcaaggtacctggcctattgacagtgcccagtaaatggtcagggactgaaggtttttaacaaacttgcctaaaataactcattcctgttggccttacttgtctttgaatctccaaccttcctttgagacttgggtctgacctctgttcaacctgttgcttcttaggaggacttcatttcctgtctgtctctacttttgtccatttcagtgtttttcccatcattcccttctttatttcccctcactgccatctttatttctcctcacttccatgggtttttgttagccaaagagctctgtaactgtggctgcaaagaataattgaagagatggaataaaaaaaatgcccaaggaagctcatcagtataaaatccttagtttttttcttctttcaataacatactttagaccataattatcaggtatctattcagttttctcttgtattatttcacgttcttttctatttttaagccagcagacacaattttctattttttaagtcagtagacaattttgccacacaaaattgtgtgtgactttattaatatcatgaaaatggaaatatataaaagggcatataaatattaatatacatggtctaatacatattgttttgagaaaacaagagtattttatgaatctaatattttcaataccatcttaaaatctgaattaggggtttgaaatatatttgtattcagaaatgaaaattgttttagcaattaaaaattaaacatattttaacttttagaaccctggatatgctgggcgccaggaactaccagaaaacctaaaaatccagtttagaactgttgctatgatggttcctgatagacaggtatgcactaggatttaaaagcataatgtgctttatgttctttacttgtttttcactaaagttgaaaaaaactcactatattaattttcagatcattatgagagttaaacttgcaagctgtggttttcttgaaaatgttatcttggctcaaaaattttacgttctttacaaactctgtgaagagcaacttactaaacaggtaactttatagatctgctttcctcctagcaatagtatttggtttttttgctttgtaattttcccttgataaatactcatcagtgagttaaaatctcattgactcttttctaaaatgcttttagaattaattttacctattggttgtgtatttttaagacccttttattttgaaataattgtagattcacaggaagttgcaaaggaatgtacagggaggcatgtacccttcaccctgccttgcctggtggttgacatcttgtaactgtagcgcaataacaaaactggaaatggacactgaagcagtccacagagtttaaggtttcatcagttatacatgcactggtgtgtgtatatgtgtgtgtgtgtgtgtgtgtgtgtgtagttgtatggaatatgtaagatacggctctgttccatcaccacaaggttccctcatgctactttatagccacacccacctctctcccaaatccctaacccattaaccttttctccatgtctagaattttattgcaagaatgttatgtaaacggaatcacatagtatgtaacctcttggttatgcatttaaaaatctattgtttgggccgggtgccgtggctcacgtctgtaatcccagcattctgggaggccgaggcgagtggatcatgaggtcgggagatcgagaccatcctggctaacatggtgaaaccctgtctctactaaaaatacaaaaaaaaaaaaaaattagccaggcgtggtggcacgcgcctataatcccagctactggggaggctgaggcaggagaattgcttgaacccgggaggtggtggttgcagtgagccgaggtcccgccactgcacttcagcctggatgacagagtgagactccatctcaaaaaaaaaaaaaaaaaaaacaaaaaagaaactattgtttgttgctcagactgtatcagactatattattctcaaaagatatttaaggtgtgaatacttacttgatcttgcagcttggattttcccatggaatgatcatatttcagtcaaaggaaaggcaggaagttgagctaataaacctttgtggcttagtcaccccaaaactatcccatataagtatcagaatcgacctatatgcatagagtgagccgtgagtctatgtttagtttttcaattaaaccatctttttgccctcttctcccatctcaggttcattatgactttggattgagaaatattctgtctgtattgaggactcttggatctcaaaaaagagccagaccagaagatagtgaattaagcattgtcatgagaggactaagagatatgaacctttccaaactggtatcttctctgaattctcttcttttccacaattttaatattgtttctttctatttggtggacaagtagaggtaggctgatgttgagctgtgagcacccataattacagggataataagtgtgcaaagctaccactgtgcttccagaagaaagcaaaagaccccatgacctgtgtgaccaacatggactataagtgcctccttttatcagctgtgtgcagtgaaacaggtcatcagtgggcttcagctccaagactcaacctagttgtctaccattattcacaaagtgacacaaattctcagcataagaatctggattcacagggaaccatgagaactttttgctttctctgtatgtgactagcttatctcagatatatctctcccaaaacataaacatcatttctattttccaaaaacacattgaaaatttgctgtggagagcatgctgctttcatgcttgtcatggttacagcctgatttttttttttttctttgaaacagactctcagtcacccaggctggagtgcagtggtgcaatcttggctcactgcaacctcctcattccaggctcaagctatttccctgccccagcctcctgagtagctgggactactggcacacaccaccatgcctggctaatttttgtactgttttgtagagatagggttttgccatgtcacccaggctggtctcaaactcctggactcaagtgatccaccccacctcagcctcccaaagtgctgggattacaggcataagccaccaagcccagcccagcccagccaggttgttttgaatagctgatggacaggttcatgtgacatataaggatttctacatgccacatattgtgcccatgccatgggtgtacaaagttgaagaagaagtggttcaggaagctacattctagttacaaaaactaacatctgtggagttcattagtgttacaaagtcttttcaggtgtatcgtcttatttgagcctcacagcaactctgtggggtctggatggctagcttgtttattgtcacttcacttattggggaatggagactagaggttgcaggattcccccataatcaccatcagctgagaagaggggacaaaaatttataagattttctggtgccaaatccactgctcctgccagtatacctcactgcctgtatgaccaacatggactgtaatggaggcttagactccctaagtcacccaggctggagtgcagtctaagcctcccttagataatggtattttggaaattcctagacaagtactcaagaaagcatcagcaaagccctagagaataaagagaaatcataaggggtcagatgttgggaacagggcaatctatgcattaaagacattgcaagcaaggattggagtcagtgtactcaaacctactgcttataagaaaggctcagaacactgccctgatggacttttgcagccattgttggatgaagtcatgcagggttatggctatttccccaatttaaataaaatatccgttctttaatttcatggggttgggactacaaattatcatttttaaggttaatgcaaatgccactgtgagaagcaaagattcatgtgataaagtaatgaggtcgtactttggagcagtagactggggcaggattgtagaacacattgaatgctaacgaactttgggtacaatatagattcagtggtgattgtattagtctgttctcacactgttaataaagacaatttataaaggaaagaggtttgatgaactcacagttccacatggctggggaggcctcacaatcatgctgggaggtgaatgaggagcaaagtcacgtctttacatggcggcaggcaagagagcatgtgcaagggaactcccgtttacaaaaccatcagatcttgtgagacttattcactatcataagaacagcagggaaagacttgcccccatgatacaattacctctcactgggtccctcccacgacacgtgggagttatgggagctacgattccagatgagatttgggtagggacacagccaaaccatatcagtgatattctggagaaagtactagagaatacaagcctgattaggagagtaataaatggttctctggggatgaagtgataagtactatgcacatcccagctagctgataaatgtttgttgactgaatgagtaaatttattttaaactatgccaccttaggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcaggtaaagacattttaatctattattagtataatgataagtatgtgttaaacattcctgtctgaatagaaaaactcatagttagtcttacttgatgtaaatgttaaatgaaaacatcatatatacatcattgcaaaaagaatacttggaaggatgtggtggtcctaggaagatagtatggatttaccctgcctcacagtaatcaagcagtaatttactgcagtttttacttatacctggtgacaatgttgggcggaaatagtaggttataaaaactctaggggaacggaacaacgcagatgtcttcttgtgccaatctgatagtactggctgcagctgggtgcctcagtggagtgcagagcctgaggaatctgggagtgctattttgctcctgctttgtgtgtggacatgttatatccttcacctacactaaaacctgaatcttttgactgcatatgttggtgtctttctgttcatcacatttcatccttgtgacaaccatctaaccacttgattggattaccagtagaatcaagaacttgtagcagagacacaggattaaatctctatgagcttgatgctttgggaatattttccagagcttttggaaaattaaggagctgaaattgtggacattgttgaaaactgcatttgaaatattaatataacgattcttattttaacttactgttcttgccagattataagatgtgcaagtatctgagatacatccaaatcttacaaagaaatatgtgcatgggggaaaagtctttttcatcattcatgtactggaaaccattttaagagtttaaaaaatttctgggaaaacatgattttatatatgatatgcatacagtatactgagttttaaaattcttgccatctcaatgggtggcgactagaattttgggttctttgttgatgtcaataacattgctcttgaacatgtcaggaacagtgcctctgttgcttttaaactatagtttacaatggtaatacatttctgtccaaaatgttaggagaataactcactctccctctgatcagctgtcagacctttgacttcttaatttttttaatgagaaaactgcagacgggatgttatagcagcggctgtccatgatcctagcatgtctcctcgaatctcttgtaccatttccacgtgcccctgcccagcttctgtgtgttttcgcttctaatagcaaaaggaggcctggagccattttgttggcaggcacaaagagtaggtgctgcacgggagtttatttcccatccacccccaaacaaacgtctctaagagttgatggagtaggaaagtcaagcttgcctggttccaggtggagcaatctttgaggtgtaagttacactccagtctcccgagggatcaggctcaagtctgtcctctacagggctttgtcctcaatcacaccttgcttggcttcttcccattcctgtcctgctttcctcttctcttactggtttctcctgggagcactacctgaataaatcacttgcacaggaatcctcattcatgatgtacttctggggaattagaaggcccctttgaaacggatcttcactgtgatgctctgcgttgctgctttccaccactaaggggcgatatcatcacattggatgccgagaaagtttgcgcatggaacaactgctggttatagaccaacaagccaaaatcacagggaatcatcacgcaagaagcaaaaactagatgctgagttaattatttccaaaatgtaattcaagctccacattgttattactttagcacatatcgttttataacgtggtgctcatttgctatgcacatctagtaaaacaacattttttacaacttaaaaatagtgaactagttacgttaatgaagagcttattaaagcctttaatcttcaagtagctactatgaatgtcagcaagagactcataaattacatattttaatttactggttaattgtgtagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtatacacaaacctcctttgtgatcattttttccctgctagcgtattaacacagtatttttttgatttttccattttaattacttgcaagtgaaaagtgattttctgttttaattattttcaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggtggggcagagagatgggaagaagaaccctcagagtctctccacgtttcactttctcaataaacacagattctgtttctttgttgcaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaagtaagatttttttttgtacatttactacttcgattttgatttttttttcactcagttgcagtttacagccatctgaaatagaaagttcagacagtccataaaaatcatttgatgatgtggctgtaaaagctctgataattttgatttctattaaagatcttcttaatgatcttactgttttctctattattttcacttcccagagggatgttgtcagaggaaggggaatgaactatctttcccattgtcaggtttagtgacctgtcccataaagtgtgtataataatgacagtcaataaaatatagtaattaattaaattttaaaataaataaaaaataacacatacacctacacacacacacacacacacacacacacacacacacacacacccctgcactccagctggggcgacagagtgagaccctgtctcaaaataaataaataagtaaataaaaataaataaagttggtagcttcgtgggaaagaacagaaaggggcctgttgcaatcaagaaaacttgggaggcaattttggctttggaaatttagcatataacaggtaaggaaaatctttaaataaaaattatctgacaagtagttgtagcattgttttttccctttcttccttcctttcctctttctttccctttttcttttcttttctttctttctttctttctttctttctttttctttctttctttctttctttctttctctttctccttccttccttcctccttctctctttctttctttctctttctccttccttccttcctccttctctctttctttctttctctctctctttctttctctctttctttctttctctctcgctctctctttctcccctccctccccttcccttcccttcccttccctccccttccctcccctcccctcccctcccctcccctcccctccccttcccttcccttccctccctctctctctcttcttttcttttcctttcttttctttccttttctttcttttctttcaacaaggtcttgcctgttgcccaggctggagtgtagtggtgcaatcaatcataactcactgcaaccttgaagtcctgggctcgagctgtcctcctgccttagcctttgaagttgttggggctacaggcacacaccaccatgcccagctaatttttagattttttatagagacagggtctctgtatgttgcccaggctggtctaggctcctggactcaagcagtcctcctgcctcagcctcctaaagtgctaggattgcaggcatgagccaccatgcccagccagcattctttatttcctactcggttttccttattagtctttgagttaaaacagaattaatcatagatcttcaagggctctcctaattctgatctataggtgatctctccttacacattctagagcttcaattctcagttaagagagtcagtcatttgtgggtaggttagaaacaatatataaggccgaaatcagtgaattatttagtaattactttaaaatggatcatagaagacaatattttattttgaagtaattttgttttgaaagaccgaggatgtcctactgtacttgtctttctgatgctatagggcattggcacactttttcttaaagggccaggtagtattaataaatattttaggctttgcacaactctctgtctcaaccactcagctttgctgttgtagcacaaaagcagctagagacaatgcataggtgaatgagtgtgactgtgtgtgtgttccagtaaaactttatttaccaaacaggtggccagcctctagggccacagtttgctaagtcctgcaaaattttacaaagaaatagaatctttgatctggaaaatttagataacttaactttagaaccagtagctaccttagctgcttacatcgagtctaggccttttgctttcccagtaggaaattgagactcagagaggtcagtgggatgagctgagggttgaaaccacaggagcagattttcagttcagcatcctttctgctagaccatgctgcctgtctaaaacaggatagcctttcttctacgtgctgttggctgtaggacggtgatcaagcaatagcttgagatatatctatttttcttctctcttccttcctccttttaattttactattatttacaattttttattttcaaaattttaatttaaaaatttattttatttgaaacattttcagtctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtaagcccactgaactataccttaaatgaaatgacttttttcaaatgagaaaatataagctttcataaactcttctatgagagaatattaaaacaattatgaaaacataattgttaataccattttgaaaagagcatgtatttgaaagagagtggaattttgcatatgaattgtgcccgaaactgatattgagactcttgacttctccttttggagtgggctcagtaaaatctggcataaataagttagtaataccttgtacaacatctactttctaatgctggaataggaaaggtagcagcgtggagaacacagattcttcatgatgcaaagcatgctaatacacataacggatcagccccacaattcccctgttgggaatgccagaatgagtagagaatgaacgtagcagattcctcaaggtccagcgctgtcaccttagccccccagccttccatgtatggccgggcccagctcactgctccttaaaagaaatgcctttgaacttggtgctttcatccagagcccaggccctgattcttcaaagttccaaagaggaaaaatatgcttcctaaaaactctaattacctctggttcttcctaaaaactcaaaaacagcaatagtcttttgtttgtttgttttaatgaataaactgaaggacaactggagcaggagagtagacagcaatagccaaattttgaaagcaagaaagcagtaaggtaagcggcagtcgatttagcacactggcagtgggaagagctgagaagtaattgagaagcgcacgtcacaggacattcaaagggctcaggaagtggaaactggggcaaaagttgagctaaaaaccacagggctggttataagtctgtttgagaaaaagacctcctgggccgctttccaaagccctgctgccagacaatcggccttccccacactggcaagactaaagagttactgtttgaatcgtgtaaaatagagggtttcctagacttggggacaccaggcacatttaagagtgggagaatcataccaaaactggggattaagtggaaatttgtgtttgaaagggactgagataaataaattttttcagtgggccatctttaaccagaaaggccaataattgtattacatgtgttagatgctgctaaaggtttgagatggcaaaagggcactctaactcaaaatgcaaactaacaaaggaatctttaaatctagatatgcactcccttagaatccagagccaagctcctccacagcgctgctttctgagcagccggagttctatgatgtttaaaggttcagattgcctccctctgagtgccttgtccttattcagaggccgggccccaagttactcagagagtgaaattcatcagcagcaattttccaaccatggcagagccttggttaggggattgagatggcatctaataaggaagccaataaaataattaccttcctctgtgccatcaaaaatatgtattgccacatttcttaaagagcagtccagtgatgtttgtgacattttcttccaagtagctaggactggttctgtaagtttagacaatgatgttttcttatttttaatggagatgttaacaaaaggttgacaacaatctagactcatattccttcttcaaggtggtcctgaagtggtctgttgactaaaatattgaggggttgcaggcattcagtcttgccatcctaagtaactacttttgacgaaatttatttgcccgagcctttgtggccacgaaatgaactaagatattatgcacttagtggttatttagggccctaacatgtccactcagctgacttctagccagccctttcttaactcattcttcatccatccttttaatttttttatggacattaacatctttggagaagacttcattcatagatttaaaatgaagtaaggagacttatgcttccagcgaagatggagtaatggggactgggtttaacctcttatattaaaaatatagaaaactggacaaaatgtgtaagacggttttttttcagagattggacaataggcactactggactgaaatcaccgagggaagtgaaacaaggtgattgcattagtttattgcatggatgcagtttctagaagcagctcagggaggggaagatcaaatagaattggctgtctcaccaaatgagaaggcagaggttgatttgggagaggccaaggtggctggaatttgcagggcagagcaccagagaggagaaatctgcacaaggaggaagtgtcagagaacaacagaaacagaaagacaaatccacagttatactaaaggtgtcaatattttgaataattgatagaacaaatagacaaaattagtaaatatatggaagactttaacaacactatcaataccctgaattcaaaattatagaatgcttcagcccaaaacagcagaatatacatttttttccagtgcacggaaaacacttaccaagatattctgggtcatataacaattctcgatagggagactttacagcactttatgtctttactagaaaagaagaaaggtctcaaaacaatgatttcaacttcttccttaataagttaggaaaagaaaagcaaattaaacccaaagtaagcagaagaaagaaccatgatcaaagcagaaatcaatgaaacaaaaaatagaacagcaacagaaaaaaatcaatgaaacaaaaagatggatctgaaaagatcaataaaaagaataaatctcttattagagacatcagaacaaaagagaagacatacattaccatagtcaaggatgaaagagagaacatcactacagtcctcacaaacattagaaacatgacgtgagtatattagaaacaactttgcaagaacacatttgacaatgaagatgaaatggacaaatttcttgaaagatataaactaccagccatcatcaagaagaactagatattgcacagcatgctgaatatagttaataactgtgttgtacatttcaaaattgctaagagagtaaatttcaaatattttcaacacaaaaaaatgataagcatttgaggtgatagatatgttaattcgcttgtaataattccacatgatacgttaattcgcttgtaataattccatattgtatccataaaccataacattttgttccccataaatatatacaattgtaaattgtcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaatgtacaataggaagaaacacttcccagcccatttcataaggacagtgttatgctcatgccaaaaccagagaaagacattccaagaaaaaaacaaaaacaaaaaaaactatagaccaatattcctcaggaacattgacgaaaatttcttaataaaattataacaaatccaatagtatacaaaagtccaactgtggcttttattctagaaatggaagatcaacattcaaaaactgatcaatataatctgccatataagactaaaaactaagcaagccataaacagtcatctaaatgaatgaagaaaagcatttggcaaaatttgacactcttttgtgatgaaataggaactttatcatctgacaacatctacaaaatacctacagctaacgttatacggaatggtaaacaactaaatacttccttcccaatatcaagaacacaacaaggacgtctttctcacctctattcaatttcatttctattcaacattgtactagaggttctagccagtgcagtggggggcaaatcaaatgtctatagattagaaaagaacaagtaaaattctctttatttgcagatgacatgaccatctgtggaatcttcaaaaagttattagaactactaaaggattttagcaaggtcacaggacaaaagggccatacatttgataagttatatttctatatgctcacaacaaacagttgaaaattgaattttaagaataccagttaaaatagaacgcaaggctgggtgcaggggctcacaccttcacacctgtaatcccagccctttgggaggccgagtggggcagctcacctgaggtcaggagttcaagaccagcctggccaacatggtgaaaccccgtatctactaaaaaaaaacaaaaaaattagccaggtgttgtggtatatgcccgtaagcacagctactcaggaggctgaggcatgagaatagcttgaatctgggaggcggaggttgcagtgagctgagattgtgccactgcactccggcctgggagacagagtgagactctgtcttaaaaacacacaaacaaaaatagaatccaaaaaaagaatacttaggaataaatttaataaaatacgtgtaagatctgtatactaaaactgtaaaactgcgctgagagaagctatagaaggcccaaataaggggacagatcttatttaaacattatttaaagattattttgctatttgaaatagcaaaatctagccagtgcgatggggggaaaaatctcttttgctgtttaaaagtcactattaagaaaatgaaaaacccagccacagactgtaaagaactatttgaaacatatatatctgataaaaaaaatttatccagaatatgtaaagaactcctataatccaataactatcaataggcaaccaatctaaattttaaaatggggaggaaatttcagttgatactttgctaaataagataagtgaaaggtgaaaaaagcatgtgaaagatatttaacatcattggtcgtcagggaaatgcaaattaaaactccaatggggtctgggtgcagtggctcatgcctgtaatcccaacactttgggaggccaaggcgagtagatcacttgaagtcagcacttcgagaccagcctggccaacatggtgaaaccccgtctctactaaaaatacaaaaatcagctgtgcgtggtggcgggtgcctgtaatcccagctactcaggaggctgaggcaggaaaattgcttgaacccggagatggaggctgcagtgagctgagatcgcaccactacactccagtctgggccacagaggcagaccttgcttcaaaaaaaacaaaaacaaaaccccgcacaatggatatcatcacatagccactggaatgtctacagttaaaaaggttaataatgccaaatattggtgccgtaatagagcacctagagccctcatatgctacagaatggcacagccactttggaaaatagtttggcagtgttttagaagttaaacatactcatttttgcttactttctcaagaaaacatgaaattggggttattactccaatgatgagtatttgttcatcattgtttcaccaatatcaatgtatgctttctttccatgcattctgtgtacacagtaacttttgggtataattctgaatcattgtataatctttttgaagacatttaaaatagaggctaaacgtatcaatgaaagtaattcaatttgaatggcaatgataggaataacgccaatacaagtttgcctagcaacagcaatggtacagtaccacaggttgtaaggaacatccagagatgctaaaatgtaaataaatttttgaaatcaatgttttttttttttttttttgagacggagtttcgctctttgttgcccacgctggagtgcaatggcgcgatcttggctcaccacaacctccgcctcccgggttcaagtgattctcctgcctcagcctcccgagtagctgggattacaggcatgcaccaccaggcctggctaattttgtatttttagtagagacagggtttctccacgttggtcaggctggtcgcgaacttccaacctcagctgatccacccacctcagcctcccaaagtgctgggtttacagacgtcagccactgtgcccggacttgaaatcaatttcttatggcaaatactctatatctagtaaacggttgactctttttttggtcttttccgtcttttcagttgatgtggcttttctgctaggcatccattacattactggttttaccaccggctgattttaattccatttcaggcaaggtttctccagatgggtgagttagcaatttaaaagccaatttacaaaaaataacagatgctggagaggttgtggagaaaaggaaatgcttctacactgctagtgggaatgtaaattagtgcagccattacggaaagcagtttggtgatttctcaaagaacttaaacttagacctaccatctgacccaccaatctcattattgggtattatactcaaaggaacgtatatcattctaccataaagacacatgcatgcatatgttcattgcagcactattcacaatagcaaagacatggaatcaacttacatgcccatcagtgttagactggataaagaaaatttggtacacatataccatggaatactatgcagccataaaaaatatgagattatgtcctttgaagaaacatggatggagctggaagccattatcctaagcagactaactcaggaatagaaaatcaaatactgcgtattttcaattataagtgggagctaaatattgagtacacagggatgcaaagaaaggaacaacagacactggggcctacttgagggttgggggtgggagaagggtgaggatcaaaacactacttattgggtactatgcttatcacctggtgatgaaataatctgtacgacaaacccctgtatatctaacagacctgcacatgtatccctgaacctgaaagtttttttaaaagctgactttataaaaaaaggcaaaacaaattatcaaatgctgtagacataagataagcagatatattaacatgttttaggaaaacattttgaatgtttatacgattctattgattgtttattgcacttaacatttttgtattatgagataactttcacagaatatggttctattaagatgaaattttacttattatataggtgattgggagcactggaataagaaacttcagccttattattatccaactgacagtattccggaatattcatcaattttggttccaaatgttgacaatattagaacaaattttttgatagacaccattgcaaaacaacataaagtaagtttaatagatagttccttaaatgatcacaaaccatccatggccacgggaatatgcacccatattttcttccagcacttttatagtacacattttacatttaaatctgtaatacaactgggacttattttgatggtagatgcaattctaaaaagttattaaaaattagttgtattaatttatagaagactagcccatagaatcataagatatttgaaactaaataagttgtaacacatttcaacactattatcctatgattgcaggctgttttgctcacaggagagcagggaactgcaaaaactgtcatggttaaggcctatttgaaaaaatatgatcctgaagtacagctatccaaaagtctaaacttttcatctgccacagaaccaatgatgtttcaggtgaaatccatcatttgctgtaatattataaacataatacattttaaattagtggttacaataaaatgtgtacgcatataaaatgtgaaaatattatatattcaaaagaaatcatgctgcacttggcattcagctgtttagctttcctaaggctaaggttgaaggcaaatccaaatagcatactttgacctaatattgagactgcagctgaactttggagcatatctactgtaatgtaaatgaaggataaaactccaatgccttatttttaaaaatttaacaacatatattttaataattatatgtatacttattaaatgcgtaagtaaattatattctactctgacaagaatgctcattatttttagaagtatggattaaaatctaatgcataagacaaaacgtttccttctctctagagaacaattgaaagctacgtggataagcgaattggaagcacatatgggccaccaggagggagaaaaatgactgtatttattgatgatattaatatgcctgtgattaatgagtggggagatcaggtatggctgaaatatctcatatagatgatcctgaatttgtatttttatgtatatatattatatatatgtaaatgttaataactttgttaaaaactttatgtttttaagtctactgccaatcctcagtctttttctgacttctctgttatagctgagtttctcctttcttaaatccctatgtgtttttttgtttttgtttttttattaaactttaagttttagggtacatgtgcacaacatgcaggtttgttacatatgtatacatgtgccatgttggtgtgctgcacccattaactcgtcatttaacattttgagacggagtcttgctctctcacccaagctcgagtgcagtggcatgatctcagctcactgcaagctccacctcccgggctcaagcaattctcccttcctcagccacctgagtagctgggataacatgtgcccgccaccacgcctggctaatttttgtatttttagtagagacacggtttcaccatgttggccaggctggtcttgaactcctgacctcagatgatccgcccacctcggcctcccaaagtgctgggattacaggcatgagccatcacacctgtctcctacgtggttttctacagcaaatgcctcctctctctttggctacttgacttcagtgtcctttcttagctcctctcttctgcctttctgcagggttacatccttgctctaacctcttattgtgcataatttctgaggagtacgtgatgttcaaaaaaacaaaaacaaaaaatgaaaaaccaaacaactatttatttatttatttaactgtgccacacaccgtggttctagttgtggtcatctatccacccaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactcatcctgtggcgaaaaaccaaacagttctgtatggcctgcgtctgctccaaggcagatagacctcagcagttcctggaaggagaggagggtgaaggcatgtttagatcaggttcatgcttatcttccataagctgaagcgctcctgaattccgaactcacgtatccaactagggatgtctggttggatcgcaaacttaacacctccaacacctgctcctccaacagtcttctctctctcagcaaatagcacctccacagtcactctgtcagaaaatcaagttggctctatcttcacactgtatctgaaatttgaccactactcatcacctccactgctaccacctggcgccacccaccaccagctctcttcttgatcattacaaatgcctcctcactgcctcctgtctcccttacccttctcagcttgttctcacatcatcaacaaatgaaaacaagagttagatcacgacacactcttctggtcaacatcctccaaagagacttgtagaatataaataccaaaatccttaccatgatccaagactctacacattttgaccgcctctccctcttcccgtgactctttgcttccaccacatttactgatctttgtatacgctggatatggtgttcactcagtacctctgcatttgcagtttcctctgcctagagtgctcttcccctaggtatcgaactggcttactttctcaccttcttcaggtcttggcttatatatcatgtcaggtgaagcctcccctgctctccttgagtcacacccttgagcccctcctatattctacaaaagtcttagagtataccattttatttacatatcaacatgcatctgtacatcttgtctctcaccactagaatgtgtgcttcatgaggacagaaaattttgtctatgctacaagagaggctggcacacagtagtcattcatgaaatgttggttaattgaaagacggttatatttgaggtgcttgtgtgatatgcactaagagatgctcaatagagacttgaatatacaggtgtagagcttagaagagaatttgaagctagagttatagatatgagattctttagaatatagggttgagatagcatttcctggaacaatgagaagaggaaagagcccaggatggaaccctggagaacagttacatgtgagggatgagtggacaatgagtggcttaggaagtgatcccagagccctgagatggacctggaaaaaaaacaagcctctgaaaccaagagaggtaacatttccaaggaggggggttggcagtgttggaggatgcagagaagataagatgagaacataaaaccaacaaccaaaacagttagtaatataatattgaaaactcaggacagaaaccatcctacattctgatctaaaggtttttaagtgttgaatattgagtatgaaagatgtctacagtaaaacttgttgtaacttggagtattaatgtaatttaaccaaatatcttataactcacatatctaaatttatttggaaattagtttgatcaatgtggtgaaaggcaccttggacttggaccatgcatgtgttatgatctagagttcatgggtgacatcatttaagtcaaattaccttgaaggtgatcatcgacattcacaaacacttcattgataagagtttaatgttttcttctaatctcatttgtactattttattgaagttatggaggaatatgatagtgatatgttacaaaaatattgctgtgtgaaatttcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggtatgaatattcttagcgtttattttattgcattacataatggacataaaccacacaaaatttcatttaagagacaaaaaggctctgtctaaagtggggttaggtatgtgaaatggagagctaaacactaggaaagagggactaaatactaaggtgacctatgcttatagcctattctcagactcagagatatttaaaaataggcttgttgaaagttaacattagacgtaaaggaaccttggtgttttggttttcaggacatggttaatcagagaaatttgggccaataaatgatagcacaaagatcacagattaacgatatattatacaaagtcaaatgtagcacttcaatatgttaatgaaaatgagattcttgacatcaaatgtaacatcgaatcacataaattatgccatcaaaacttatgtgtaggtcagcccatgcctataatcttagcactttggaagaccaaggtgagagaattgctggaggccaggagatcaagagcagcctgggctcatagagagaccccatttctacaaaaaatttaaaacattagctgggcatggtggcacacgtctgtagtcctagctgcgtggaaggctgaggccagaggattgcttgagcctaggaggtcaaggctgcagtgagctatgatcacattgctgcattcgagcctgggtaacagagtaagaacctgtctaaaaaaccaaaaaacaaacccccaatccaccccaaaacctcttacatacacgagaaacagacccttgcatataagaacattaattatttgatatagcaagtactgtagtcagaagggaaagggcagacttttttttttttttttttttgagatggagtgtcactcttgtcacccaggctggagtgcagtggcgcgatctcagctcactgcaaccgctgactcctgggttcaagcgattctcctgcctcagcctcccaattagctgggattacaggcgcctgccaccacacccggctaatttttttgtatttttagtagagacggggtttcaccacattgacagggttggtctcgaactcctgacctcaggtgatctgcctgcctcgggctcccaaagtgctgggattacaggcatgagccaccgtgcccatccgggaaagggcagacttttaataagtagttctgggatacttagtaattcttataggaaaataattaaatttggacagctacctcatgccaatgacatgatcaactacagatgagataaggacctaaatatggaaggcaaggctgtaaaacatttggaagaaaatgtagagaaatagttgagtgacctctgagtaggaaaggatttcataaatgagactcagaaagcacaaaaataaagaaaaaaaataccaatttgactagattgaaatgtaaaatttctcttcattaaaaaataacattaagagagtgaaaagcctcaaagtggaagaaaaaattttaacacatataataacaacaaaaatgtcatattctgaatatttagagaaatcctataaatcagtcagtcaagaaaaggaaacaacctgatataaaaatgggcaaacaactaaggcactttaaaaagaggaagctaaatagccaataaacaaagtaaagatggtaaacatcatcagtattctggaaaatacaaatgagaaacaccaagcgataccatttcatacccactagatttgcaaaaataaaaaattctgacaaaaatcaagcattagtgagaatgtgaagcaactgagactctcattgcctgctggccgtagtgtcagttgctacaaaccctttggataacaattttgcatccctgctggtaaagtagggcgtgtgcccatccctagcagtaccacttctaggtttatgccaaattgtcatttttttcctttatggtttgggttttctgagtctcaagaagtccttttctatccggacatcatacaagtattcttttatgttttcttccagacattgtatagttttgccttccatatctggggcctcaatccatctgtagttgattttgcacatgcatgccagcagacttatacaaaaatgctcatagtgcagcgtacacaatggcaaaaacgtgaaataatccagatatttatcactagtaaaactggataaatacatcctgtcacaggcacacagtggcctgctgtgcagcagtgaaaatgaatgaatatagctacatgctttcaccatggatgaagcccagaaatacaatgctgaattgaaagaagcaaatcacaggaaaaatataattccattaaactgaatttcaaaaattttttttttttaccagttcagaagttcaaaaacctaagtggtgaagctataaagaaaagcaagttactgattatattaaagagaggtggcgacctctggagaagggaggaattgtgaacaaggatgaacgtacaagggcttctaatgtgctgggcaaggttgtagttttcaatctggtggtctgtacatgagcgtttgttatttgttaagctatttgacatactcttcagtatgactgacacatttaaacaaatacggaaaacaaaccaaccagaaactgagcctcagagaagtgagataactgcccaatcaaggccttttagctagtgcttggcagatgggtgttgctaatccctatctcatgcttcttataacatggttgtcccacaggaaggtggaaatctagaatataggatttcaggaagcaaacggactttacaggcacttagcacaaccaaccatgatttggaggaaaatttcatgtttccccagggcaattcttcaattagtgtgaacaaactccagtttctttagtctccactcttcatcaacctgttctgcatctctgagcagatattcatattcctctgagaataccatgctcagaactgaacacactctgcagtgtgtagtctcactggagtgaagcagagtaaatctttcttcggtctaaatcaaagacattctgagactttgagaacagtctctaaacctacaccccagtctttctgagagtcataatgatggtcagaccatcactttgctgggtgttccctaggaatgttgcatgtctagcccaggccagagtggtgactgactgtaggctggaaaaagtggtcctgattccagttctgccaataccagtccatgtgaccttgaacaatcggcttcacctgtctgggcctggtctccttctctgtaagatgagggagtactctctaagctcacatatgcttcagggtgaatgctgatgtacagactctagggccaggttgcttgggttcacatctcagatttgtctgcatgcaagctgtgtaactttgagcaagttactaagctcatgttaaaatgggactagtaataataatacctaccttgtatttttttcttgtagggtgctgggtgggggattaaatgagtcaatacatataaaacacttatcactgcgtactaagcttggctggatccactactgactcccagtcttagctgatcccttgagagaaattctgaacaacacccagcttagtcagccttgtaatgatttgtttactgggataaacatatacttggaaatcttttggtaagcttataccttcaatcttgcttatctttcaggaattattggatgtggatactttgatccttgtagaagtttcaagcctcaaatatgtgagatgattgtgaatttagtctcagtgggtagagtgctgtggcaatggactaaggtacagaatggtttgtcaataatttttaaaaaggcaactattattcagccctagatcacacctcgtggctcattaagttatcataatatcatatatagtggtgttttttggaaaagacaaattacgtgctcaaatagatttacaacaccttttccttccagggagcaaatgatctgactaaatgatgctttccgtatgtatgagatgttactgtaaaccagacatgacatccaagacaaagtagaattttgctgaaatgagaacactgcatttccacttgttactctgatttgtaaatctttatttgtattatctgtctccttctaccaaactatgtcagacactcagatgcttattgactgacttaatacatggatttccagatattctcagccaactaggacttgaagtctaacttgtgtatttctctgagcaggagcgtgagttagtaaatggatggaaatgttcttaacaaaaattggctagatttgcatacacaagtcagtgtcctaagtaaagctcagcaaacctgcagctgtccccagatgacttagggcagtactcatgaaaaggcaattaagtgtaggtatgagataaaaatgaggttgatatatttgacaaaaagccatgaaggagataaggattagttgtcgtaattcactacacatccattaggccaattatacacatgtgggcacgcacttgtctcctgggaaacctgagtgtgccagcctttcagattcctgggtagactgggggatttctagatacacaattattggaagaggaatttgggggtttcttatgagatgctcttccatgtggccaccttcagtgatgagtgtggggccctgttccttgccaacacagggcctttgcacatgccattgcacctcttttaaagaaactcagaaatgagttgcaaggactgagcgtctgagatagttttccgtggtaagatacatgtggtttccaataggattattgctcaatttactgtgcttatatacatagttctctgaaaagctttgcccttgcagctgtcttccatcagtttcttttggtatttggatgtttcctggctccatttcctcagtgtcttttctttacctctttaatccattctgcacaagctttcattcccactgttcatgtcaaggccaccaaagaccttgatcttgccacatctcaaggttaattttcctctccctcttacttgactttttagcagcatttgacctaaatgatcctttagcagcatttgacctaaatgatccctctaaatattttcttcacttggcttcagagggtccccatagtcttgattttcttcctagtgcactggctacctcattaaagtcccccttcttctttccctcctctaaacactgaaatgcacctggtctcgatgccaggccctcttctctatctacattctttccctaggtggcctcatcaagcttcaaggctctaaacatcatccctgtgctgatgacttcaaaatggatatctccatcccaggcctctctacctggctccaggccgattgctaactacttaatagacatcagtgtttgatgtctgatactcatctcaaagttaccatgtccaaacagaactcctaaatgtctttaaatacaatcctctctcagacttctgcatcttagtagcagcaccagttatcctgcttcttaggttaaaattactgggcaccatccttgatttatgtcttcctcatggcctacatcgagtccatcagtgaatctcagtgacctccccttcaaaatctaccccaaagctgaaccttcctcaccatccccccgtgaccaccctgataagtggtccgatcacctgtcccctggaccatgcagtaacttcctaaccaatctccttgctttcttcttgctctcttggagtctgttcttttcacagtcctagatgatattttttaaaaagtaaagcagaaatctttactccttcttaaaaccaccagtagactcccagttccacttacaatgtcagcagactccgcttacttcccttgcctgccaccaacctgctccagccgatggccctgctcaccattccttgagtaccccaggtttattgcgttgctgggccaccatacgttggctcattctcatcactcttaccttcagagcgactgttccaatcatcctctaaagtgactgcacttgtccctatcctagtcattatctgtctcctggccctggttttttttaaaccatggcttctatcattatttgcatatttacatatatatttgttccctgttcattctcaggctctccccactggaataaaagcccgcttgatggcagcagagttagctgtcctctgtttaccactgtgtcttcttaagaaccaaggaggtgctcagtcattgaaaaatgaatgaatcttcctcctctgcccacctctacataagcagccttctttgtatcttttcttcaaatctcccatcttcacaaagcactcttttgatccattcatgccttgtctatcagcccacctttgtattactttatatagctttaaggcagaagcagttcagaaaagaaagaaggtgatgaaaagtagagggaaatattagaagagaaggaaagaagcaggttaacaaataatgagaagaagaaggaaagaaaggaatttttttttacagaattctctttaatgactgcctcagttaccaatggctgccgtcatggctggagtgttatactataaaaaaagcaatattcacataaccttaccgctttgagtatttttacatacttgtaatataactatatgttttacattttagtgggtaggatgaacattttagtttgcaatggaactgagcaaagagggaagttgataggtgattgataaaatacacttcttttattttcatctccccatgctacttgctgttttaaatagcactgtgaattagcctgtaaaaattacaaactcaatagggtaatttttcagtatagaaagggcttaatttatgaacagatgctaaagaaagcatctgctttgctgaaataggcgtatggggtgtttgtatcaccagaattatcattattttcactttcaaaaatgatgctaatgatatcaattatgatctttatacatgaccatcaatgctttccatatctagagtacctcgaggttatctcttaacgggtatctctctgggtaagaatgtggtattgttacagctttgcctttttatatcctagaagttggtagaaatagtaaattagcatataatacagtctttgtgctcaaacagaaaaaacatctattactatacgtatagctgcatgtcagacttgcctgtccacttattatggatatacagatacatgaaagactgttgactgagtttggatccacacagtaaaatccaggttatgatatgcagatatatttatggaaatcctaacacattaaggaccctaatcaaagcaatttatagaagatagccattattaactttaaaggtgaacattcgttgttcttacctgcatgacaaccaactcacgttcagtttttgttatgacatatttccacatatactaccaataattagggatgattattcccacagttcatatagtccttaagaattcaggggaggtgacttgttcaaagccaactgatggtagtagaacaaggtgttggaatctgcatccagtgccttggtcttgaatccatcctatccaagagattatggtcttttaaatcctaagttggtttatttatgatttttttctgtccgtgttgtcacaaaatgtgaacttaatcttgatttatttactcagcagattttatctaaaataggatttgtgagacagttgtaaaagtaattctacttttagttgtatctgaaaactaactgagagtattacattttttcatctctaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacaggtgcgtgttgcggcactagagtttaaatgtatgacctgagaagtttatactacttggttaattttttttatttttatttttgagatggagttttgctcttgttgcccaggctggagtgcaatggtgcgatctcagctgaccacaacctctgcctcccgggttcaagtgattctccaacttcagcctcccccgtagctgggatcacaggcatgcaccaccatggccggctattttgttgttgttgttgtatttttagtagagatggggtttctccatgttgatcaggctggtcttgaactcctgacctcaggagatcctcctgtctcagtctcccaaagtgctgggattacaggcatgagccaccctgcccagccggttacttcttgcattacctactaggataagtagagtaaggagcattgtcatcatttgctgtggggcttgtgaagcattgatggcatctctcacctgcccactgtcttaaaaaaatgctctgccgatttattccagtatgacttcaacaatacatctttataaatcaccagatcatcagaggtgataacattcggaggcacattttcattgtatatattttctacaaattttgtgagctctttgtaggttttctgtggggaaatctggtttcatccctttaaagttaaacaatcccattaaagttaaattcagtcatcttttggagcctccattccctcatctataaatcatagatgataatgccagtttcacaaagttgtaaagtgtctaccatgtctcacacaagggtgatacttgtcaaatgttactcccctttgtcctctcttccctctgttatattgtcaatctgaaaaggtcctttgtgtactgaatccaccaacccagaaagaggacgctcgtccactaccgaccatcacttctgctctcctatcgcaagttttagggacctttgatctcacctaagtgattcatctgtgttttctataagtagtgctgttaatgttataactttcttggatggggttatgcccttcttatcaaaaggcagaacatattgtttccctgtcctgaattgagaaggtccagggtggggctgagaagaggcgaagggacatgttcagttagaaaagatgctttcatatttaacattcttactactacattttcctttcagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattggtatttattttcatctcttaaaagaggttttcagattgctcacctgactagatctttctctctgcaccagagtcctaccatggagttgctataattccagcactttgggaggctgaggtgggaggattgcttgagcctgggagtttgagaccagcctgagcaacataatgagaccctgtctctataaaaaataagaaaaattagtcgggtgtggtggcatgctgctgtactcccaattactcagcaggtggaggtgggaggattacttgagcccaggagtttgagactgcagtgagctgtgattgtgtcactgcactctagcctgggtgacagaatgagaccctgtctcaaaaaaacaaacaaacaaacaaacaaacaaacaaaaaaacaaaaaagagagagagagagttcagtaagatgaccaagcattatataaatgtgaaataactatcctctatacctataccaagggttggcaaattatagtttctgggccagatccagccagcccactgcctgtttttattagacttactagctaagaaggatatttatttgtttatttatttatttattttgagatggagtctctctctgtcaccccaggctggagcacagtggcacgatctcggctcactgcaacctccgcctcccagttcaagcaattctcctgcctcagcctcccgagtagctgggattacaggtgccccccaccatgcctggctaattttttgtatttttagtagagacgaggtttcaccgtgttggtcctgtgattacaggtgctcgctaccatgcctggctaattttttgtatttttagtagagatgaggttttatcatgttggtcaggctggttttgaacttctgacctcaagtgatccacccatctcggcctcccaaattctggagtgacaggcgtgagccaccatgcccggctgatttttcatttttaaatagttaccaaaaaataaaaataagcaaaagaataatattgtgtgacatgtaaaaataatatagaattcaaatttcattgttcataaataaggttttattgaaacacccattggtttaaatattggccatagctgcttttgcactacaatggcaggggtgagtagagactgaatgggccttaaagcctgaaatatttactatcttgccctttacagaaaaaatttaccaacacttgccaacaatcacaagacagaaaatataacataaaagtatttcatttaacagcaacaacaatattaacatgtaggaattaacatgataaaactttacttaaacagcaacatgtcattctttctaaattaatatataggtttaatgaaatttgaaacaagatttcaaagggacttttaaaaacagggttatataacaaagtaattctaaagttatatagagccgggcgaggtggtttatgcctgtaatacccgcgacttgggggagttgaggtaggaggagccatagagccaaggaagtcgaggctgcagtgagctatgattggaccactgcactccagtccgggtgacagagtaccttgactctaaaaaataaaaataaaaataaagtgtatgcagatcaaagaattagatggggaggaacaatttgcaaaacaaagaaagtgggtgtggatttatttcagaacaacaaagacttgtggatttaactccataaataatgtaaaacctttttatatttttgaaagctgcaaacaatattaaaaagtaagtaaaaaccaagaaaaatatttcctatattaatgtgttaattactatggataggagttggtagggaaaggtcagaaatgattttgcactagaaaccaactaatacagttaagtttcaggccttagaaaatggaaataactaaaagtagactaatacgtgagaaacctctggaaatccataacgtttaaaaaaagatatgtatattttaaaattacttttgagtgtctttacaattgctactttaatacatacttggatcttaaatattatttttttatctttctctccacccatagatgccatcctttgactttctggctgaaaaactccagttttaccagagacagttcaatgaaatcattagaggaacatctcttgatctggtgttttttaaagatgcaatgactcatcttattaaggtcctaactattgcctatttactgatataaatagatgatttaaaagcttcgtatatttcatagataaattttttgagagaataactatatactatcaggtaccgtatagaagactgtacataggttgggtcaattcactgtcccagaaaataaaggcttaataggaaaccctttatttgaatccatctacatggcagcaaatgtctttcaagggcaaatagatggttttctgttcagagcttttggcacactgagtcaacaagaaagtatggagaacctttagaaagtatggagaaccctgtgaaaaaatatacttccctcaaattatattttgatattatgggaattctgttgcccatggaggaaaagatgttgcttttaaaagtgtcaatgttatgattgacttacaggtgatgggacaggggtaaggttgatatataggactggtgagagaatagaagccagttagaggtaacacgaaaaaggggtgttttcacactaatctattcaacaagtaattattgaccattcaccgtggctagatcttgaggttctgagatcctattctgagtgcaaagccataagtgattaatatattttaaaatatactgatagaatttacacataccagggtgtcattattgatccaccatctgcaaaacttgtatttttttaaaaattatttttagtggtgatagtgaatttactgatccatctagactttctccctaattggtgacaataatataaaagacagctttttagcaatgtcttcaattggcctgcatgagatttgacccacaatttgagtcttatcttcactgaggaaatcaaccatagaaaagcaacacaacatgaaaggctgtctctccaagttggcttctagaaacatcctcctaccccactgtaaatagaattatggtacttaaaaaaatttgttggcagagatatgatagagttagtgttcattgttgagttaggtgtctacatgattcagtgtgtcaggctgatgaataataaaaaaacaattgtaaacatttcttatatcttctgcagattgggaagagcagctccactatccattgggtctaaaaataataaaattctacatgcgtgcacacgcatgaacacacacacagaatagttttaaaatagaagggagtaaatccagtttgttctgttcttcatgatgtaaacatagatggtcaaggaaagattcgagctgaacaaatcagtattaaactttaattttaaaaattctgtcatagaccattaacgaggaaaaagtctaatatcatctagaaacatatgatcaaaacttgggctcatttagtgcaagaaaatgtaaacattgcattcttttttcaaataagcacgttttaaatctcaaaacagatttcacgaataattcgaacgtcgtgtggaaatgcattgctggtgggtgttggtggttccggaaaacaaagtctttcaagattggcctcttttattgctggctatcaaatattccagataacattaaccaggtaggatgaaataaaacacaatatgtttttctatagttaatttctctatagttaaatgtttagaaaaaaaggaagcacaacagtttcctgtatttctttttaaggtaaactttaagtattatatatataaggatatttacgcaagtgtcacaaagtaaatacatctatgtagccagtctacagatgaagaaataaaacacttcttgtatcccagaagtgcctccatgttacgttgcagtcattaccctcccaagggtaaccatattcaaagggtaagcccattgattagttttgcccagttttgaattttgtatcaattgaactatacaggatttgctctttgcatcctatttctattactgcattgtttgtgagattcatccatgatgctacatgtagcaagaattgttcattctttttgctgcatgatcttcaacttaatcagatactaccacagtctatttatccattgtactcttgataaacatttggtttggggcaaatagagctactgtaaatattcttgtacatgtctgagtacacatctagagttaaaattgctggatgtaggttatctgtatatttagctttagttgatctgcttagtagttttccatgtggttgtaccaatttacacttccaccaacatgtcatgagagttgctccgcatccttgctcccacttggcattgtgtgtctttttcattttagcaaatctttttttttttttgaaatgtagtcttgctctgtcgcccaggctggagtgcaatggcatgatctctgctcactgcaaactccacctcccaggttcaagcgattctcttgcctcagctcacgagtagctgggatcacaggagtgtgccaccatgcccagccaatttttgtatttttagtagagacggggtttcaccatgttggccaggcttctcttgaactcctgacctcaagtgatcaacccgcgtcggcctcccaaaattataggcgtgagccaccgcgcctggccgattttagcaattctgtgtgtggagtggtagctcactgtgtttcagtttgcgtttcccagatggctaatgatgttgagcacctttttatctctcattggccatttggataggctcttttgtgaattataaaagccctttctccatttttttttcaatttgtttgcgattctttcttattgattgttaggaattctatatgtgttttggatataaagggtgtatattgcaaatacctttgctcagttattgatttgccttttcattctcttagcggatcttaattttaatgaaacattcatttttttctatttagtccttttttgtattatattttaaaatctttgtttaccctaagggcacatagatattttcctatgattttcttcacatttacacataaaatttactactttctcatttagtactataactgacctagaattcattttcttataatgtctgacataggagttgtgattattattttcaatattgatatccagttgatccagctccatttattaaaaaagtcatcttttccctgccacatcacagtgccattttttgtcttaagtcatctgatcatatatgtgactatatagtctcctccactggtttccttatctatctttgtatcattacctactatattaattgctgtagcttctttagtatatatatttaaatttaacatatgtatatttggtagtgtcagatctctaactttgttgttcttcaaaacgtcttgtccatttggccttttatttccgtataaaatttagatcactttgccaatttataaacaaacacacaaatcattctgctgccaaacaaaagaaaaataaaaattgaacaaaatacaatttatagaagtattttaaaaacataaaatatcaaataagtaggtattaatttaattttacttcaaaaaattaaattagttgtcagcatttaaaaatcgggaggtttcatgttttagaaaagcgtatttctgactttttgaaataattggaagatctggcaacctagggcctacactcccaggtggcagagctcagtagcagctgcctccttggatgggacatgcaatcctccaatccacaggccccaacagcactgcttcactcactggcattatctgtctgattcctgtaggcatctaaatttgggatcctgagataggtggtgttgcactgattgtagttaggaatgacggaggcttaaattaaggcaaatttattcactatattttcttaatttctgtattcttgataccctggcatctgagactctgctgactggggagagactgacccttctaggttagccaattcttagagattcaaacagctcctccaggagagtacctttcatatgcaaaccaaccaatccagagtccttactcccaaccaccacctctatctggtgggtgtgtggtggcatctcatggtggattagaatattcctctgccctaatcaccccagggccacataccagtcaacaagggaccactcctatgccccagaggctgctgaaattattcaaactagcaaatcctaattctgcttacctgccttgcctttctcatggaaaccacaataaagactcttgcccgtgttttcccatcactccttttgcctcctgattgactctggtgtttccccatgtcaccctacctagcatgtcaagcccccttctgtttctggggatccttgagtataaacatcttgcttcatgacagtcgttcctgtgtcattgtgtcttaccacacttgattacaacaaattctggatacattttataacagcagatgaagtgggaatagagaggaagactcagcagggacagtttaaagtatgcaggattgataggacttagtaactgacccaatattcaggaagaggaggaaagaacaggaaggctaggatgacactctaatttctctagtggtacagttgtgtgccccataaggacattttggtcaacaacagacaacatatatgatggtggtcacatgagattataatggagctgccctatacacgagtagcattttaaaaatcttttatactgtatttttactgtaccttttctatggttaggtagatacacaaatatggaccattgcattagaattgcctatggtattcattcagtgcagtaacatgttgttcaggtttgtagcttaggagcaataggccattccatatagcctaggtatgtgtaggcatactctacgctgttctgtattagtcagtttttgcattgctatgaatacctgaggctgtgtaatttatttaaaaacaggtttgttttggctcaaggttctgcaggctgtacaggaagtgtgatgctggcacctgcttctggtgagggtctcaggaagctttcaatcatggcaggaggcaaaggggcagcaggtggtcatattgtgagagctggagtgagagagtgagggtgcaggtcccagactcctttaaacaaccagatcttatatgaactcagagttagaactcactcattaccaaggggatagtgctaagccattcatgagggatctgcctccatgacccagacacctcccaccaagccccgcctccaacattggtggttacatttcaacacgagatttggaggggacaaacatccaaactatattatgctcccacagttacaatgttttctttttctttctttcttccttttttttttttttttttgagaaggagtctcactctgtcacacaggctggagtgcagtggtgcaatctctgctcactgcaacctccacctcccgggttcaagcagttatctgcctcagcctcccgagtagctgggattacaggcgagcaccaccacgcctggctcatttttgtatttttagtagaggcagggtttcaccatgctggccaggctggtcttgaactcctgaccttgtgatccacctgcctcagcctcccaaagtgctgggattacaagcatgagccaccgcgcccagccacagtgacaatattttctaaggatgcatttatcaaaatgtaaccccattgttaagcaatgcatgactgtacttaccacactgcattaaaaaaaagtgcttgttcacatacatttctatctccttcactaagctgtaagctccctgagaatgggccactgtaatctttgtcttttttacttttattattaaatgcttacttttaaccaattctgtaaaaggatgtgttgaataaataaaaaaatgaccagctttgaagggtaaagtgagaatttagttcagtacatttgagtctgaggtgtctgcagaacacagtgtccatagataataagactcatggatgtggagttcaggagaggggttctggttctggagatagcaatatagaagtctcagtagagaggaaccttttgtggtcatggggagtacgaatagggtgcgtcatggaaagaaaagatggctgtggaaagaattctggggtctcccaacatagagaaagggggcttgcgatggagagtgagaagaagaggcaagacagagaggaggaaatccagagtggtttccagaaactaagcaggtagataattaatctgaaaatgctggccgggcgccctggctcacgcctgtaatcccagcactttgggaggccgaggtgggcggatcacctgaggtgaggagttcgagactggctggccaacatggtgaaaccccatctgtactaaaaatacaaaaaaattagctgggcatagtgacaggcgcctgtaatcccagctactcaagaggctgaggcaggagaatcgcttgtaccctgatggtggaggttgcagtgagccgagatcatgccattgcactccagcctgggcaagaagagtgaaactccgtctcaaaaaaaaaaaaaaaaaaaagaaagaatctgaaaatgttaagacatgaaaagtggcaactgatatgcatgacgacactttcagtgaagtggatgggtgcacaagccacattgcattaggaagagaagaagcacagagaatacttttggaaaacttgaaagaaagaaacaagagaggtcaggatctggacaaggggtgtgttgtgactgtctctatgtattgcaaaagcaatacatcacagtcagtctaattctttaaaaaatcagccaaattgacctctttggctgattagttcagagactggccagtcagtgagaggattactctgacagcatcaggccactagatctttctggttccagggctcatagtctttctgtgagaccccatggcctactgcccattacttgcattgtaacacctccttccagtgaggattaccttttagtccttgtcattagcttacccatgaggatttacatacaacatttcagataatgtctgctttatttttacacatctcatcacctctggtagcacatacatttaaccggaaacagagtgaaccaaaaaacaaagaccaagatcttttcattccataatttgtagccatctaacatttctattatttataccttattgcacaatgcatctttttctgtgggttttctttgtatctagccacttaatgagctgtgcaaattgccactatatacaatttatgactaattttattcataacgtattttgaatttttcaccaaatcaaactcatccaaatttcagatgagttttagatattatatatatatttactcggacaaaatctgttgctgaggactgtcagattgcagggactaaaagttcatttctctattcccacttatgctttgtggatcacttttggtaagttccctgtttctcagttctcagcttaaacgaaatatttgttttgaatggtaacatatcactctttagctctaatctctgtgttttctagcaggcaccattacttagtatctattggagcaggtacagattatgctctaataatcacaggctattattatgttttgggataaattatgactatggttttttttgttgttgttgtttgtttgtttatttgttttaagaaggagtctcactctgtcgcccaggctggagtgcagtggcatgatctcggctcactgcaacctctgcctcccgggttcaagcgattctcctgcctcagcctcccaagtagctgggattataggcacacaccacacacttggcttttttttttgtatttttttagtagagatggggtttcaccatgttggtcaggatggtctcgatctcctgacctcgtgatccacccgccttggcctcccaaagtgctgggattacaggtgtgagccaccgcgcccagccgactatatattttttaatctaaaactttctatcatttttcttcttaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggaggtaagtctcaaaagtagagaaaaagcccatattgtaaaaatataaattatattggaatagaaaaagcagcaacctttcaaaaatgaggctatttagtacattttttattttagacatggttaatgtacgagatttagcagattttctgaagttcctgtgaaatgaatgctgcccatctccagatgctttgtttaattttgaacatggttccttacttgtctcttcagtcttcactttggtcttataatttattttaggagaagcaaagtatctgtccatctatctgcatactagtgaggagtatagaatggttgaaagagttctgttagttgtaaatggatgtctgtactgccacttctgaaaccgcttgtatcagcacttccgtgagcactcacatctttagtacttcatcagaaagactcaccagactcagcatatacaggtcgagcttctcaaatccaaaactctggaatccaaaatgctccaaaatctgaaactttttgagcacggacatgatgctcaaaggacatgctcattattggagcattttagatttcagattttttgatttgggggtgctcaaccagtaagtgaaatgcaaacattccaaaatctgaaaaaaatctgaaatctgaaacattgtggtcccaagcattttgaataagggatgttcaacttatagttatactcatggctgagatttattgtggcaacacagtaaggatacagagccagatcagtagagaaaaagactcatcttgtggagtcatcgatgttccaggaacatggaattgatgttccagcttcctatgcttttgccaaggggccatgcagaacgtcctctccatccagtatgaagggcagtaacatatgcactgtttccattcagggaagcccacttgagattcagagtccagtggtttttttttaggtttggtcacttcctgcctagctacaactaccaaagttccagattcctagaaggaaagcagatagatgtttgccatgtatcacaaggtttgtgtaaacagtctagttggcactgcaaaacaaccttatcaattactaatggaggagacattccaaaagccaagttccctgataacagacaagggtcagctctgcaagcatacccttttcaagattaggcctgctgtgttaactcttccctacaccatggtatacagatgcttaatggtgcaaaaattagttaagtattttggagccagagttgattagactgactctgagtcaaagtacagagggcacccctggacattttaaagagatgattgagtggtggtggagatagctttttggtgatagctattggagcacaggagaacacaattagttcttgattgagctgctcaataaaaagttgcagtcttgatcatctctggcaaatcagggatttgactgtggagatgctgaaagaaaatatgaaacaagatgacatgcaaattaaaaaagggactggactttggcagtgaattgactgtggagaactcttaaaacacagaacacttccttgtccattccttaaagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagtaagtttttatttttatttatatctacgtagaaagagttccttatttaaaggtgcttagtttgccttctctgattagaaaatgatcttagaaattaatatttttacattgaattaaaattaacacttttgtaccacacaatctccattgaccaaattctcatttccagtgtaatttaaaatattcatattattaaaaaatactgcataacctgcaattttcattaattacctagagacatgggttgtttgaattgtaagggacttggtgatgtaacctcgtccagctccacctcccatgtagacatattagctttactataatgtctctgatgtaggtttgaaaatctctatctcattgtgcttcccaatatagtagccattaggcatatatggctacttaagttttgattaattagcctcatttctacttactatttggtttatttttggtacagggtcttgctctgttgcctaggctgaagtgcagtggcatgatcatggctcactgcagcatcaacctcccaggctcaagccatcctctcaccttagactcccaagtagctgagactacaagcatgtgccaccatgcccagttaatttttgtattttttgtagagacaaggttttgccatgttgtccaggctggtctggaactcctgaactcaagcgattcacctgcctgggcctcgcaaagtgctgggattacaggcatgagctaccgtgcctggcttagctccattcctggtgcttagtagtcatgtgtggctaatagctaccacactggaaagcatatatataaagcatttttattatcacttaaagttctattgacagctctgctctagggagtctcactaatttataaggcagcctgcttcattcttggatagtctaattgccaaaaagctcttatttataatcaatagaattttgtctctgtacttttctgattctaactctgccctatacaaggaactcaatccctcttccgtgtaaagtttttcagatatttggagaaggtttttgcaaggctgtctaagttgattcctttttagaccaaacaactgttcctgcagctgttctcacttgtcccagtgtccaggccttttgctgtcctggccctctctctaaaagagtactagtttatcagtttcctcttaaaagaaagttcctagaattgaacgcaataatgtagatgtagtcccaggacagggaagagtgtggagtatatttcctcccttcatcacaacattaaatttatatatgactgcagcccaagaagattcattttcaaatctgtgatgtcacactcttgggtcagattgcgtaaatctctctctggctgacttataacccctctgtgtttctaatgtttgttgactttgctatcaataggttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaaggtaagtgatattacataagcaccatcgctatggaaccacagcatgtattcccaagaggaatgcattgtaacatccagcagaagactctttctattcattgagcacgagctgtatttttagatctttcttgctttgattttctagtgactatgtatgaagagatggcaagtaaacaagatttaaaaacgaactagtgtccacacttaaatacctttttatcctccaagcctcagagtaacagatgcttaatgaattactttatttcatctgcttaattttgttttgaaaatgacttaactaattcatcaccaactgtttaaaattagtttcttattcaaatgtattatttattttgattaaagtacactgcttctaatgtttctttattgccttatgttaaaggagtatttagaatttgtatttgcattacttagtcttaccaatgtttctatgccagacaactatgaaacaaaatatcaattgactatgggaaaaccactcactaaaagcagcaatggcatgttcattatgtgaaagctggtgtcaaccatgcaaaaacacagcttttttccccaaagcatgacagtcactgtgtaagattgacaaatgggccaacgtggatccccagaaaagctatgcctgtttttctgcatagagagtttgcgtaacactttcattgattttcagtgaggttcctacttcacaaaagtttatttattccataccttttcctttacttaaaaccattcccagaccacccttttagataagatctcccaaattctcttggtgaatcagtgtatactaattcttactgttaagaagattttctttctatttgaacgcctgctaatgtcatccatggagataaatttttacctttgtgcagctacaaaaatctgtttctttactttgaaaatttgggtatatttttcaaaattttttatatgttcttaggttgttgaagtttattctgaatgtaatatttttacaacactttaatgatagtcacatatatgcccaagatcttaaaaaaaactcaaaagcattaaaaatcttcaaaactacaaaagtttaaattaatataaaaggttaaataattttatagtacgtgaagaactcttttttcacttgagcttcttctgtataaaattatgccttttgtaataaagccacaataaagtggacatttgaatcgagtgtggttgccttgatttcaaggccaatccagtgaacttgggagacattggtttttgcttctgtaaacccacccagctggtatccagcagtgaagaggttgtaacaaatatcacttgaatgaaaatggatcacagcacaaattcatttcaaccacttatccctaatatttgtccagaaccttaaagttttgcactgttgacaccagctttcacatagattcatatatgcgattttatttgatcttcacaaaattctgggaggggtagagcagatattcttttctctattttccagatgaggaaacagagttggagttaagggtgaagtcaaagacccctcagggttgaaacatcagacagatttagtcctttttccacctcacctctgagaaaccttgctcaagtcctgtcttcctgctagtgaatcactctacatgatcacactgatttcaccttgggaaaggtgtcgttttatgggagtacgcacaatgattgaaatggtccttttaatgttctgctttcagataccgccgaagagcacatgtgactcccaaatcttacctctcatttataaatggttataaaaacatttatgctgaaaaggtgaagttcattaatgaacaggctgaacgtatgaatattggtaagaggaatggaatggaatgggatggaatagaaatagggtttatttgatagggatctcaatattttgtttggtggacattttgtctgaaaatgaaatactcactttgttagtagtagataattttaaaggatggccttgagggtattttgacctgtcgagaaactctgaacagaagaaaatctaaacagaagtggcctattttctctgcagaaccatttctcctggctctttcaactctgggtcccctgtgctgagtcactgagccattgctggcagatggggacaagccagcttttgggaatggacaacaatttcagtttttggtttcattttgatttgccttgatttgtataaactttgccatgttaattttccctacatttctaataaagaaaaaggcaaaatagaagcaaaaacaaataaaaacaaaaagagattgtgtacctaagcaagagttttccaagtgtctgctatatgtagtataactagcaaaagtaaacattggaagagattatatgtccagaaagcatgtggcccaaacaatctaaaacaccttagttcttatttttcaagttctaaataaaacttgaggggctgagtatggtggctgatgcctgtaattccacactttgagaggccaacgcaagcggatcacttgagcccaggagttcaagagcagcctgggcaacatggtgaaaccctgtctctacaaaaatataaaaattagtcaggcattgtggtggtgcatgcctgtagaccaagctacttgggaggctgaggtgggaggatcacttgagccctggaggtcaaggctgcagtgaactgagattgcaccactacactccagcctaggtgacagagtgggaccctgtctcaagaaaaaatcaaaacaaaaaccacttggtcacatagcataacagcgccaaggtctgtgaagtcatagttatgagagaagactgtgaaagaaggcttcttctgcggttttctcatgattcagcttcttgcagctttcctatatgatgctttagatcagtagtgtgctgaagccaactcatagtggcttttgagaacacaatgttaaatttttaggaattttgtgatctccttgttaaacagaacttttattaaaaattaactcatgtatacttacaattaaacaaattggatttaaaataaaggcaataaatgctcaaactcatcccttcttagttttactctttttttttttctttttctttgagacagagttttgctctgttgcccaggttggagtgcaatggcgtgatctctgttcactgcaacctctgcctcccaggttcaaggaattctcctgcctcagcctcccaagtaactgggattacaggcatgcgccaccatgcccagcttgttttgtatttttagtagagacagggttttgccatgttggccaggctggtttcgaactgacctcaggtgatccacccgccttggcctcccaaagttctgggattacaggggtgagccaccgtacccggcctactctattttcttatatcaatgttcttgaggttatttacttctgtctgtatggtaggaatattacataacagtgtggtactgagaatcttttggtagcctgaaatcagccatggtgggagtgtttacactacagaaattggacaatatacagatgagggcttccccttttcccagtgacccagatttaaatatttaccaacatcccactacctagaacccgttggaatgtgagcaattcagttaaccagttctttttctctacggtgctaaaagttgcaaagtccattacataagttttcacagttattttcatttttataacaaagagaaccacaaaaatgttaatatattttctatttcatttgccacctcagctgcaatatgattcaaaggcaaaaaatgatagctacaaactgtttacaaagccacagagagcataaatttgtcaaataagtttcttggccaaactaatcttattcaataggacattgtgactttcccttaaatgtagctacgtgatattcttcggtcagagctattttctttgccttcctgttgaaactcagaaatatggtcaatattgttgcttttaagacatgtatatttttaaagcttttgtctacaattttgtgtttgttatattacatgtacagtgcctaataaatagtaaacattgaataaatatttgatgaaggcatatacctgtactcagtaaaggtatatatgtgtgtatttgtaaaggtcttgataaactaatggaggcaagtgaatctgttgctaaactctctcaggatcttgcagtcaaggagaaggagttggcagtggcttccataaaagcagacgaagtgagtttgcatttattttatcactgatgaggaatatttttccatattaaaatgcattgttttaaaatggtactaaagaacaagcagggtataaacccatggacaattcctgataagatagtgttcacaaagaccattagacatttttgtttaacttataccagcgtatacctgaactattaattttgctacttggcctaagactattatttcttctctcactctgtctgtctctcttgttctttttcatctgtttatgaaatttctgcttgactatgagttatatttggtcttctgtttaaggtccctgtatgttccaggtttctgggatggcccaaatcgaggaagagttggtagagtttttttttttaaaagaaagaaagaggaaaaatccatactcctctcaaggagataggtatatatgtgtgctgctttttctcttttttttttttttttttttttttttgagacagagtcttgctctgttgcccaggctggagtgcagtggcgtgatctcggctcactgcaacctccacctcctgggttcaagcgattctcctgcctaatttttgtatttttagtagagacggggtttcaccatgttggccaggatggtctcaatctcttgactttgtgatccgcctgcctcggcctcccaaagtgctgggattacaggcatgagccatggtgcccggcctatgtgctgcttttttatctattatacagccttctagtctcagactttcagcttccagtcaccaagagtcagttaagaatagatacttcagtcttgatccttagccagttgctgaaatgagtgaactaacataggggaggcacttaagcatagtcctggcatatatggtaagcactcaataaacattagcttcttttattgttattatacaaggcttaaaatggttttttgcccttattctatgatacttacttgaattgttttaattttctagaaatttgtagagtgaaaatactatttcttctgaaagctttaaatatttatttatatatatattctaagcctaagaaaagcttagaaaatggaagactgcgaggaactgctcaaaggaatttactttaatataccttaaaatatagacaacttaggaaataagtttgttcttattcgtgttttatattatgttgaataaatatttgctcactattcagatctataaattttgcttgaaaggtttctattggctttcatgtgtttcctcaacttaacaggtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatgtgagcagtgcattgttaccccttccaacacaagtcctagaaggcttcatgtttcattacatgaaattaactcatcagaaaactgaattgaattcttaatgtgattgataatctctgagtctggaaacaaatgtgtcaattaattcagttttctaagttctaatttttttaaagtcttcccctcttatattattttcatcccacaaattggtcttccatgagaactgagaaataatgctagtggttagtggcctaaactgtgagaaattcagattacgcagagagcctgctcagtttctccagcatcccttccagattatgtcatgctcccttttaaaatcttcctgtggttcccactgctcttaggataaagtcctgagctagacatccacagctgtgaggcaaaaggggcacagctttggaggcaggcagacctgcattcaacctctatatataatacacacacacacacacatacacacacacacacatacatacacatatatgtgcatgtatatatatgtggatatatacacacatatatacacacgtgtatatacttacacactgctaatacacacacatataagtatgtatgtacatatagatgatctggagtaaatttgcttaactttcttgggtttctatggggattataatttctcattgatccttaaagaatcaatgtgagcattaaaattaattaatacaaaatgctaggcacatagaaagcactcaataaatattagtgcttctgttcctgctgatgacctggctcctgtctgtctcttcaactttatctcttgtcattttgtccctacacacaatgcgatccagtcatacagaaaaatgtataggattctggaagaatggtcaggatctgttacctttaaacgtgcctccacctctgctgggaatgcttttcctaactttcattgcctaattagagtcattctttaaatctgggcccagacctcactcctcccaggaagttttcagttcttcttcgaggccttcctttgttttcctatcactcacatgcttctgtcatggcagaaatccttatgtagggtaattgtatttgctttgccattttcagaggttatgaggacaagactattttggtttgctttgttttatatgggagaatgcctgcaattgttaaatgaatgaataaatctatgataatcatttaataaaattttcacaatgaccaggacacattctgcacccccacttcctttatgggtcttactgtaacgtacaaaaggaagagatcaccgaaccgaaggagtcttagaacatgttattgatcatatggtctcccagtccttgccttgatggtcaggcaatgtcttaatccaaacccagccaatggatagaaattttcaaaaatgtttttatgagccatatattacagtaattttcttgtctccttctaattcctctccctgccatagacagggaagccctcacaatgaaggctaaaggtgaggtttctgatattcagggctttgtatcctctcttaatatccacacctaatatagaccctgtgctttgaagatgcaagttatctaaatgttacatatcagtgggacttattaacagaggtctatgatggcaatgcctgttagtgatattttaaaccaattcgttgggagcaacagggaaaagaagaatacatacaaataaacacaaataccaaaataacaatgaaagagccactaagcaaaaatcttggaaatggagagaaaatatgttttaaagttttctatcttaattattgaaaagtattagatttccatataactattaataccactcaacaaacaaaatattgatccttaatcccaaatatagactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaaggtaagtaaaatctatcattgtcaatcctatgagctgcatcaggcgtcctcagcccaggacactcaatatagaccagacaaactggcagacaataattgatcattgcgtattgaaaagtttatcttaaactccatcacctaaaatgtaaagagggatagattttaaagccaaataccttctttttatgacatctgtccagaaccggtggctagtattggcacagccttggtgtcaacccagcccagttttcaaaaaggggcttgtgtggttggtggcattcagatgcacttaccagaaagaaaacttacatagcttttcttctttactctttccacatggaatccagaagacaatttgtgatttacagatttaggttggctactgccaatagtctcaatttgtgtatttagagcaaatcatctattacttctttgagaaaattcaatttagaagtacatattaactcaggaagaaagtattttcttccagaacttacaggttataatactatttttcagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggtaaaagtttccttccttctcccagtaaatcaatatttcataaaatcagtcatcagtattactgctattaaaagacaatgcgtagtttagaccaataaaggtagatgtccctgttaccaaatttgtcttttttctctatgtcctctcaaagtttctccttctttttatatctgttacatgtttcttgacaatgcaggcaagtgactgaaaccaacatgttaacttacacaggaaatgaatttcttgggaataataatcaagctgtcataagaagaaaaacttgccatttctttgaagtttggagattaggtttggaggttgaatttgattactgtatttcaaacaaaacttataaaattaggtttgacacctagaaaggttttaaatttcaaagacagaaggagaaccttaaatgcaatctaagaagcaatcagacaaaacctaaaaggttgtttacaaaagacaaatcaagatgttgcagatttcccacaaccctaaatactagaagataatgaaaaaacatatgcagagttttgaggaggaaaatgctggggtccaagcactccataatggccaaagctggtcttcatggatgagggaacagaatgagattcttaggagggcaaggattcatgaaatgtatcactcagatacacactgcctccagggccccatcccaatctcccaccccaacaaagctaaaagtattataagtggttgctctgtggaatggataatgaggagtcggtgggcagggggttactgtttttcataagccttagagaagtggctgcctcctttaaaacctgtgcatgaggaactttgagaaaaatagaaagtcaatttaaaataaaaagttttaacaaagagaaatgataggaaaaatacaaaaaacacaccccaacaaaaagatactaagggagaaatcttacaataaatgtagaattcaagaaaaaaaagaaaacacacacacacatcagaaaagaactattctttgttgataaaaattatgatccatagtgaagacaattaaaataatgtgttatgcaataaataaaatagcataaaattgtataaaccaaatccattagtattttcagtggaaattaacaaacataatactgtaatttgagattgtgatacatgctatgaaattaacaaaaataatattgtaatttgagattgtggctacccctggtaggcatagggccagcttcttgggtgtgcacacagggccttgtgttaatgctctgctgttgccctcttcagattcttaatatttttttttaacaaggggccccacatttttcattttgcactgggccctgtaaattagagaggcagtcccgagtaggcataaattagtaattatatagaaattttacatgatactatttttcaggttgaataactacattgaactttcttcagtataaacaaagaacatgaaattatttctagagtacaagaaacatttataagaattaattatattcaatggtaaaagaggaccttgattaaattcccgaaagcaaaaaatcctggggtctcattctctgagtataagcaataatactggaaactttacattaaaatgaactcagtcattcctaattaggaaatgatgaaaataagcgagttaccaaagcttctgtgatatggccaaaatggtacattcttagcccttacatacatcaaagaaactaaacattccactgaagagttaaagtatatactcactcataagcatacatacacatgaaatttaaggaaatcggaatagagccaataaaaataacattaaaaattagagaaaagcagcagaattaatgagcaaatctaagaacctatgctttgcaaaaacaaaactgtaagaaatattcctggaaaatctaatcaagaagaaaatgaaaacaaatgaaaatagaaagataaatcctcataattctagatgtgaagatttaaataattataaagtaattgttttttaagagacagggtttcattctggcccccaggctggagtgcagtggtgcaatcatagcttactgcagccttgaattcctgggcttaagcagttctcctacctcagcctcccaaactgctcccaggattataggtgtgagccactgtgccaggctgcaaatattacctagttatatgttaatatattagaaaatctaaatgaaataaaagttttatgggaaaaggagctaaattcaaataaacattgagaatgaaaataagaaagggatcaaagaacttctaccccagaaggctttgggcctagattattttactgattattttaaatttacaggaagcagatcattaccacattgtaggacttagaaaaatatgaaaaactactgttacagtaatttcacttgcagaatctttgaaattggattgttaccaaagtaacaatcctaaatgtgtacatatccaatagtatttatcacaacattatttgtaataactaaaaatgggtgggtggacaaatgtatatgagtaggaaaaaggttaattatgatacatccaacacgtagaatatcatgcagtcacataactaacgttcatgatggacttgggaccttcataaaatgaaatgaaatgaaaaaaaatcaaaatgccaattacctacttcctaacacaatactcacaggttatgtctgagaaatttcggggtaacttttgtcctcctttctatacattgctgcattttccatgttttcttattgaacattaataattaaaaaaatttttttgagacagggtctcactctgtcgcccaggctggagtacagtgttgcgatcacagctcactgcagcctcgacctccggggcccaagtgatcctcctgcttcagcctccagagtagcttggactacaggtgcatgccaccatacctagctaatttttctatttttctgtagaaacaagatctcactattttgcccaggctggtcttgaactgggctcaagtgatcctcagcctctcaaagttctgggattacaggcatgagccaccacacctggccagtaattaaaaatttaaaagtaatgaaataccctccaagacgctttgctttcccagctgaagacacggaaacagatgtgctcgaaagtcccgtctagtgcagaaattatgtgatttgtgttatctaccagttacaatcatgactgtttcatgcagctaatacactaaccacgtcttcttcttttcaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggtgagattaaacataaaaaatccccaaaatggtgtactgaaactttacacaagagcatgctatatttggaaatcaggcaaatggttgtgatgaaaaaatattggccagcatgcctatctgctttggatctttggtgctcaaaattattttttgtgttttcactgatcaaactttaccgtcactgatttgagggttagaaaactgggtttgagatgcagctcagacacttgttaattgtgtggtttggggctttcacgcgcgtccatgtgaagagaccaccaaacaggctttgtgtgagcaacaaggctgtttatttcacctgggtgcaggcgagctgagtccgaaaagagtcagcgaagggagacaggggtggggccgttttataggatttaggtaggtaaaggaaaattacagtcaaagggagttgttctctggcgggcaggggtgggggtcacaaggtgctcagtgggggagcttttgagctaggatgagccaggaaaaggaatttcacaaggtaatgtcatcagttaaggcaggaacaggccattttcacttcttttgtggtggaatgtcatcagttaaggcaggaaccggccatctggatgtgtacatgcaggtcacaggggatatgatggcttagctttggctcagagacctgacaggggcaatctacctagctctgtttgtaaaatggggatcctaatataacctcttgggataggttgtaagcagtggtggtctggtaaatgttaacaatctagtgtgcagtgtggggagaggaaagtccggatttgtaatatttgctgatttctgtggtgtaaatactcccatcactggcaattttaaactccaatgtaacgtcactgagcacagatttgggaaaaggtgcatggcagtaccccatcgcatactatttccaccatccagatacaacggtcttaacctcaaaaccatagataatattaacatttaaataattaggaagtaagcttttgttatttattacttttgcttttaatataattttttaattgtaagcttacatagtttaatttttaataaaggctgtgtttagcaccagctcacaaatactctaaaaatttaacaattggctcttaagagttgatacaagccggctgctacatgctattgttgtctgggatttttccaggagaaaatactttgtaaatgacaaagaactcgggattattactgcatccaagacatcaaaatggcaaatcttattgatttgattctgttttgaaaatattcaatagaaatactattgtaatttgtctgattaaaagataaattatgtgatttggattctgtcttacaaaattgctttccttgaaattttataaggtaaaatcactatattatgaatgatcaaaatttaatatgtgaagtttcaatgcacactgtatttttaggttatattattttgcaaagtaagaaattcccccatgtatttttatgtgtgaatataatggatgtttgtgttaagcacttagaaaagttttttgagacattctcccattatggctgcaggatttgcttaatgacgctgatacgtgccggaaaaagatgcaggccgcctccactctcatcgatgggctgagtggagaaaaaatccggtggacccagcaaagtaaagaattcaaagctcagattaataggtgggaatctgggtcttcttcataatcactctttctttgtgacattagagaacataaagtccatttccatgtgttcatctctgaatcccatcatctatgacagtgcttgcaacttaaatcatgcactctcaggtgaaatactatagagggtgaagaagattttgtgaaatattttacatctcagctgtggttcagcactgtgggttttcagtatgagagtgcttttgatattgtttggatttgccagagccgtctccactccagttctctatgcttcacctcaatgattttgaaagtgtggatcaatggtttgttgtggatcaatggtttgttgtaaatgcaaggctgtcttctgctggtgtctgttggtgtccttagaaaacttaaaagagaggggaatgagagaggagcaagaaaatggcaaaaaaataaaaataaaaataaaaaaataaaaaaataaaaagggaggggaaagaaaaaatggtttaacacaagactgaaatctgaataagagcaagggacaggatgggggaagatactttcctcacagtatcaaggctcacgacctgtaggcttcaggaggaagccttctttcttgcttcctgaccaccccacatgtggccactcctacccacttttgggtttggggctccactttgcacggtctttttccatgcctggctaccaagcattaagcaggggcaaagaaggatttcacccagtaacagagcaaaactgtgacctctcaaacaacttaatgtcaggtgactcactttggggagggggctgtgtgttttcttcacagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactgtaagttttactttcccaatgttatttgaatttcagtctcattttatttcttacttactgagaaacccggctgggtgtggtggctcacatctgtaatcccagcactttgggaggctgaggagggcagatcatgaggtcaggagttcaagaccagcctaaccaacatggtgaaatccccatctctactaaaaatacaaaagttagccgggcatgatggtgcatgcctgtaatcctagctactcaggaggctgaggcaggagaatcgcttcaaccagggaggcaatggttccgagatcacgccactccactccagactgggcaacaagagagaaactccatcccccccccaaaaaaaagaaacccaggttcattgaattttttctttaactgggaagattgttttgaaagtgcttaagagtttttttaaaaataattttctttatggtataaatgtttctttgcgttttaagtaatcttgcttccaaattaagaccaattgcattgctatgaactgaaagatcatttgagagatatcagcttgctaatactgggcccttcttataactcttcattatttacaccactcctgtgaagtcatactctctttcaaacattttaggcaaatgtaggcatgatctgtgctggtattaaccttattttcattatttgctatcttttttagtgtctaaaaacgtaacagaatagcatgttctggtgaccctaagtaatagcaagtcctttcatactaaccttccttgctgggaattcgatgccactgtcaatttccggtatatcttgcagagcttctgttgtaataaatgctttccaggcaatttgtattcatgagttgcttttctggtttgcaaatctgctctccagttgctgtttccttaggggatgccaagctattaatttcatattatctgtatttaaaagttaaaaactaatcttttccaattcgaacattgttgaattcacccttacagggaatagattatgtcttggagatgcactgggcactggtgaagcaaagtgggccagaatattctttattaattatggcctttgggggtcctgggataatttaacaaaggtggaggctggttggctcattggatctctgattattttattttattttattttattttattttattttattttattttattttattttattttttttagagacaaagtcttgctctgtagcccagacggaagtgcagtgctgtgatcatggctcacagcagcctcaaattcctgggctcaagtgaccctcccagactcccaaaatgctgggattataggcatgaaccactgcgcctggcccggtgattttattgatcacatggtgggaggctggcaatcccctctaaatttggagaaggaaatattcacaaaagtgtcattgatgagctccggccaatataataactcatctaatttatctccagctatgcaatcacccatacaccatgtgggcagaaccaaagggccggaaggggaagctatcaggggctaattgcctgggacttaccttgttctctgacatttcattatattcactatctccattaaccccaaatcaggtttaatatgcaatcaacttgctatgattcccctaagtatgaaaatacaatgcaaaaggataaaccttgtcttgggtaattaaagaagggattcattagataataaatttgtttttttttaatgtgaatgttatttggttcacatttacaagtttgctttttttcgaagtacaagttgcatagtctcaaaggaaaataatgtccacattttaaattattttactttacagtacttttaattactaatgagggcattcctgttctcctttgaatggtgatatccatttcctgttgttcagattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtatgtagcatttggtgcaggggaaagtaatcttgaaatcatgaaactctttcaaaattttgattgaatctgcagtcataaagttgtcatctccatgacaaatgtttgctaattcacactcttgagttttgtaacagcaatttggggcaacagctctgattcttttctctcttttgtactctctttggatcctccctccccctctctttgtacatttccctgactccattgcttttgctaatgtcgaatgtggcttttgttccgggccttgggtttgggcctataggaaagtggcaaatagaacattgtgatccctcagttcaagaccattcatgccaaccttgctcaggctcttggtactacgtagcttactgagtccagctttggtgcttgcatctaataaggtgttaattttaaggtgagagtagacaagggcaggattccaacattcctgactcccttagggattctgttactattgatattttaattcaactaccaatgtgggatattcagtgtttcctagacactgttcccagtgctctaaacccccgtccccatgtttttgcttatactgtttctactaaccaaaatgtctttctctacctccacttatatcctagataaaaatctcagatattcttcaaagtccacatccaccactacctccatcaagacttttctgtgtccccagctcaatataacctgtcctgaatcctcacaatgtcttgtttgcactcatgttgtggacttagaatctgacttaaattattgttctttgcacatttatcttttatttctattgtaccatgaactcctttttggccaagttttattcatctttacatgttctgcactgctctttttgagtaggaattctgatatttattgaatttaagtgaattaatcaaagtgtgtcatcattatagaaaaaaagaaccaggaaaataatgtggtcatcttgatgaatatgaaaagaagcacttggtaaaattcaatgctcattcatgatcaaatttccagcaaactgggagagatcttccttaattagatagtttctttttacaaaaagccataacaaacatcctatttagtggtgaaatgttgaaagatttcctcctgagatcagtgcttctcatccaagtggatatagcccagtgctgggaagcacacctaaataccccacctcatcaatactccagaacacgatacatcagtctatgtttactaagaaaacccagggaaatcctagaatggaccaggcaatgtaaatagaagagaagagttaaaagaaatagtgtccatttccacgaagcttcttaggagccacattttcaggggtgcacaaatgtggtataccagaacacttctgttcttagtttctgcagccaggtcaactataacttgtccctggccccattccccttggctcccctggctttcaatctccctgctcatcttattcttggaaccttgcctggacatccttagctcaatgcatgctcctgtatcacttggacatgaatgctgctattttttctgatcttagctttatctctccatttctggattaaatttactgatagtcttcactgaagtcctttctgatgcaacccagtcccaggaaccttcttgtggaaggaatagaaatatgcccgaaactcttccttattttaaaaaccatccactgctgggatggaaatagactgaattgtattctccttactcagacaacattattttcttatgtggataagcacatgtacaaacacatgcaaatgaaaaacaaagcatagtttttatgcccagggctgtggtcaaccttggcagctttgccaaggctaccttcaatgccatctccaggacctacagctctgacttgtggaaagaggatgtatttaccaagtctccctatcaggaattcactggtcaccttgtaaagacccaataccagtctttgcgcaggtgaaccaggctctgggggtggctaccaaatagtgtttcacaagaaaaatccagtgaaataaacctgaaattgggattccaaaatactatttcaagtttctaaaagacattgaagatgactgaagataattatctccttacttgggaaagatatcacaaaaatagaatttaccccttgagaaataaagcaagatataagcaaatttagtcttactggtgcttttcttcaccttgtttattaagttcattaaagttctttgtttagattctttttccttattaacttacaggaaggtctttacagcacattatttgtataaagaaagctattcatccagggaaacaacttccttcatgtgcagaatttttttttagttatttcctttttaatcaaaacaggacaaaagtaggctgatttaattgttatatttcatatcttctttttatcatagtaattgagagatacatatttaattccattctcctaatcgcctgttgtcccagtggattcttccttgcatcttatggtctgcacccacaatagcctaaggcattagttgaattcagaagataggatacaaaaagttgagaaatgagcctttgggaatcttcacagttaggcagggggagggatcctaggtgaagtaagggttcaaatccaattggctcatgcagagatgaaccactacagtgtgtctattttaactaataacaaacgcattaatctaaacacgaagacccaaccaggaattcagaattgcagttttaaaaaaatgtaagcatatataaagtgaatgtctagtcttttaggttgactttacggaaagtgttaaattcttcccagtgccaataggagacagaatacatggatagaccctcagtgcgactcaatatatcatttctgacattcttatgtttactttttatcacttactcatcttgtaggggtcctgagaaaataaatgaatatccagatatgcaagttgctttgctttctctgagcgattatagctatgtaagtttgaaaggattaatccttgactattctcttccatctgtcaggagcagaactctgacattgcatctgagcaatgccccttaaccctcctcttttgatcatagagaccccattacacatctagaccccattcaacaaaatcatgactcaccaagttttagaaattaatttttgtatgttactttaatttttttaagtaagtcttcttctattgcccttaaaattcttgattacctgtccaacaaatctctcggtttcccttagcaatgggcacattctttgtaacacagatagaccaatgagttctttctgtttaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgagctttgtaaaaaaaaaaaaaaagaaagaaagaaagaaaagaaaaagaaaaaaagaaaaaaattaagaaagagaaagaaagaaaagaacaatggtgacatctacttatcttattgagcatagcagcaaatgcaatttcctttaggcagtagtatttggtacgtcggaaataaactatttccagactgatacttcagtgtttccttttattttttatagcgtataaaagtttctgaggtgggggcaatattttgataagagtagtcgtttagctaaaactaagtaacattaaggaaacacattgtctggtcttaatatgttagtgcaacacacagtatatatatgtttaagcaactctagatattggttttgcaagccttatatatatacatttttacaaaataacccggatttcttccctggagaaaatgacattttaataaagtcattgatttggtaaagtcattgatttaataaagtcattttaataaacacattgatttggtcatttatctctttattttcagtctaaactcattgactttgttggaagctatggaatattgttctcaattgttggtgatgaattattttcaatttgtataagtgtttcatgtttaatttgtgtcattctctacctttaggcttcttaagttttataacagcatttctgattgggtgtttattactttggacaacttaatttcatgagtatcagtgaataagtaaaaatgaatattttctcattaaataaagacagatttattcagaaaaattttcttcataatgtgaaaatcttttatatgccgcattttaaaaaattcattcagcaaaggtttatggagcatccaatatatacttaagcctttatgagtttatagggagaaaaataaataaaacgcagttagtgttctgaaggttagcatcattctataagattagagggtagaatttctctttttcataaaaagaagctaagaacaaaattttggtgactggcttggatattatggactcatccacaattttgaactgcatttaaaaaggtttaatccacaggtaaagatcgtatatatttaaactgtacaatgtgatgatttggtatacatatacgttgtataatgattaccacaatcaaattaattaacacatccatcaccacacatgctgtaccttagatacctgaaacttgttcatcttatcactgaaagtttgtaccctttgaccaacatctccccatttctcccatcccctatcttgctggcaaccactgttctattctctgcttctatgagtttgacttttttagatttcacatgtgagatcatacagtgtttatctgtgtctggcttatcttatatgacatatttaatatgccaaaggaggttatagaatctctattcccgaaggtcttttaaaagatcctagatttttatctgcaatgtgaaggcataatgccttagaatgtgatggtggccttagtgatgttttcggtcacgggcagaattaagattaaccagagatttaagtcatttaaaaattctatgattgccacctgatttttagatagcaaaaaccaattgttttttcaacatgctgcaaatagtagtgttgaagataaatgttacctttttgaaaaaagttggcgtttttcctttgaaaattacattaactttttctgttgtcaaatatgcttcagatatacctatgaaattcaaaaaacaaaatttcctataaacacatcaaatttccacagtaggaaacaattttcttaactggagaaaaaatagcggctcctgtactacaaacaattgatgggagtgataagtacttgctaaaatgttaaagtcaaatcttagatatgtctaagttttcctttattcaccgtttgttttggataactttttcatttgatttgcttggtatcattgctaaaaacatcaccaggcaggactacaattctaaattattctaaattgaataggctttattatttaagatcagtgattaaaattttgtaactttccttcccaatttattgaagcgtcacagcactgacaggtaaattcttttctaaattgaacccaagttcctttccctgccctttaagctgtttttaattttatatgtgaatttatgtaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggtaatctctctctcaaggtaaagaatttctgcttataatacatgcttaaaatgtattgagaaattgctaagtatgtgaaaaagaaaaaaaaatttaaaaaccatatttatccttgttaacataagtatttcttttgcagccttaattcctgtcaagaaatcatgtaactcatcttctcatccagcctgaaacacacacacacacacacacacacacacacacacccgtctctttctacttctgtctttaaacttctaggtgtactgactctcttatgtatagtccttgtcttggggacacctgaaaacatcaataaaacaatgattgagagaaaaagaaattcctctgaatggctcttctttccactgtagtagtttcaactactacagtccaataatctaatgatatagggagccatacctttatttttaattaaattttcctgcactaaagcagggaaattatgtctaactgagggttctaataaaacaaagaacaacttaggactggaagattttaagagactgatacaagattaaactaatttttaagttgaagctcagaaaacattgttttatgcataaaatataattgcataaaatattttatgtatctgcattataaagtacatttgcataaaatatgataaagtaattaattttagaattaaagattcaagacaaaggcaaggttagaaataataagagcagcaaggcatgaagtggatgggtgagaaaaagaatgacaagggaggaaaacagacagaggagggaaaagaggagatgtgaatccagggtcccaaacacaggagagacatccaagaagggagagggaaatgacacagacaccaaagaagtagactcagtgaaaggcaacatcctacctggctcatagacagttaccacaggcacaggcccttgaaaggtggctggtctggtggagtgaaaagggcacagtctcagctttgactctcttagttgtttgatcttggtttccaacaaacctggggcttatgcagtccaggaagggatcccgttcctcttccacagccaggcggagatggccctggcccggcaattcactgtttccatcgcctctcaggatcacatgctgttaactgttgacagttagtcccttgtggtctaattggtgctgtgggtttattttgagatgattcctcgctggtctagatcccccatgcaggctgcactaacctccagaagtcaagcaactccactgtctaaaggtccccagggctccccacacccactcttcttattccctagcttcctcttcaagagatgtgctaagatgctcatagcaaccttgctggagaaaaaaatgcacatttaatatgcaggagggtattctaaacattatatttaaccctcctaacaatcctactattatacccatatttttacagatgagcaaatggagaccaaagaaaataagggtctcggtctgtaacagcacatggactttgcagcctgccaagcctcctagataaggtttacaggtcctgctatgaagtttagcaagagtccactgtgctatgatatctgtttttccatatccagaaaaggaagctaatatgatttcattttgtccatgtattcctatactgccacccaggggtgaccattttaatgaaaatgactaactggttatttccctgcaaatacagcaatgctctttatcgccccatcaactcctgccaccctgtaagtacaatggcaataacactagtcttggagttggaggacaagggtattaggctgttttaacacacagctagttactggcagagaccggcctaatacccttgttattcagagttcatatttctgggtccttggcttttccaaatgtaaaataaagaaattggactaaattcagcacatttcagtttgacaaatatttattgggttgagtttcttctttacaaagccacaagataagtactgtcaataatacaaaaatgaataggaaagcttatgtatctgttttctagatgcataaaccgtagttggagggaaataatctactgatagattgtgatacaaactatattagaggccaggcgtggtggctcacccctgtattcctagcactttggaaggttgaggcaggtggattacctgaggtcaagagtttgagaccagcctggccaacacggtgaaaccccgtctctactaaaaatacaaaaattagccaggcgtggtggtgcacgcctgtagtcccagctactcgggagtctgaggcaggagaattgcttgaacctgggcggcagaggttgcagtgagccgagatcacaccactgtatcctagcctgggtgtcagagggagactccatctcaaaaaaacaaaacaaaacaaaacaaaaaacacgcacagaaaaaaatcacaaaaaaacaaaaaacaaaacaaactacattagatgtacagatgaaggctgtgccatggcttttgattgactggttcaggaagactttttgaaaatgatgaaatttctgaagcaattttcccagaaaccttcccaaataagttttaaaacaccttcttttaacgtaattctaagtgcagcatgtgattctgtataaaatcagaagaaaaatgttgtaaggaatattattgagattattgagatttcaatgtagactctgtgtttagtgagagtatcagtgatactgacacatcagtatcagtgttaaatttcctgaatttgaatattgggctacacttatgtaaaagaatgacctggttcttcagagatttgctaaagtgtttaggggtaaaaggacatgacatccacgagtgattcagcagtaataataatgataacaacaataacaataatgacaacattatgtattctatagagatatagtgataaagcaaaatgtgatttggtgaatctaagtgaaggctatatgaaagttccttgtattaggcttgcaactttttgaatgcttgaaattttttcaaaatataattttaaaaatatatcattttatgtaagaagaaaaaaactcctgtaaacattcaagtttgccctctgtagaaggagatacaaataaaatggaaaatgggtttgtattggcaatcggctgtgccaaaccaggtacctggtgctcccataggaaccaggccaagagctcacatttaatctgggtagccccttggtttcttggtattattgcctttttgtttctacttgttctgactgcaaataaagatagcatttcttacagaagcagtgtgggaacagggccaagagaatgggacatgctatttataaacttaaagctggcaagagagcttggggtaattgggcaaaattatttagcagaattgtctggtgcctgccagtataagtgctgtggaaccttaatgacagtaggcataattttaaaaaaatttccacagaaacaaaaatatggatagatagatttggctaatgatagtaatttcttctgccattcaaaaggtactttgctttaaacttttaaaattgttaataaacactagtgagttgggtttactgtaataactggtaattatagttccaatgttattttttgttttttaatgacaggagttagaggctgagagggttaaacttttggaggatgttacttttaataagcggaagatgaaagaacttgaagataacctcctctataaattaagtgctacaaaaggtattgtgttattaagaagtaatgaaataacggattctgaataaggatttcatttacactcttttcaatgccctcatgactatagatgttaggaaatactcatgttatcaatgcaaaaacaagcaaggcaatttccatctagacattaaagagggacggcagagaatctgatttttgaattagcaaatagagactgagcatctgagaataacacaattttcttgatataattgctttctcctgagaaaaattagggctcctgatagagctagataactcattataggttaatttgcttgccccaaagaaactaatgtgctcaatctattttttttttttttttgagacagagtcttgctctgtctcccaagccagacgtggtggctcatgcttctaatcccagcactttgggagaccaaggcgggtggatcacctgaggtcaggagtttgagaacagcctggccaacatggtgaaactcaatctattttttttcaaattgactctttcatttggcattgaaatgcagttattgcaacgggttatgacacatgtaatccatgtcagaagagcttgggtaccaaaggcccagcttaccctctacttggcttgacctcccactttagatgggaaagacaggttctcctctgggcagccaaatcatcatgccacacctcaatttgaggatgtactctctctgcaatatataaaaagaaaattttatccaaagaaaataaaatcaacaaacatattgttctgtagcagacaaatcacagaaacctgaattctactaccttattagaagtgaatgaatacttcacaactgcaccttaatcccgggatgttatttaaacaagtctgaccttccagaagtactgtacctttatggtgagcttagtgaaaagtccttttatctgcctactcgcactgctcccgctagtgaagttgtctgtttcttggtccagtgactcctcccagccatttgggatacccctgggcattaaaaatatagcaagcagagctgagggctgctcccctagtctagccaagagtgtgctggatcaagacctctctccttgaggttaatcccaatttggacttccacagtagacagcatacccgttggagtaacacagcccttcctgcagcacttgtctgccatcccgaactctagggtaggccagagtgctgctgttcgcagatatgggaactgttcgcagatatggggactgttagctcagtacatccaaggtgtctttccttagattttaattaaaaaccaaattcattgtcataaacatgcactatttccattaaaaacaataataaaaaaaaaggatgagttcatgtcctttgcagggacatggatgaaactggaaaccatcattctcagcaaagtaatatcagaatagaaaaccaaacaccgcatgttctcactcataagtgggagttgaacaataagaacacatggacacagggaggggaacatcacacactggggcctgtcggtgggtaggggtctggggggagggatagcgttaggagaaatacctaatgtaaatgacaagttgatgggtgcagcaaacaaacatggcccatgtatacctatgtaacaaacctgcacgttctgcatgtgtaccccagaacttaaagtataataaaaaaaaaaataatgaaaggcaaaactaaaaataaaattcaagtttctcttcctggtgagacattttcactatacccaatttgctcttgttagagacagagggattagagttttctatagcaacgactgttctactaaagcagtgtgaggagtgtaccattcaactatcagcatgacagtcagcccatgtgtgaagtgttcaggttagctacaccctgagacaagcagcgtggacaagctgtgacactttgaggagagccaccaagatgacagtgggtgtgaagcctatcacatggggaacagcaaagagcactggagacatgatcattgtcttgagacatgtgaagacccaatcaaatgggtcttttgctttttgcagatgtttaggcagagcaggggatagtctgtcagcaggaatgttcagaaggcttcaggtattgggtggtagttggactagaagctttttggtgtcttaagattctactgtaccagtagtcttcctgactttggagacatcaagttgaaagctaacagcgttttttttttttcagaagagatgtatcttgctttgcaagtttcccgtcttgtgtactacggttttcctgttttgaatttcaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccaggtgagtcctcactaccttcatccaaaagtggtgacttaaaagtttgcttgtatttctactcttttagaaattgctttttcactattcacaatagcaaagacatggaatcaacctaaatgcccatcaacagtagagtggataaagaaaaggtggtacatatacaacggggaatactatgcagccataaaaaagaatgaactcatgtcctttgcagaaacatggatgaagctggaggccattatccttagcaaactaacacaggaacggaaaaccaaataccgcatagtctcatttataagtaggaactaaatgatgataccacatggacacatagaggagaacaacagacactgtgacctgtcagagagtggagggtgggaggagggagaggatcaagaaaaataactaatgggtactaggcttaatacctgggtgatgaattaatctgtgcaacaaaccaccatgacataggtttaccgacgtacaaaccttcatgtgtacccctgaacttgaaagttttttaaaaaaagaaattgccctttgcttctttgattcttaaaatgtgtttcagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaaggtaaagtgtgtgggatacagatgtggtgtgtggaggatgttgcttttgatatgctctttgatataccataaacccatttctgtgatacagtagggaaatgatgttctaacgaaagtttaattaagttttatttttaataccttttttctgtttttcattcgttttgccctagttacttaagattcaggcctgtgccaactcacctgaatattggtattattgtagttattgatataactacattcagtttattcactgctgcccatgccaggaaaagtgatactggtgatggctttctttagcaggacagccattccctcagcaagggagtataatgatttttcagactgcaagaaaaggctcacttatgtttcatatttgaagttaatcctattcattgcatatctccatgttaaaggtataattaaggagacaaaagaatggaattttcatttcagtttagttacacgagtatttactgagcacatgttatgtaaacccaccacgctagctttggggatgtaagaataaaccagatattgcttgaaaagaaataataacctcagaatggggataaagataatttaaaaataactccaaagtaaggcagaatcacctaagtgctataagagagctaagaaacaagtgttgagtctaaaaggagggaaagattacatgtggttggtgaaatcaaaaagtttcttagaaaatatacctttgtgggttaagccatgaattggggaactatttggtacgtggcaaaatgtttcaatctttttcttgtgtttttggctctttatgtatgatttaaccaattattttctggctccccacaccccataaagaaagtggcatttgaggtggaccctgaagaggtagaaatgaggaaaacattccatgctgaaatggaacagcatgagaaagggaacgagtggagaacatctaagttgtaagaatcagtctggttttgttgaaatgaaaggtggatatggaggcatactgagaaatagagctggacatgtaaactggtgacatactgtggagagcctgggttcctgtaggaaggattttcttgatctgggaagaaacagggagttgtgtaaggtggtgacgtgattgatcattatggtcatttagggaggtgaacttggcacacgtgtaaggatcaaagaaaagaggttcaagggagtctctttcaatcttcccaactgcaggaatacattcctaacctagcgtaaaggcaatgggaatatacagggagataagggtgtagagattaaggaagtaaaatggcaaaaccgatgcatacaagagccaagagagcatgcagaaatgagtctatgatttctggcctatgcagagatttctggtctggtggttggaagaggagttggtttgaggagggttggagtgggggattgctggatgtgattttaggacctgtttagtcagaatcagaataggccaggttttgctgccataaaaacaatctcaaaatttcagtgacttaacacaaccaaggtgtacttctcattcatgttacctctccaacgtgctgttatagtcactcagaaatccacattgcttccataactactatggcagaggggcaaggatgtggcagactgtgcactggctcttaaaagttaccccacaagtgacacatgtcacttacgctcctatttccttagccaaagccagacacacagccacatctcacttcaaaaagagcagggaaatgcagttccccgtgtgtttgaaaggcggggaaacagtttgtgaccagctcttatgactacagacgtgaaatttgagctatccagaaaacaattagaaaagataacctaggccgggcgcggtggctaatgcctgtaatcccagcactttgggaggctgaggcaggcggatcacaaggtcaggagatcgagaccatcctggtcaccggtttaggtgaaaccctgtctctactaaaaatacaaaaattagctgggcgtggtggcacgtgtctgtagtcccagctactcgggaagctgaagcaggagaatcacttgaaccagggagtcggaggttgcagtgagcagagatcatgccactgcactccagcctggtgacagagtgagactctgtctcagaaaaaaaaaaaaggaatctagacagtccaagagaagagtcaggcagttacaaagatggggtacagaaataacagccaaagccatgggaatgaaagctaatctagggaaaaaatgtggagtatttctaacccacaaggtgataggacctgctatacttttgtcctctgcagcctatttataataaacgggcagtcaccgataacttcttactctttctctacttcatttaattccttcctcagattcaggttagattaccactgtggaaacttcgcaaactattttgcatcatctctgaaatctcttctttgtgcctttttcatgaacacaggttttatttctggtagttccaaggaagttgaaatgtatcatgtggttcatatttttttcacaggtctaatgcacttatggaagttggttttttaaggcagtgtggtgtggtacaatgaacactatctagggtggggaggaggcactgcagagagtgtcaagatgtatgaggttttggtcttggggatgcttaagtaaagtaagtgaatttacccaatctggaaacctattttacctcatttcaaaaatctttaagccctcacttggacttgggctgcagccctggtattgtatgatgctgagcaggggggtagggggcattgaagcgtgctgaaatccaggcagcagtggcagcaaaatgacccccacaatctggggaagcctcatatctatgcaccatggtctgaatgtttgtgtcccctcaaacttcatctgttgaaatcttaccccaccccctccaaggtgatggtattagcatgtgaggcctttggaaggtgattaggtcatgagggtagagctctcgtgaatggggttagtgcctttatgaaagaggcctgagggagctcactccccctcccaccatgtcaggacaccatgaaaggagccatctatgcaccaggaaatgggccctcaccagacgttgaattcatcagggtcttgatcttggactccccagcctccagagctgtgagaaataaaaatttctgttgtttctaagccacccagcgtatggtatttggtgatagtggctgaatggacaaagataccgtgcaatacgagtggaggagaagtatacttttgaatctttccttactggtgagctggctttgcttcctcaatgccatctgctaatatgacccctgagaaggaggcacatatgacatagaaaggaagaagtgggaaacctggtgcctgggtccacagtggatggtgggaaggaaaaaggaggtcagaggtagaaagaggaggtcaggtgcaaagatcctcatctcttccttgcctcctgagggagctgagaaggggagagtgccggagaaactcccagataggagatgcccctgcattctgcccagtgtcacacccaccatggaagcaggggaatggctggatgggtgagcctgaggtttggctggcacacagcagagactagaggtcaaaccaaaaagctgtcaagaaagagaactttgtacctgcagacaaaggaccaatgccaggagctggggcagtggattgcagtccagggccccaacagatagcatttgtcgtagctcataggatacagtacagggacctagcctgcacctgaggtgtgggaagcctggagggcagcctgcatacctgaggcatgctcgatactaagacatagtcccaccccgtctcacctctcccacctaccaaccaggcagaccagagctactacctgaaagagactgggttatttgaaagagggtgggtaaaccagaggagactgagaaacacggcaacacagtggggagggaattcatcagggaggattagatttgttacagaaaaataaagaaggctgaacacatgggttgtggtgtgagcacatttgtgaccccatttcatgaaattggagtcagggagaactatactgtatagggccaggagagtcagtgagaggagtttggatttaatttagttggcaatagggagccatcgaatgttttatgagcagggatgtggcatgaacagaacagtgctttaagaagattaatttgggattttatgataggttgattgacagcagtacaattggcttagcaataaaggagtttttctttttaaacaaaacataacatttgttttagttttgaactggcttacattttgactgaattatctttaaaagatggtatgactttgtttttaatgtttctttacaaagttaacaaatatgatccttagatcacagatacttttaaaaaatcattttgaactcaatacttaagggggagagtggaagagttatttatcctagcagaaatgtttgatttcccaagagtgacaggttttttttgtttgtttcaattactacttgctttctgcaatatttgcaaggtgcctttgactttcttcttcaaccaaaaatgtcagaacactttgaaaaatgaaatggataccaggcgcaatcctgcattatagagcaatggacttatctttcttccctgtctggttattttagaaagatattatctttcttttgtcatagactctgtacaaaaagacaccttagggggtcttttcttgccttccaaactggactgaacctgggccttccaagcggggaaagaaaaagagagagagaaagaatgtcagaacaagagctaatgattacatagctcttattattattctatactgttctaggtacattaatgtatttaaccttcacagcagccaatctggtagattctatcagacatccacttggcagatgaggaaactgagagggattcatgtttttttgttcaagtttatgcagctaacaagcggcagagccaggatattttgggggaataggaagggctgtcattgttctgggttagtttaggaaacacaaaggtagcttagatttcttctcctggtgtctctaaagctcaggattacatgaaaacatttctttggaaacaaccaagaagaaaaggggtgagtttgtctctgtgccaggcctgcaggtggctctctctagtggctgcttctcgcaccagtgactcctacattagcaatactgttgctccagtgagacctgctctgtctccaggttgcagaggggccgacagtaagaagaaggtttacacattgttctaaaggtgttgttgcactcagagccacagattcccaagtcccctgtggtgaagcaaatgggtttacatgaaaaaagtactttcgttcatacagctactcaggacgatgctagatggggagagcaaagacctgtagttcccccaagcccctttttggtccatgagttgatttgtgaactggaaggaatgatgagttcttaaggaagatgataagatttaaaagttaaagaatcactgctttgcatgcatctgaattaaacaacagtggagctggaattattatgatacattactaaagacatgcaatagaggaatttttaaattgtaaatatcatcatgtatttcattggaaaatgctgggtatgcccatttggcctgagatatgcttcagaatatgatcaatgctgtaactcattctccactggactcaagctctgtaaaagcaagggcctggttgggttttctgtgctatatcccccagtgtctggaacatgtcaaacacctggagggcgctcaataaatatttgttcaatcaatgaatggataaatgatttaaatattactcatccactaaaaaacccatagatctattatatcatttcctccttcacttccttctttattccccccctctttttatccctggcctatgtttctcccaccctccttccttaaccctaaccccaaccttaaccctaaccctaaccctaaccctaaccctaaccctaaccttaaccccaaccctaacccatccatgtctttatctatctgtttgacctggtaacaagtagtttttaatggcaagcttctggaggagtaatgactaagaagtgatatttaaaatccacacatggaaagatcaacatattcattgatatcaaaattataagttttaggttgttaaaaaataaaaagcaaacaaatataatcacttgagaaaaattctttgcagggaaaaatgacagagttgttatttataccttataagatggtataaatcagtaaataaaacactaagacttgaaggaaatgtaccaaaaaaccctcacattttctgtaatattattattttccaattttcctatattttcagtaatgtggctattttgcttttattatttgaaaagtacatttctagaagtgaagtacaggcttacccaattcaccctgtctgacgctcttccccagggggagcagctctggacctgaaagcctgtcctcccaaaccctatcgctggatccttgacatgacttggctgaatcttgtggagctgagtaaacttccacaatttgcagaaattatgaaccaggtaatacaataaagggctggttgaaagtgcagatctgcaaacccaaacatacctgggccgcttaaactggggcttcctggcagcaattccttcacccaaaaaagtcaacccaatagtttggatttgaggctctgtggctgtctgggagagatcttggacagatggacctcagggttaacctcttcatagttgcaggcaactatgttttcctcctgtgtggtgggcatgggtcatttttgtatgcctgttagagttgctgctggaatcagaaccagtagatggacccttttattgtagacgactcatgcttttacactttaacttctgcctatgattaagtgatttgtacagatttgaatgtgagtcaaattaagaggttgaggtccctctaaaaaattaattattttagtggtgaaatataatggtgaaaatggagaaataggtaccgatttgcttgttgtttttttcttatttgaaaatgtacattgattactgtggattaattgttgagtcaattgttactggaaaacaatcatgagactcagaataaagatagctgtttcttactgggttctgttggctgcaactgcctgtcactaatggagcctgcagtttcccagtgtcagatgccaataatcatctcttttctatggctgctagtgactgacagatggggccataggtagactgcaggttgtcagagcctcatgctgtaatcaccaatcccctgcccaacatactgtgttagctgcctctgtttgtttagtggcatttctgaaacattgtgtagactctacctattcagcctggttgggtctgagtcaattggataaactctctgggttccatctgtggatagacagtgagctttgttttgtagtacaaccacagatgagtcctccaagcccaaacaaatgcttggaaaaagaaagtgatcttgggctgggcccgatggttcacgcctgtaatcccagcactttaggaggctgagccaggtggatcacgaggtcaggagtttgagaccagcctgaccaacatagtgaaaccccgactctactaaaaatacaaaatattagctgggtgtggtggcgggtgcctgtaatcccagctactcgggaggctgaggcaggagaatcgcttaaaactgggaagcgggggttgcagtgagccgaaattgcaccgttgcactccagcctgggtgacagtgtgagactctgtcttgggggaaaaaaaaagaaaagaaagtgatctcggtctgatcagagattgggtaagggagatagtcaagaaccactggaaaaatcacttgaagcccacgccctctaatgatggtttatattgatacaaggatatttattattgtttgcctctgccaactaggttttaactactcatgaggtagaatatagtagctattactgcttactatgggataggtactttgcaacaataaccctgccacagaagggcagagttattgaccctaatttatagatgagataacagagattcaaagagttagttaagtacttgcccaagagcccattgccaataagtggcaaagctcatgctcttcccatgccatcatgagttatttctctcccactcctcttacaccaccgattgggccagaagtggggtgaggggcagttctcaggaaggttgcaaaagttcagcggagacctgcagtcaggtggccatcagtctggcctgcctgtgggaaggaagggaggaagcagaagatcaatctcccagctgagtggatgtcaggaactgaaatataatagagcagctgccctgaccttggcatcccaggccaagggtcaggaaaaggaatgagaaatggagatggacatccagaggctggaagtcatcttatcacctatcatggctgcagctcactttgaagctctactgtggtcaagtcaaaattagcaggtggaaagtcagtaggtgaagaatagtcatccgctttcttcctgtgcctcagctgcagatgtggaggaggcctgtgggggacactgtgggcaggggcaaggtagggctcgcaacacccaggccctggcatgcaggcatcttctttgagggcagccaaccagagagagctgctgcaatcttcaggagatagatggcagttgtgaaacatttcagaaatcctcttcttttttttttttcttgagatggagtctcactctgttgcccaggctggagtgcaatggcgcaatctcagctcactgcaacctccagctcctgggttgaaacaattcttctgtctcagtctcctgagtagctaggattacagatacacgctgccacgcccagctaattttttgtattttagtagggacggagttccaccgtgttgcccaagctggtcgcgaactcctgagctcaggcactctgcccgcctctgcctcccaaagtgctgggattacaggcatgagccaccatgccaggccagaaatccccttcatcttttagtgccccagggacaaagtgggagcaactgagttgcagaataactgttctgttattaatttatactctatctgtatcctgtatgatgaattgttcacaccacagatatgagactttggacagttatttaacctctctatgcctcaataaaaagtaggggtcatagaggaaaaagtgtaatcctcaggtctggcatagggcatctgctatgtgagcctttgctatttgctattactgcttactgtggcttttttattttaattttaatttttttatttttttgtttttgagggggagtttcgctcttgttgcccagagctggagtgcaatggcacaatcttggctcacagcaacatctgcctcctcggttcaagtgattctcctgcctcagcctcccgagtagctgggattacaggcatgtgccaccacgcccggctaatttttttatttttagtagagacagggtttctccatgttggtcaggctggtctcgaactcccgacctcaggtgatctgcccgcctcggcctcccaaagtgcttacaggcatgagccactgtgtactgtggcttttttaaaagcacacttacaaacaccgtctaaataacccagcctgattgttgctgaagagcagggataggctcaataatctatagttttcgtacttagtcttgatggaacttgggcgtcagtgagcaccttttaatgcctctgaaaacctgaagtccttttcatgcttctgaacaatatttaagaccagctgttggagagactcctttcgttattaggctttaggtctcaaggtgggggatcactaggaaaataaaagttttgattttgtcatctatcattatttttaagtagagatcaacatttagaggttgggttatcagaatggtctgtcagtggttctcaactgagggtaatctacccacccccaggggcatttggctgtgtctggagacatttttgattgttaggacccgggtggagggtgctactggcatctagtggatagggacgctgctaaacatcctacaatgcccaggacagcaccccccacaaaaaaaattcagatccaaatgacagtaataccaagcttgagaaaccttgatttgtgtttcttctggcccaatcatttggtgcagttgacacacgatcctaattgtagcgaataatgtagaaaaataatggaagaactggaagggaatagtaatatccaagttattcaagtcattgatcctgaagaaaggtttaaactgtgctgttatgcttgaaaaattatctgcctgtaaagaatgaccctctcaggtgattcagaatcctttgtaatatattccacttacatatagttctgtggcttgctaattggcttgcttcttttagatatctcgtaatgagaaggggtggaaaagctggtttgataaagatgctccagaggaggaaattatccctgatggatataatgattcactagatacctgccataaacttttacttatcaggtgagaacaggcattatcagacctagaagcatcactcataatattgctaaattacagattttatctcagtgagtttacttcactatatcactgtcattgaaagtaacggcaaaaaccgcaattacttttgtgccaacctaatattataagaaatgtatgtacttccaaattatggttttggatagcagttcttcagttccttgacaagcaaaataaaatggtgatggtgacagggaatgatgtattttgacaacgtattaatgatagtgcttttagcaaaaagcgtgaaaaatatgcttttaatattcactttgttcatgatttaccattgagtgtaaatcagttattgttgaatttatttctttaaaaaaacagacctcacaaagttacaagacaattagcttataagctaaagttaaattgcattcgagaaaaaaacccaataatattgcactgaatttgaaatatataaatgctacttttggctataaaatggaaacaaaagtttgaaattgatgttaaagaagaaaatcgccctctcttttcactgtttacattttctcagtatccagtaactcagagaccttccacattgaaaaaaatcagtgtgtgtgtctgcgtgtgtgtgtgtgtgtgtgtgtgtgtgtgtgtttgtatggtggatgggtaaggcagaggagtaaagcaggggagatgagacccccacatgaaaaatgagaggtagagttattttgaagcaattttttcttttctaatgttatacacctaagtttccacttcttagaaaaagctgtttcttagatattgtcaaccttcaagagtgaccagaacaacgctaatgttgacctcatagtccgcagagtatgaaaaggcttttttttttttttgagacagagtctcactctgtcacccaggctggagtgcagtggcatgatcttggctcactgtaagctccgcctcccgggttcactccagtctcctgcctcagcctcctgagtagctgggactacaggcgcctgccaccacgcccggctaattttttgtatttttagtagagatggggtttcactgtgttagtcaggatggtctcgatctcctaacctcgtgatctgccagccttggccttccaaagtgctgggattacaagcatgagccaccgtgcctggccagggctacttagttttattggaacaaatgtgtcttattttttaatccgtcacttaaaaattagatctatgtcaaatagtgcaatctagtagcaccaaaaaaaaaaaagtctgtggggcttgtctgtgctttaccatatcaatattaaatgacacttatccaatgtgtctgtgtgtgtagaacttgctatggtgtgcactacacaaatggtatgccacaaatgcttgctgacccacttactttgggcatctttggcatattggttcctcctctgaaaaggctgtggagcttcagagtgtgtggcaggtcagcccctaccatgtgttggagctggtagaggacactgtgttgttatgggctctgccctacttcttgccaatgcctggctggtaccaaaaccacacgattaagtttgtgctcatctgtgataggaaaccttgccattcctcttacttagatgtggaaaagtaggaattaacttgttgcccttttgctaattaaatgtatgtttttacttactcagataggataaaaattgaacacgtttagtttatttcgcctaacttgtattcatttttaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactgggtaagactagcaatctacaaaatgtagcaacacttccatatttttttgccccaaattttgcctttcgtaattttataactgattcttagaaatagatgtaaaactgaattcgaaaaatattaaacttattcctctttcatcctttcatacctcctaaagtgagggtatgatataggtatctttgtttagagaagaacatgctcatctagcatatagtgttttttttttgattggttgtgttttaagttctaaggagatagctgtattgcatggatagctgactaacaagaatgaacacacaatagccaaagtttatgttattgccatgtctatataaaattacagcaaagtttattttgtcacaaattaaaaaactataaccattattgtaatgcatagtagttagggattaattatttcattgctttcacttaataaccattcagtacaggcagtgtgctagatctggggagcacagagatgaatacaacacagctgggaaagacagacacgtaaacatgtaattgaaggcaatgtgacaactgcagtaaatgtttcatagaagtggctgatcacaggattcagagctactcggattgcctggggtataggggaaaacatcacattgatgatatttgagtaggaaattaaaaaatagataaaatttaccaggtggggtggtgggagatagaaagttactccagggagaggagatgggaaagaagttataaacacagaagtgtttataagtgtgactgagtcagtaggattaaaggacagggatgcagagcacatcttgacaggactgagccatcctgtaagaaggactttcttgacaggactgagccatcctgtaagaaggactgtttatcccttgcttcattcatactctgaaaatcggaatgctgttgacattggcatttgcaatcttctagggtcaggtatctgtaactataccttgtagggttaatccaatcatgtcttttgagtattacagtgattgattatgaatcactaaatctatcctgtgaagtaaaattacattaaatttattacatagtcgacataagcatgatataaaatcaattcagtcatgtccacgtactagccacatgtccctctgcataaaaccaagctacggtagcatggtccatgttcatgttctcttttctcatcttgacttcactctatttgttgtcaccacactgttctatattctcagtggatcagtgttcaaatggccacggtcttctgtctgaacactgataccaatgcaaagagctcccaggttctattggcaactgctcatggttaagtctcattcgctatcttcaaagtaggcagttttgctctagtatttactgcagcacaccagccgtctgagtttatctcagagtgatgcctctcgagtagccttatagtttgcaaatctctctcaaatctgttgctctatgagtgtttatccagctgcctctaagcctcacttctctctgcacacaggtatattttttctctcttaacacttaccattcttctccacatggcagaacatgtggcttctagtggctcatgggcttcactgcttacgtgctcagaatgttcagcaccctcagggaaactcctcttattgtcatggttccaagttccaatatccagggaagtaactcattgtctttgctttggtcatgcactcctttctgggccaatcaatgaactgtcgctctggagataggttcctagtagaaaccttatgtacagagctggaatgggggacatttcttagaagatacaacgcctagaagaaggagtattcaactagagttaccatttcaaatgttgtaatttgagaacataattaaaaaattcaaggtctcctttgggagaaattataactgacattaaatgaatgcagaagggcagacttgtgttatatcctttagtgttatcatactgctttgcttggcaatttggtggtttccgtttcttggtcctaccttactttttccaacaacaatccaggcttctattgattactttattagggtactggaacaacatagatttggctttaacactgaaggatcaaatgaattttataaacaattctactgccaaatcatttgagcagtattaggaagtctcaggctgcttgctgctttgggttgaaagtcccaaagatagctgttaaaatggaactattacacataccgaacaacatgttaatgtagtctcagctattaatattttatttgaaaatctggataataaataatcatagaatgcttcaggtgaatgtgactggaaatcttgaaatccaattacttttttttttttttttaacagttgggggaaactatggtctggagataaggccccagacctagtccgtggcagatctggttcagaacttatctcaggaaccccacttcagtgatctcattggtctttctttttcattccttctcattgttttcattgaatgaattaaccagctacccgaaaataacatacggatgggacagaatcaataagtttttgtagaaaaagaggagaagggaaactttggttatagatattgtcttgtactggtcaagatctgtagtgagaaatttggagcagataaactctgcacagagtactgggtacatgggcaaagtggagaaagcagatgggtttagcacgagagcctttctaggagcctgactactggaggagggaggtctcagaggaaggatgggcttaaaaagaacacctaaaaacaaacgaaagagaacaaatacataaaaccccacaaccacacaaaagtagtagtgggaaaactgatataacaatatgtacagatgaaacattttaacattttaaataataagagaatggctcataattatagtaataaattacaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaataaattacagcatctcattaaaattggcaaatttatagaaacatatgaatttagaaaatttcctcagaaaaggtagaaaaccctgaataaaccaataatcaaggggagaaaaagtagaagttttaaaattattacatcagcaaaggctctaggcttggataattttctgataagtcctttaaaactttcaaggactctcatatgctatattctgttccaaaagatggaaaaagagaatacattttcctttttcttttgagacaggctcccactctgtcacccaggctggagtgcagtggtgcaatcatggctcactaaagccttgacctcccaggctcaagtgatcctcctacctcagccttccaagtagctgggactacaggcacacaccactaatcctagccacattttgttttctgtttttttgtagagatgaggtctcattatgtttcccaggctggtcttgaactcctgagctcaagtgatcctccctccttggcctcctaaagtgttgggattacaggcatgaaccacttcatctggcccattttcctctttatttgcattattctgaaacagtaaaccgacccagatagtaactgcataaaagaaagaaaactggctgggcatggtggctcatgcctgtaatcccagcactttgggaggccgaggtgggtggatcatctgaggtcaggagtttgaggtcagcctgaccaacatggcaaaaccccatgtctactaaaaatacaaaaattagctgggtgtggtggcgggcacttgtaatcccagttactcgggaggctgagacatgagaatagcttgaacctgggaggtggaggttgcagtgagccgagattgtgccattgcactccagcctgggtgacagagtgagactccatctcaaaaataaataaataaataaatgtaaggatcttaactaaatcacaagcaagatgaatttatagtgatgtcagcaagatgtctcatatccctccacatatccctccctcatatcccaccaccacatcaggaattctgtatccatctacagacaaagtctctctgcaggaacctcgggatataggtagaaggttgtgaaaccctattaaaatccaagacctaggagggttgttttgagagcacaaactgacacccaaatggcagatctgccaattgtgcttccaggttcaagcctagaaatggccctgctccccaaggagtttggctatagccctttttggccttgagcctgcaactaaaaccaactgccaagggttgtaggtggaatcaggcacactagtgtctcagtgcagaggctcgtctgcctgccaacatcgatcttggcagtgaacttgaaagttgccctgtggcttgtctccaaccaccctcagctgaggtcccaactcagagctaactgtgcaagagcccagaaggaggcttgctcatatctagcagactgggagtctgagcctccatgaagggctcatcaacctctgtaccccagcagataccaagggtgcccactgtcagctctggtccctcctgctgcagtcagggaactatcctacctgtgcagggatctactgggagatacatgcccttctgagccaatgagatgagctcttcagccatcatcctccagcagatcccaaaagggcccagtctcagctccagttcctcctgctgtagtcaggaaactaatttgtgcagagacctgctgggagacacactcccatctgaaccaatgaggtgggcttgccagctctgccccacgtcaagtcctgaagggctccggtctcagccttggctcctcctgctgcatttggaaactatcccatctgtgcagagacttgctggaagacaaacccatctgggccactgggacaggcttctgggcttgtgtccctgaccaactgtctcacacagttcaggcacattgtccctaaaaaacaaaacaaaacaaaacaacaacaacaaaaaacttgttataaatatcagattttttggtaagcctcatggtaaccacaaagcaaaaacctatattagatacactaaaactaaaaagtaaggaatcaaaacatactactagagaaaatcacttaaccccgaccaagggaagactgcaagagaggaagaatggaagaagaaaggatctacaaatcaactagaaaacaagtaacaaaatggcagtagttagtccttacctaccaacaattaccttgaatgtaaatggattaaaatctacgattaagagacacagagtggcttaatggattttttaaaaaagacccagctatatgctgcctacaagagactcattttacctggaaggatacacacagactgaaaatgaaggatggaaaagatattctatgcaaatgggcaccataaaaagaacaggagtaactatgcttatatcagataaaatagactataaaccaaatactgtaaaagaaggccattatacagtgattaagggtaaatacaacaagagtgcatgtgtgcatacacacaatgcacccaacatcagagcacctaagtgtataaagatatataaaaattaatatatatattaattataataaaagatataattaataaaaatgtaaatattaatagacctaaaaggatagactgcaatacaataatagtagggggcttcaacatcccattttcagcaatggacaaatcacccagatagaaaatcaataaagaaacattagagttaaaccatactctaaatcaaatggacctaacagacatttacagaacattccatccaatagttgtaaaatatacatgtttttaaacagcacatggaacattcttgaggatagatcatatatgaagccacaaaacaagtcttaacaaattaaaaaaaactggaaacctaccaagtatctttcttgaccacaatggaatgaaactagaaatcagtaacagtaggaactttggaaactgtacaaatacaaggaaagtaaacaatatgttcctgaataaccaatgagtcaaagaagaaatttaaaaggagatttaacaatttcttgaggcaagtgaaaatggaaatacaacacaccataatctatggaatacaacaaaagcacctctaagaagtttagagcaataaatgcctacaccaaaaaaaaaaaaaaaaaaaaacaagatcacaaataacctaatgttgcatctcaaggaactagaaagacaagaacaaattcaactcaaaatttgaaggaaagaaataataaagatcagagtagaaataaatacaatagtgttttgttttgtttttttttatgaagtcttgttgtctcccaggctggaatgcagtggtgagatctcggctcactgcaagctccgcctcctgggttcacgccattctcctgcctcagcctcccgagtagctgggactgcaggtgccagccaccacgcctgactaattttttttttgtatttttagtagagacggggtttcaccatgttagccaggatgatatagatctcctgaccttgtgatccacccacctcagcctcccaaagtgctgggattacaggcgtgagccaccgcgcccggccgatagaaatttttaaaagtacaaatgatcaacaaaatgaagtgatatatttttgaaatgataaaatcagtacacctttggccagactaagaaaaaaagagatatgactggaaaaaaaaaaaaacagagatgaaaaaggagacatcataactgataacacagaaatacaaaagatcattaaagattgttatgaaaaattacatgccaacaaattggaaaacttagaataaatggataaatttctggacaaatataacctaccaagactgaattatgaagaattagaaaacctgaatagccaataatgagtaatgagattgaatcagtgattaagtctcccatcaaaaaaaaaaaaaaaaaaaaaaagcccaggaactgatggcttcattatggaattctatcaaacatttaaggaagaaataatacctattcttctcaaattattccaaacaattgaagtggctaggaattttttcagactcattctatgagactagcattactctaatatcaaaacacaaggacacaacaaagaaagaaaactacatacaggctgatatccctgatgaacatagatgtaaaatcctcaacaaaatactagcaaaccaaatcaaacagtgctccgaaagatcattcacattgattaaatggaatgcagggatgtttcaaggtacataaatcagtaagtgtgatatatgacagtaatagaatgaaggacaaaaaccatatgatcatctcaatagacacagagaaagaactggataagattcaacattcctttgtgataaaaaccctaaactaattaggtatgaaggaatgtacctcaacacaataaaggtcatgtatgacaaacccatagctaacatcatactaaactgggaaaagttgaaagcttttcctctaaaattaggaacacaacaatgatgcctactttcaccacttctgttcaacatagtacaggaaggtctagctagagcagttaggcaagagaaagaaataaaaagcatccaagtttgaaaagaggaagtcaaattgtccctatttgtagatgacatgtatacagaaaaccctacagatgccaccaaagaattgttaggactgaaaaacaagttcagtaaagttgtaggatacaaagtcaatctacacgaattagggtttctatatgccgacattgaactatctgaaaaagaaatttaaaaagcaatcccatttaaaatagctacaaaaaataaaatacctaggagtaaatttaattaaggaggtgaaaaatctctacaatgaaaattattaaacattgatggaagaagttgaaaaggacacagataaatggaaagacatcttgtgttaatgacttgaaagaattaatattgttaaaatgtccatagctacccaaagcaatctgcagattcacatgcaatctttatcaaaataccaatgtcattgtttatggatagaaaaaaattctaaaatgtatatgaaaccacacaaaatcccaaatagctaaagcagtcttgagcattaaaaaaaaaagtttaaggcaccaaactacctgacttcaaaatgtactacaaagcaatagtaaccaaaacaggatggtagtggcataaaaccagacactaggccaatggagcagaatagagaaaccagagataaacccatgcatttacaaccaacttatcttcaacaaagttgcctagaacatgtaatgaggaaagatcaatcttttcaataaatggtgttgggaaaactgggtaattatatgcagaataatgaaactagaccctatctctcaccatacacaaaaatcaaatcaaagtggattaaagactgaaatgtaagacctgaaattgtgaaactactatgagaaaacactgaaggaaatgctccagaacattagtctgggcaaatatttttttgtgtaagacctcaaaaacaggcaaccaaagcaaaaatagacaattgggattacctcaagctacaaagcttttgcatggcaaaggaaacaatcaacatagtaaagacataacctacaggacaggagaaaatatttgcaaactatgcatctgacaaggtgttaatatgcagaatatataagtaacacaaacaactcaatagcaaaaaaaaaaaaaataataatctgattattaaagtggacaagagatccaaacagacatttctcaaaataagacatataaattgcaaaaagatatatgaaaaaggctgaacataattggtcatcagagaaatacaaatcaaaactacaatgagatatcatctcaccccaatttacatgccttgtatgaaaaaaaccagtaacacatgctggcaatgatgtggagaaagaagaaccttcatacagtattggtagaaatgtaaattagtactttggagaatagtatgcaggttccccaaaaaactaaaaatagaactgctctatgattcagcagtgctgctactaaatacatatccaaaagaggtgcaatcattaagaaaactttgaaaggatttttttcattttaaatataaaatttaaaaaaacgaagtgaaatcagtatattgtagaggtatctatctgtactcccgtgtttactgcagcactattcataaaagccaagatatagaatcaccctaagtacccatcaccaaatgaatggattaaaacatgcggtacatatacacaatggaatactattcagccataaaaaaagaatggcattatgtcatttgtgacaacatggatgaatacggtgggcattatcctaaatgaaataagctaggcatagaatgacaaataccacatgatctcactcttgagaatctaacaaatttgatctcttagaattagagtagaatagtggctaccagaaactgagggagggtagaggggaggaagaatgatttctagtgttctagtgcacagtaaagtgaatagttaaccataatttattttttaaaaaaatatatagtccaaaatatctagaagagagaatattgaatgctctgaacacagggaaatgaaaattatgttgtgacggatatctaaattacctgatttgatcattacacaatgtatacatgtattgaaacatcacactgtacccataaatatttacaatcattatgtgtcaatgaaaaacaaaatatgactttgaaaaggaagaattcaatagaacatcaagaaataacttgcaaataataacgtgccttcaccaagttggaacacatgggcaaatataagaaagatgcaggattaagaaatctcatcacaacaataagagaaaaacttctccttaagctatcatactgttatcttgatgggtgctataaaagccattttataaaaattcaacacttatatttgacttttgaaaagtaggaacagaaggatattttatttatatgataatgattatgaaccccaaacatcgtgatacttattggcgaacaactagagacatatccattaaagtcagatacagatgtctgctattgccactgttatttagcattgtgttgtagaagatatggctaatgtattgaaagaatcataaataaaagatgtaactaccggaaaggagggacaaaatcaacattattcttagacaatataattgtctaacaaaaaatacaaatgaatcaacggaaaaactattagacttaatagtctaatagttcagtgaggtgactgtttacaagataaatatataaaaaatgatgctttcttgtaaaataagatgtaaaactcctcttcattatagcaataaaaataaaactgagaaataatttttaaaatactcatttaaagaaaactataaaaccttcttagagacataaaagtagttagaataaatggagaggtaagccacattcccagtatagagattcaatgttgtaaagatgtcaatatttcctaaattaatctataaattgaagccaagtctaattgaaactcaagcatcattgtttttctagttggatagtagagggatattagagcttctagaattgcaaatggacaagaatagctaagaaagcttgaaatggaaaaaaataagaataatggggaaccagcaccaccagatttttaaaacattatcaaatgccaataattttatcatttacattacaaacattgataaatatggagcaaaatgaaagggccaaaattagactcttgtatgtacaatagcttaatatgtgataagatttgcatttccaatcagtggaggaaaagtgggttagacagtaaacaatgttgagatagcaggttaactttagtaaacataaaagttttacctcacattaaactctaaatgttaggtcgattaaggcattaagtgctttaaaataaactataaaacaagaaaaagaatatattcaattagttatatattgttgagtggccaagattttcttaatcataatacctgagtctaaaaccagagggacaagatagataatatgactggaagaattttaaaacatctgtatgttataaaaaggaataaaataatggcatttgcagcaacctgggtggaattggagaccattattctaagtgaagtaaatcaggaatggaaaaccaaacatatgttctcactcataagtgggaactaagctatgaggacacaaaggcctaagaatgatacaatggactttggggactggggagaaaaggtttgagggtgtgagggataaaatactacttattgggtagagggtacactgcttgggtgatgggtacaccaaaatctcagaaatcaccactaaaaatcttattcatgcaaccaaacacaacctgttccccccaaaacctgttgaaataaaaaaaatctgtatgtcaaaagcaccataaataaaataaaagcacaaacaaagaaacaaggataggtgtgtaggctggggactatagcattccacttcagtgggagacactgggagtcctttttctttttttttttttttttttttttttttgtaaaggacatatcatatttattcatacacatgctggaattattggtgcagacatttaaatacattttctttgagaaagtcctttttttttttttttttttttgatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaattttttttatttttagtagagacggggtttctccgtgttggtcaggctggtcttgaactcctgaactcaggtgatctgcccgccttggcctgccacagtgctgggattacagtcgtgagccaccacagctggcctgggaaagtccattctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccgggggggctgacccccccacctccctcccggacggggcggctggccgggcagaggggctcctcacttcccagtaggggcggccgggcagaggcgcccctcactgggagtcctttttcatatgttgtgaattttaaaaaaatgtttgaatgctgtatccaaactattctccatgtatgaattcctcctaagaacatattgagagacatacatccagatttatatacaagggtgtttaatctagtgctatttataatactgaaaaatcaaaaatgtcttaaatatataaaaaggtattgattgaatgaacaagaatgcatatgacatgatggaacaccgtgctgccattaaaaactgttttctgataatatttgatgacagtaaaatattcacaacatactgttgaaacgtagagatataaaataatgtatagtccgggcatggtggctcacacctgtaatcccagcactttaggaggctgaggcagaaggatcatttgaggtcaggagtttgagatcagtctggccaaacatagcaaaaccctgtctctattaaaaatacaaaaaattagtcgggcgtggtggcacatgcctgtaatcctagctactcaggaagctgaggcatgagaatctcttgaaccctggaggtggaggttgcagtgagtcgagattgtgccactgcactccagcctgggcgacaaagcaagattctgtctcaaaaaataaaataaaataaaataaaataaaataaaataaaataaaataaaataatgtataatacatatatgcatatatacattttaatatagataggtctacaaacccttggagtcagatatgtttcagaaatcagaatgttctggtttttagaaggtgatattccatatattatataatacactgcagctaagatataaatattcaggaagatagggataaataaagactataaatagcctcacatctgtttaggtcagcttttgcctccaaaatgatttacgattttcagagctttctgaattttgaaatgaaggtaagggattgtggattatgcatattaaaaggattagaataaagatctctagggaggaatattggtgatttttatttccttctttatatgctcctgtatttttcaaaccttttaatgtgaacatatattatttaattagaagtaaatccaaaaaaataagaaaaagtggaagagacacaagcctaattttggaaaggaatataaaggcagtcaaaattttactaaagtctttcaaatacaaacaattaaaacaaaacctaaaccaccaaagtgtaattatactgtatcacctgcagcaacacttcctccaatgtttcctgcatacacgcttctcttgagagtcccccttatgatatcttggcagtctttgccccccacctgtaaaaactcagcctatgctgtttcttgtctcattggcccctttccttccttgcgtgggaatgtttctcactttttcaatgccaatcaatctttttcttccccaggccactcagaaaagatataaaatatttatcaccttatattaaatgaagaaagattacaaattaataacaaccttccacattaagaaacttagaaaagaagagcaaactaaactcaaagcagtcaaaagaaaggaaataataaatatgcgagcaaaaaaagccagataatagaaaaacaacaaagaatcaagaagtcaaaggtatcttttttgaaagatcaataaaactgacaaatatttagctaaactaaccaagaataaagaagagaaagtgaagattactaaaatcagcaatgaaagaggggcgtaactacttacccaaatttaaaaactcctaagggaatactgtgaacaattatgccaacaaattagataacctagatgaaatggaaaaaatattagaaataactattgaaactgactcaagaagatgtagaaaatctgaatagagccataagaagtatggagatttattcattaatcaaaaaattcacacaaaaggaatcttagtcccagatggcttcattggtgaattctagcaaaattttaaagaatagcactagtttttctcagcttttctaaaaaataaaagaggagggaacacttttcaacccattctgagaccagtattaccatgataccaaatgcagacaaagacatcacacatagaaaaaactacagaccattatcccttaggcacatagaaacaaaattctcaacaaagtattatcaaaccaaatgcagcaccatataaaaacattatacactatgaccaagtgaattaatcccaggagtatgagattggttaaacatatgaatatcaatcaatgtaatataccatattaatagaataatagacaacaaccacatgatcatctcaacagatgctgtcttagtctgtttgagctgctgcaacaaactaccatagactgggtagcttataagcatagaaatttatttctgatagttctggaggctgagagtccaagatcaagaccttggccgattcagtagctgataaaggccggtttcctatttcatagatgacttctcattgtgtcttcacatggtggaaggagggcatcttttataaggtcactaatcccactcttaataccttgtcacttcctagtaccatcactttggggtttaggtttcaacatatgaattttaggggtacataaacatttagtccattgcagatgcagaaaagcattgaaaacattgataaatatggactagcaaactaggaataggaggaaattttctcaacctgataaaaggcacctacaaaaaactcacggttaatgtcacacttaatggtaaaagactgaatgccttctcccaaagatcaggagaaagacaaggatgtctactcttacgacttttattcagcattgtattggtggttctagatagggcaatcagaccaggcaaagaaaaaaaaaaaccatctacattggaaaggaagaagtaaaactgcctctatgattgtgacatgaatttgtgcataaaaaattataagttgtttaccaaaaaacaattagagctaatagatgagttcagcaagattgtaggatacaagatcaatatttaaaagctattgtatttctatgcactagcaagaacaattcaaaaatgaaatcataaacacattacaattcctttacaatattattaaaaataaaatacttaggaataaattcaataaaagaagtggaagatttgtacattgaaaactaaaaaacatcattaaaaaattaaatacctaaataaatggaaagacatccagtgttcatggatcaggagactttggtaaaatgccagtactcatctaatagatcaagagatttaactcaatccctataaaaatcccaacagccttttttaaaaatagaaattgacaagacgatcctaaaatttgtatggaaattcatgggacccaagataactaaaacaatcttgaaaagaaagaacaaagctataggacttatgcttcccaaaatcaagacttactacaaagctacagtaattaaaacagtgtgatatgggcataaagatatatatcattgcaaagaatatatatctcaatgcagaattgagagtccagaaataaacccagccctcacatattatggtgagttggttctcaacaagggttctaagaccatgcaatgttggaaaagacaatcttcttaacaaatggtgctggaagaactgatatgcatttgcaaaggaatgaagtgtggtttttacatcacaacatacacaaaaattaactcaaaatcaatcagagacttaactgtaaacactaaaaccataacatacttagtaaaaaaaataagagtaaatctttgaggccgtggattaggcaatggttttctagatatgaaaccaaaaacataagcaataaaaggaaatattgataaattggacttcatcaaaatgtaaaactttgtgcttcagagggcaccatcagaggacaacctataaaataggagaaaatatttgcaaatcatacatctgttaagggtctagtatccagaatatataaagacctcttacaactcaacaatagtcaaattacccaatttaaaaatgggcaaaggatttgaatggatatttctacaaggaagatgtacaaatggccaataaacacatgaaaagatactcagctttgttagttattagggaaatgcaaattaaaatcacaatgagatatttcttcattcccactaagatagctataatcaaagacagggacaacagcaagtattggtaaggatgtggaaaaattagaacattcatacattgccaacggaaatgtaaaatggtgcagctgctttggaaaacagtctagcagtttctcagaaagttaaagatagggttaccacatgactcagcaaacttgcctctaagtatatacccccaaaaaactgaaaatatacatccacccaaaaacttgtatgtgaatgctcatagcagcattactcatactagctaaaaagtgaaaacaacccaaatgtctggggctgatgaacagataaagaaatgtggtatatccatgctgtgaactcttagtcagccataaaaaggaatgaagtaatacatgctacaatatggatgaaccttgaaagcatgctaactgaaggaagacagacacaaaagaccatatattgcataattccatttaatgaaatgtctggaatagagacaaagtagattggtgattgctggggtgggaagggggaatgggaagtgactgctaatgggtatggggtttcttttggggttgatgaaaatgttctggaattagatgatttgatagtagtgatagttatgcaactctaaaaacatattttaaaatattaaagtatacactttataatgaagtatatatttcataatttatatggaaattatacctcaattataaaggttcagaaatatatatttattgagcatctactgagtgccaggcactatctaggtgctgggttggccaccatgtctaagtccctagctgatattctagactggggataaaacagacagttattgataaacaaggtagtacataatatcctaagaagaaaagtataaaatatgctaagaagcaggggaagggacagagtgatgggagaggtgtgccgttttagatagaacaaggtccgtcaggaaagtcttgctgacagggtgagaaaaacctgagatgtgaagggagtgagtctggaactctgaaggagggaacaccaatgaggctggggtgggcctggggaggaggctgttatggatggaggaaagtgaatggataggggggtggtgagataagaaaaggtgtgtgtgggggggagtggggggtggtgtgtggcagcagtagcagggactgattgtgtagggccttatagtctgtaaataagaactttggtttggattttggattttgccttggatgcaatgggaagccattggatggttctgagcagaggatgaacataatctgatttagggcttgagagacccctctggctgctgtaggaagaatagctagtagaggacaagggtggaagtgaggttgtcaccagttaggaggccattccaagaatctaggcaagaggtggcggtcacttacaccaggaaataaaagcagagttgggaaatggccagattctggatatgaagggatgcctctaaatcgcctcttgacccaatacctggatcaagcaacaactgtcccagggccacctgaacgaaaactagaccttccttgtagaaggtgtgtttcagaggagttggaagaagacagagaggctgtggctcacactcatgtgttaatactttttgagcctatcactttccctcattgatctattgaacatttgtgtgttcttccgaaataagtggggctcgatatctatccacgatccagaggctcctcccattcaagtcacgcctctcctttcttctgcttttataggctgggtgggattcttttcaggtgccagattccccttaggagctggaaagattcatgtgggctttggtgggaaaatccacctttgcttgttaatacttggcccatttcaattcctgattctccaagcagtgagtgctcttccatcctccttcaggctctcattgcaaagtgtctccctgtgaccctgagcccacgaataatccctaatcttgcaccctgcagaccctctcagaatatctggccattaaccacaggatgccatttaaatggtgtgtcctgacagtgtctctggtttctgacatacttccctccccaccccatgaagtctccagcttcttatagtctctaccagcagttaccataaacacacactggttcacaatgtctccattgattgcttttccttgtacagggattatgcctctagaactcaagaaaatttgggtccacaagggcttgcttaagagttaatttccaattgcagttgtgcaaacatgattctcagacttcttcattttagctaattcatgtgggaggtcacaagcatggttctctgcctgggacatctggtcctaaatggtgtattatctctggaattatgacatttctcatcgtggagtgttttcatgtttagttccaaggtggtgatttaatctgaggagcagctgagaactaggtcttagacagttgcccctgaatgtacccgtcacagggctgaactgtctcaaatttcatctcagaaaaatgatcaaacatacaaagaaaaccaaaacaagcagacagaaaacactgtgagcctgatatctaaaaggaataaacagaaaattaaatctttacagaagcgtctgctaaaacgccgaaaaggattctaaccaaaacttacagcaaaactaaaaaatcctttttccctacaaatacctgtgatagcattgtagttgcctctcccaccattgatcttgttcctcattgtctccaaagaatctcaaactctctaaaagcccaccatacgtgcctttttctctcccttcctgacccccaacccacgcttttccgggtggtgcctccaggtctctgctccatgcatttctctgatccacacaaccaaaggccaggcctgtttgaacagcaaagatttttttttttttttagaaacaatagaaggaggctataatcattcagaaattaatttttcattctaatcctgctgtaagagttgtgtttcatcatagtgaactttctcctatgttacagaatgtagaactatctcaatggggcaaggacaagaagtacatgctcgaaagctgattcagatgtcaatgcagcaggtatgtgacaagagactgctcctgctgcaacattattgctagaaaccccacaatcatggatgttaccacattcttctcgtgatgctcaatcctggtttttccatttttgtttatcattacctgtgaattttaaacctcagtctagtttcctcctgatattcgcatggaaagcttattccattttctatagtatatgctccattttaccttcaccaattttttgttcgttttatgatttgggagacacaccttctgatttctaagaatgcatctctagcagtcttggaatttcatgatcaatatgaataggtagtacttaaggagtgacagattgagacagttaaatttccattttcagttaaaggcagactttcatttttcattaacggatcatttcaggcaaagaaggaatatttaaggatgctatgtttaaatactgataatggttttcactaataattgcaagctgaatggagtgttgagagagatttcccatcacacctaataaatacacaggacattaattttctagaaatgctctgtagatagccatttcagctgtaataagaaattataccatttataaaaataaaataagatattggtttatttttaagcttttgatctcagaatgtctgtacaaactttggtgcagcttttccctgggaattaatgactagagagggttaatgggctaaaactctgttgggtcatcaacttttccagctagtcattaattctcaaatgccctaagcctcaatctttatcacttaattaaattcaataatttatttaatttatacatgtatatctcaaagcaattatacataattatttttactcggatcaaatgtttcactctattgagtgatttgacagtttaactttgggccttaaataatttctttagtttctgtgggtgcaaaactttaatttaaatacggtgttcatgttaactgtctttggaatactagcctttataacttccatggtctgtttgtcaaagtggggtaagtattgattatatggcataatcagaaaagaaaaccagacatgagcaggtgcagccatgttgccgccttgagggacaccatgtttagcataaagctggcattgtggaacacagagtggggaaccagaaagtaagtgggtccatgatgacacaaactaatcctgaatgctgttttcctctgaaaccccagttgtatagacggcacatcccctttactagttaagccggtgtgagttgtattttcgcttacagttgagacatggtatatatgccttgccatatatttatcatgctcactattttgtagttttatgtagttcaagatagctgattcctgtataaaggtattaaaatgtctagtaaagaaactatgttctcacagggcagtgatggttttgtgacatattgtttaaggtagtttgtttaatcaagtatttatttagaaagtgcttaataagttatgtggtttcaggaaagtgtggagagtgatgataaagaataaagcttagcattatggtagtaaatgtcaccaaacgtattgtctccagctttcatgagatcatgtgtatctttctttgtaactatgaataactgtgaaccagtcttctgggttttgggggtgagtcagttctgatttaccttaggcaggacaacttgttactgattccaaaatacccgttcccaccattagatggtgcacacactgtacttacacaagtctgccttcaagttttaatttctgttcctttctgaaccaggggtggcagaatacaatcattttgaacccacttgattctaagtaattagcttgtaccaattacttgtaccatagcaggagaaatgattgtattgacatataatttttaaaaatgtgttcaaaacagagtattcacatggtttttaaaaaaagtgcacattttgttttattaaaatcatagcaaaaaggttacaagaaataaatatgaacttatttttggatacagggtggttgggtattactacaaaattgccaccttggcctggaattcatggaagaattactagagacgctaattaccactgaagccagtgatgattctttccgagtatggataactacggagccccatgatcgatttccaattacattgcttcaggtttgttactaaacgtcttttcatcgagagtcatagtaataaagatgacatcattgacattgttgaaagatgggaacacaacagggctttttggtcctgtagggtctggactgcaagatcttatactataatactataatcatcaaaatcttgacatcaaggttagactgtagtaaatatttccatagaagagctctaagacttagtactaatttattgagtttcagctctgatcaatgtacttagtttatacaatgctgaactttgcccccactttatgtaccataagcatattgttttctgatatacaggttgagcatcctaaatctgaaaatcgaaacccgaaatgctccaaaatctgaaacattctcaatgccaatagaatgctcaaaggcaatgctcatataacaatttaatgctaatattccaaaatctgaaattcaaaacacttccagtcccaagcatttcagataaaggatattcagcctaatattgtaatttctattttattctttatagtaatttatagaaacaaaagcactgttttcttttcatgacagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggtaactgcagaaagcagttttcacatttaggagatggccagtggtgtgctgaggccccattggagaggcttccaggagggtgctatccgttgccgctctgtctccttactctcttttccttcatagcactttccccacctggtatagtgtatatttgtttatgtattttgtgtgtgccccctgccccaacccccaaccctgactattggaatgtaagattctccagggtgaagactgtcttttcgtaactgctgactctcctactgtcacaacagcacgcaggggattgtcagagctcaataaatatttgtagaatgagctaatggattataaagataggagcttggttttgaaagtgcctgtgctggccaagaattttatgtgcaccatctcctgtaatactaacaaccacatttcaagataggattatcaccatcccaaagatgttaagtactcttcaaatgtggttgctaggattggctgaactaggattggctggctctgatttatgtattgttttgactctatttattacctgatagtaaaagtggtggtgatgttggaggaggaggaggaacagcagctccctgtctttctcaagtcatttgctgtttgcttttacagtcttagtactgacgcagtaatttaataattttatgattaccaagcaacttgtctgttacgattttttaaattattgttagtgttttgttctgcatctgaattttatattttgttctgtaattcaaaagctatacattttcaatgcactggatccattccttgatttcacagagaattgaagagattcctttaagccctacctggagttctttctttcctggggttggggtgaaggacaaaataaatcagttggtctatcccaggagtcaggcttttagctgtgtacagtgatgggcagaacttcacattacctctccctgccctgtccaaagatggaggggaacttaatgctcatcccagaaaatactgtgtgtatttacccctaattcattatccctaccactttactaggttcctggctgcccaggagagggatgtggtgtttgtctgcctcccaacactgagaaagttaaaatcagattaaatgctttgctggtggttatctttactaagttccattgtggcctttggattgtcaattacagctttcaagtcacagaagcctatttcatacattcttatctgggaattgttcgctttgctagaccttatcacatcctaatacaaatattgctttaactctgctatttcattcccaattcacaaataatattttatgattgtgttcccagtagtgatgattcaactcttccactgtgcttatcatggagagctggttgggggtatttgccatatggttaatgtggcaacctgtgtttttagtggccattatccaagtgctaaagggaagaagagcaacaggaccatggtccagccatggggctaaagtgcccttgcacttaacaccacatgtgtttgggttaaaacggaggaaaaatattttcactgctagggcggtgaagttaccagtggagtgtccaggaataaaaggctgaatatctcttaaaatcaaataatagagggctagaaataacacttcactaagagtcaggaggcctggactttcgtgcttgctgtgaaatcagttagctgaaagcagttagttgatcaagttatgtctctctcagggcttctgtttccccatctgtgcagttagaggcagaagtaggtgatctttcaaggtttttttcaatttctaaaattccatcgcccaattctgtgacaatacagtgagtgtaggtaattctttttcatcaatttcagaagtgtttactgtgatatttccaaaatctcctgggaattttagacatatgtttcagaaatatcacagaagtgtttgctgtgattttgtgtaaatattttttttacttggttaggatagggacagcttgatagaaaaatccaaaattcttcagagacttgttgtcttgggccagaagcatcaacatcacttgggagcttgttggaggtgcatgtcagatctcgcctcagactctcctaaatcagtctgcattgtaccaagatacctacatgatttgtatgcacctgaatgtctgagactcaactgctataggaaggaatgttgtggattagattgtttgtgacttacgtttcttttctctctctagtgttgagtataagagccaaacatctgatttgttaattgattaattgagtcctccaaattaaaacaggtatccgttgctttaaacaaacatgttatatgtacttttgttcttgcagagacagactgaaaaaagaattaggcacaggatctgaagctccagaggggttcatgctggagttcatcccacattacaatgcagaacccaggagtaaaatagccaactccctgcctgctctccagtaaaaaatgtaaattctcccttggaatcctggtttgggtggcattatgccatcagcttaccccagttcataggcatgatatgtggattctacttcagttgcagggaacaaaatgagcacctctccttttctgggagaaggggaagtaaatttggctggtcaaggataacttgggcagaagagtggtggagggcgtggtttgctttattcttgaggtgggagcaggctttcccaggaggagggtgccctgggtgctgccatgggaacatgcatagatgcacgaggcaacgccgcactaagctctgctccctgccactccccttctcctccagcaacttactatccacacagagcagtagcagctaccctgagaggggaagttactgctgaagcccccacccctgctgcagtccagtgatgtctctgcttttgccagtggcccttctgccttccttatgggagccttttattcccaggaccctggtgtgtgcctgggctcggtttggctgccactccctgagaatgtttcagcatcctcttgaagattacttaggagggaagcttctctctggcctcggtattctgtctctgtgctttcctgggtggtgtagcatccagtgtagcatcgttctgggcttgagagcaagcccacattcaccctttgggattttaattttaagcacattttcctccaaagtcttagtcttttgaaactcaatcattacatttttagccacttcctaacacctcctgcagaagatcagaataatgttctatgggttatttttttcctattgattgtcaatgtgccactctttgaggtgtgtattggaccgagtaaatgtcttaagtggtcttctcagccaattatctacaattgtcttctcagccaatgcctgggccccagaacaggacacttaagtcaaaatccccaggaggccaaaaggaaggagctcagtctttttaaaaacttccaagtgatcctgatatgtggcaagaattgaaaataatggccaaatggccacaacccttaagggaagagtcttgaaccacttttacatccatttcatagtctggagtttttctccccatcaccttggtttgtccacattgaactgcgtatttctttatgacttttcaaacagcttatatataactctgtgaggtgaggtgctcttttctttttcatttttcttttttagctaaagttattgattaggatctctaagggcctatagtggcagttgcaaacttggaaattctatcgtggcccttaaaaattacttagatagtaaataaaaggggccctatcaatagggcccagggaatctcactattaacagttcttcattcggaaaagtgtttgcttcccctacatttcgttttctttctcaagtttgagccttgataaacattcctttcaaatttaatagtgcatataaagttcttgctttggggagagatggttataaaattcctcatttaaatgtctttgaatgattatggtaatatgatactggtttatcttttacactctgccccatagtgtttcccagaggttctggctgcttctgtcaactatttttacctagtaaagtttcccttacattgtctagtgtggcttgtatttttctttgtatattagctccagttattggagttagacagttaactccagttgtctggttttgaagctgtgaaatgattctgcagctctgtgggaactgctgaggtagaacctaacgtaaaattggaaatggctctgacatcattaaaatgattgaacaacttttcatcagtgttctaaggagtttttcatgattccacattttccatatttctctagtagttcagagttttgtatattctgtgaaatgaaaagaagaaactgtattaatcaaattaagtagggagtggactggttttcctaaaatcatcagtcaccatcttaatgatggacagtcctctcccttctgtcgaatgaagttttaacattcaaatttgtctgcattccatgtcttgaagcacgtgaccactgagttgctgctactcaccagaactagcccgctactgcagtagaaccttctgtctgcagcctttttctccacaagtcacaggatttgtgttcctagttttgctcatggcctttgccaagcctggaagtctcttctctcctccttgtaaagaccagcttcagttttattcttcccagaagcctctgattgaacgtctccttcaggcttatcattgtgaaattttgacagttaattatattcactatcccattattctttttcttgtctccaagtcttatttttgcaacagattaaaacttcttgaaaatgcatcctttttgatattttttattgtattgcataggactcatcccatggtttcaaaaatgttaattaaactgaagaaattcaatattccaaataagtccagcaaaaccccttgctttgatcttccaaatgagttcttaggttctagttgtttgagtctatcctgatagtattccaaggtaatttaaaaaaatagcaagaagatgaaatgacttcatttgtgaaagaaaaggcacccactaagattttgggctttttttcccaagatgagctaatcagtttatgactttagtgaaccaacttaaaaagtaaatgctttagatgaaaattggtagtaagaaatataaacatgaagcaaatctcagcattagggcaattttcaaaactcacattttaaagaacaactaaattgcagttgctcagtgcatataaataggagtgtttccatagagtcaatttgagcagctttagtaattggagttatttttcatttggccacccatctaattgaacattaaaatttaaaaattaaatcaaacacataggtaaaactaatggtataaattctgatcctctttttcaaaaatgggaaaacattcacatttcactaataagtcattagcattcttctcttcaaagtcctcaagatggaagaaattccaagaactaaaacggttagctgtatgaattttcatgttaatatcccataaccctctccacccacccttgctcctggtataatctggaagaggctcacctcaatgtttctgagtccacttcagaaattccaaacactgggtgagcctcagcattgacctcttacagagaaagggttccttttgccctggtaataatcgaccagtgtttattaggcaaccatgattctttcccccaaggtgcaaaaggggagacaaaaatagaagacgtgtttttcactgtcaagactcaaaatctggttacaggaccacatatatcaatatgaaacatcttaaaaaacccacaaaacaaaaaccaaggcaacatgaatgctgggactaggaagcaggaagctgtcaagagaagcaatgttagggaccaaggctcccacccttgcacctaggaccacacagtctctcctcccttccaggctatggcctctgctcctcctcacctcttctaagtacagggtggaagatggttcttcacagctcctgagtttacaagttttcttagtctaagccccagataacaattacaaaccctaagtccaaattcctgggagaaggggtctggtcagttctttttgggttggctgtctaccttggatcaaattagctaagggataggtgtgggtgtcacatagcgcaaatctctaatgcctgacaaccttaactaaagaagtttaggtctagaggtaacagtagtactttacgtttttaagagctactcctattattattattattattgttgctcttagtctgatctcccagggtcagaacatctagacccaaattaatcttaatggtttactaaatactttaaaagcataccctgaaactcagtaattcaaacctttgaattttctgaattccttctctgacttgttcatgaacttgtcccaacaaaaatttatttagatttttttttaaatggtggaattattcaggatcggaatcatggaacagctgcagcaagaaggattggaatggcttgtgaaaacggcagtgtgtgtgtgtgtgtgtgtgtgtgtgtgtgtgttgagttggggaaggcagaaaagaaaaagaaaagttagtatatacttagaggtaaaagagtagaattaaacattcccatagatgtatagggattctactctccacatgagtcctcaccttaggcactagaattagggtctaggaactaatctaataaatccctggcccttccttagagactgattatgtgttgcgataggaaaagctgatgccatagaaacatctggactcatctatgtgggttgttggatcatcaattcttggagctatcaggtctaatacttgccatacctttaaaatgctctctggaatatcaaaacaattgaatcatttgctctgagtccagtttgattatttattggtgatttgacaattgtaaacagttagccactattgcacaggagtctcttaggccctctttgattaagtagagggaaacaaatgagggtcatgtgaaagtttcaagacagacacgtcatgtatacaacagaaatttttagttttcaaaatctgaaatggcaagattgcaaagggaagccatcacagaatctaagtgctcttgagagaggtttagataatccaactgaaaaaattcaaacccttgcatttgacatttcaaactttcaagagtccattgtagaataacagttcattcaacaggtatttgttgagcatctactgcattttttgagttgtcagtggagacctagactttttttaaaacccaagaactccaacttggcaaatctttggagatttctttatataaaccccttagctatagagccatgaagtaatatttctaatatggctatatgccacataacgtttcagtcaacatggattgcatatacggtggtggtcctgtaagagtataatgtatttttactgtaccttttctgtgtttagatgtgtctagatacacaaatacctaccattgtgttacagttgcctgcagtattcagtcccgtaacatgctgcacaggtttgtagcctgggagcaatagactacatcatgtagcctaggtgcgtataggctgtaccatctaggtttgtgtaagtgccctctaagatgtttgcgtgaggaaattgcttaatgatgcatttctcagaaggtaaccccatcattaagcgacatgaatgtatatccaaaattgtatatactattcttttaaactaatgtcaatttattttgataatatagccttaattttactgtattttgatagcaataaaaatggaatcaggtacatgcaatacttacttttctttggtgtttttaaggagcgacgaaaatttggccccttaggatggaatattccctacgaattcaattctgctgacttttcagccagtgttcagtttattcagaatcaccttgatgaatgcgatattaagaaagtgagtgaaattatgccttttttcctgtttttattgctcttcttaaatcagggttctacagtcatttgaagtctatgataaggtgtgaatttgctgagccccatggagccccctttgaagggacttgttgctgtaatcaggcacttgctggggcagcctgtccctgcccccaacactcacatacctctgaagctaactaactcagtgtgttgcaaaataccgcagccttcctcatgttacactcagggaccacagtgcacttcaagagaaggtgtgctttaggtcaagcttctcctcactggtcctactcctgcctcctcagaagtgaagatggtatctgcctgcccatgcgaaagttctttctcaccttaagtcacttcttaactgctcagcttatgcatatgaataacaatactttctagtaatggtcattcatcatcatatgacactttgcagttttcaaagttctcatgtgtgcaggatctcacttttatcttcacaaccctgtgagatcaataaaaaaggcattattatttatttatttattacccattttactgatgaggtaacagacaggagagactaagagacttcctcaaggtcacagagctgagaacgtaaaatctgttgtcctttcacacatataaagggttggaaatttgttttttctataatctttggcaagttaatgagccttaaagcctgtttcctcatctataaaatgaacattgtttctgtgaggaacgaatgagttagtatttgtgaaagcacagtacacagtacctaataagagctcattcaatatgactctctgcagtctggccccctcttcttccacagagtagggcttcaaggtaattagagattctgaagcttccgtaatggggtggtaagccatgatgagtgtttactctagtaccaaaccgtcatttttccttgaaatgacaaagggatatgaaattaaaagtaaggcagtctgatgaaaagttatattctatgtgttcatattctgtggtcatttatcattttggtacatacaaataatagttaccttaaaatagttgctttgaaaggcaaccaagctgaaaaataaaattttaaccaagaaaaagtaaacaaaaagcaaatatccttatttctcgtaactcaaatgtatcaagggtttaaagaaactgctaaactgcaatatattgctagtataaaattgctatagaaattaataaatattttgatgtagttttagcacatagaatgagatgcagaggatggcagaggattgcattgaggaaaaatcttgtggataaataattttcttgttgttctcgtaatgattccagaaaatacattactaagaaagcgtattaaagcaatgattacttgatttttctccttttttcactaaacaccactttcctcctctgtaacagcttggcattactacaatgagtattataggtaattatatccccagagtgaaaattagtctttttccctattttaaataatatacgtgcaatatacttaccagtgtttagtattgtagattttttcttggtgaacaaactgtagtggttccagccatgtaatagtgaaagagttattaatataagacgatgaataattttaaatgtgagtctagtgagtgcttccttttccagacctttcctctagggaaagacccgaaatgtttataatgatgtgtttgggttgacaattaataatccttttttacttttaataaagggtgtatcatggaatacggttcggtacatgatcggagaagtacaatatggaggcagagtgacagatgactttgacaaacgtctacttaattgctttgccagagtaagtcaatttagaaaaataaagtttggagacacatttcactgtattttccaatttttttgtttgtaataggtctgccaaactcaagcatacagcagagctgctgcaaagaattagccaagaaacaaatgcatgtgtgcgcttacacacacgcacacacatgcacacacacacacacacacacacacaacaaccagcaattgggccaggcatggtggctcacgcctgtaatcccagcactttgggagactgaggcgggcggatcacgaggtcaggagttctagaccagcctggccaatatggtgaaaccccgtatctactaaaaatacaaaaagtagccgggcgtggtggtgagttcctgtagtcccagctacttaggaggctgaggcagaagaatcacttgaacctgggaggcggaggttgcagtgaaccgggatcgcaccactgcactccagcctggtgacagagtgagactctgtctcaaaaaaacaaaaacaaaaacaaaaaccaaccaacaatctacttgtggtgcagagcagagcagtggtcagttctcattgctctataactcctttcccatgtagatgaaactgcttgtgcccagggcctctcccccactgcccctcctccatcttccgcattcctgtgcacctcacttgtgaggaaaacactggccatcatttctctgcctctttctctgagtgaaagtcttatggtgatttcaagccccaaaataagtgattgggggattaatcataatttgagttttctcatctcttctattaggatagacaattggaaattgaggaagtgttcactttttctctgtgccaaataaaatccacatataacatgctgataaatattttctagagaaaattgtttattagcaattgtggctttcacatcaaggatgaatgtaataaataacacctaccagactcaaactcttcttaaaatgttttacattttagggaagtaatatataacacctaagtgagaaaaaaccagatgtcttttatggttattaaattctttatattggaacctataccggtaattctctacttaaatgattcttttttcttgacaaaattaaagcctcaacaacaaagcacaagctttgggagtattttgataagctgggggttgactagaaaacggatttttaacctttacttgttttagcaagtttttcttgaagctacatatggagaactgtgaaaaataataagtgttggtgagaatgtgcggagggaggagccctgctgctgggaggtcaaatggacacagacctcctggaaagcagtccagtaatacttactgaaattaggtatctcaggtagacatatctcagaacatttctagaaagagtccacaaatggacatgtacaaaaatattcatggcaacattgtgtgtggagctgaaggcaagcatcatagatggttttcctggaagcagaggtggagatttgcattcaagtgcctcctccccagccttcctgcaagacatgaccttggctgaagcagctgcctcctgctagggcagttcctggggagggacaatgctgtgagtccacagtagccaacactccagacagcggtggggagtgagtacctgctcctgaaagaggatcgagtggcacatcatagcatccactacaaaaacctaagactcctaagagaatagataagatgtggtgggtgagcaccatggcatactattgctcacccttgtggggtgcaacctgttagtcatagtcatatcaagtgtgtgatacgactaccttctgaaccagaatcctgctcctgagtatatgtcccagagaaattctcagaatgtaccaaatagattattcatagcattgttggtggtagtgggaagttgaaggcaacttaggaatccatcatggggaaatagttaagttacctgttgtagaggcctatggtggcatataatgcagcacttagaagcaatgatctatacgacatcatgcataggtcttacaaacagtgttgagtgcagagctttaaaaaaaagtaaagtgagatctataaaggaatatatgcatagttcacaaggataaatacatgttctaggacatatatcaagtacacttaaatagatgccctcagagggaaaaggagacagtgaatggatatcagggcagaatggggaaaaattaaaataaaaggggcctagattcataaaaataataaactcgggagtgtgagaaactgacctctgtatttgagattcaaaggagaaaaaaaaagatgtcttaataagtatactttgttagaataattgtaaaagtatctaaaattggagttttagcagcagagactaagatgtggttagcttcagaatataattcaccaagagtaacagcagaatgctgatgggatcaagtgcgtgggtgaaagaagaggggagtcaaggtcatccctagttttgacttaagccactggacacagaatggggctatttacagacaagaggaagggctgcagcagggaagagttttattggctggggctggaaattaagagtttggttttgatcatataacatttgagatgtctattagacatccaaatcaagttgtctcagactgtaactgccatgagggcagggactttgtcttattacatcagtgccaaactctgagcaccagaaacagagcccaacacatctaagtgctcagtaaatatttgttgaatagaagaacgaatgcatgaatgcaggtgaacaaggcacctggatgtacagatccggaggtcatggtggagctcaggcatggagataaggatctggaattcttcagcatgtagacagtggcaacggaaagctgctgtgttggtccagagcctccagggagatgtctgagccgggagcacacggagggggaggaagaagtgtcgctgtctcagcctgctccaccttcaagagctcaagcagggggattcccctctctgacccctctcctgcctttcttcctcttctacttcttccctgtaccctgacatttggcattttgggccacagaggactagtgagctgacttcaaccctctcctagaaacccaagattctctgtcctctgggcctgggatgtgcagacttcctgatctaaaagcacagggttccatatccaggccccagttcattggctgttcccaagtaacagcagctccctcctcacctgagttattttactcccttctatcatctgattctggtttctctggactccattctcagcaattagtgccttaagtcaaaagttcatcttactattttcccattcatttgcccctgagtggcttctgtgggctcattccctccccctctctcaggacttccctaagagtggcacaaccttcagtggcttcaattctctgactgttggccaccccacttccttatcctactgaatcttctctttgccctacatcctctccaacctcctgtcttgttgctttccctcattcatttctctgtctagcttggacctgtttcagatggtcatcaataaccagaggtgagtttgggtctctggccctaagggcatgagcttaccacatgaacctggcagcagcaaccctcttgagaaaggctgcacaaaagcctcacagcccccacaccctgccttcacctgtttgatctcatcctcagccccaggcttgccttctgaccagccacctgcctgcactacctccactttaccctaaccatgtcatccagagttgcccatgggagaagcagctccactgtaaactcacgcctgcacatggcatcctctgtccctctgactttcaatctcgggcttgtctttgaaccttgttttctctgttctcagcatcttacagagtctctctgctaaaagcgattgcagaactgtattggatgttcatggggtatgaccgctcacaaagtagctccatgtagatttcatatttcatattttgactttgcccccaaatagcctccaaatttggtgaaactcagctatttgtatgtgtataaagtgctgggaaaatagtaagaaacttcattttggtcttatacatacatgtcatctgacaacacagaattcagtgtggttatttgttatctgtgtgctgaggacccagggcctttgcccccttagggtgtcttcctgcaatttaagtcatccacgtcgtgaaaaatctaatatttctaagtaatgaccatgctcataacactattctctttaataactttcaactactctccatttcttgaattaatcaccagtcctcaccctgacatcaatagtcatccatgatatgacctcacctcacttttcctgtcctatctcttatgactacattgtgtccaccctatattccattattcccttaacctgcttctcatttttgcatcagttctataactttgcttatgtggcctccccattccaagttctccggtcaaactcctctccttcaaggcttagctccaaaaatcacctccttgagaagacctcagctgacatccacctggatgttttttgttcctgctttaaacctctttagtactttgcttatttttatttccttctgactcttgccttagtgcactttgtattgtggttattaagtaattggctcatccctccgctgggtcacaagctccttgaaagaaaggactgtgtgtctcttatctttgcattctgttctggttctaaactcagcctgctcatgcataggagttgaataggataaaacagagagaatcagtacacagggtatttcagagcaatcactggatctaaaaagagctggaggaaggagatggagggaaggtactagagaacgtgtgaccaaccagaggaaggcaccgtccctctttcctgtcaagtgctccgagtaattcagacgtcgtgcctgcatttccactcttcctgtcttcccattatttccttccccactgggaaaattgctgtgagacgtaagtcattgcctcaaatctggctcataggcatttagcatcatttttttttcctttctgagaataagtctattcacaccaactatatatttgttctctcactgttttgttaaagataattcatatggaataagaaagggatgtcttaaggcaaacagcaaggcagctgaatacatttacttcatgtggacagggacataattagcaaaggaagctcttcaactcaaggtgggaggggagagtttgcatggagctctcctggccgtgtgctggggctcattgctgtgtgagtgaaactgcgcacaagcacatccttctggtatgagccccatgtcggggagaagtggggtgatgaaaatgcccagatattctcttgtgtgtgggagtatggcctcacagactttgcagtatgttcctattcctaaaatggaattgagggttgtcaaatgactcaatcagagaatgggcatgtagagttgctctcttccttactcttggtgaatatcttctttggtgttaaatggaggccaggtcaaattgtgttctggactctctcttttctccatatatgtggtaattattctatcagtagtattgttaaagcattctcaaaatcaatattaaaaactctgttaaaatggaaataaggtggcccctctcctttcttgtagcagttttcatttagatgctcatcaattttatttcttttgttttctctcacatacaggtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtaagtccctggcattttttaatttgaaggggtcatttgtaactcagtctggcaaagatggtgcatttcattttctctcctaatctctctcctttccccctttttttattttactgtgaaaaatagtgtcgcttcctgtctcccaattacaactttgtcatatcttggcctgctctcctctcactaaatcctgatgctccagtgtttatgacaacgttaagctctaatttatgcattgattatttcttctctgtcatgtcataaaacgagttggtgttagtggtagcagtgctctccgccggcagaagagtggtctgccagctcctcatctctttcttcaaaaattcattaagaatataatgctcataaatagaatctaaaaagccaggtgagaacagatgggagggtgaagaatcgtatttctgcctggtcctctctttcatggcccctctccctcacttgctcatctgcatccttttgtcatgcactgcctgtggtgggtgcagtgcggtgagcacttgagtacccgacacagatgcacagccccgggaggaaagagtggaggggctcagctttgcgtgaggtccctgctccactcatcacctagagaagaaatgctccccagttccaagccccttggcatgaggtgtcaccccttctctctttaggatccctaccaaacccaagcacctgaactggaatcctttggaatggaccgcatgtcctctgcagccccctgatgaaaagtcacaaggtttacattcaggaaaatggtttcaggaagtggaagaaaccaagactcctctggcagattctaagttgagaatgccctaagagtggggcattcctctctcctagtccctggcctactgttgtaattttaataattctctgggtttggacatggacatttccctggccttgccagatgtcccaggagtcccagtttgctgccaatttccttgtcttcccgcctctgaccaccctcctagctccctgcatgaggatgcacttttggcctctttacacccaccttgattccaccttcttcatatcctctcatctcgcccaggctgcttttcatcttcaaagatgcggacatgattgaaaatacctacaaatgccaatgcttcattccacccccatgatggaaccacgaaggttcgttagtggcagctcttgctgttatctaaggaggctttcataagttatctggggatgggaaagaagtgaagaaataaaaaggattcctcagggattggattgacaatcaactcttaacgttttatgaaagaggagcataggaaagtagttttgctttagctgagactttaaaaatgtgagtcagaccacatcaacccctgctcagaatcctcccaaggttcccgtgacactctgagacaaggtcaaagaccgacagtgacctacatacagatgacctacaaagtcaaatagtgccactgccctctacctccccaccctggctctttcagtcctctcccaccttcgtgcccactcagctcctgttactcaggccagacagcttcctgttactcagacaggccagacagcacctgccacaggatacttgcactccctggaacctccctcctcctagatatcacagtggctcacttttacctcttctagtctttgcttagatgtagccttttcaatgatgccttccctggctgtgctatttaaagattgcaacccactccccaaaccctgcccaagaccttgtcctcctgacctgctcttctctatagtttgtatcacccactgacatactctacacttttttttttttgccacggaatttcgctcttgttgcccaggctggagtgcaatggcacgatcttggctcaccacaatctccgcctctcaggttcaagcgattctcctgcctcagcctcccgagtagctgagattacaggcatgcaccaccacgcctggctaatttttgtattttttagtagagacagggtttctccatattggtcaggctggtctcaaactccctagcctcaggtgatccgcccacctcggcctcccaaagtgttgggattacaggtgtgagccaccgcacccagcctcatactttacactttaattactgatttgttattgtccaacaaccaccactaaaccataagttccactacacctgaaacttttgtgtgtgttttcactgctgcatcccttgtgctatagcagtgcctggggctcaggaagtatttgttgactgatcagtgctgctaaattcttctagagtgtgaaggatgtgatcaatgaggagattccatagaaagatcccacaagttcacgtgagtggacagagaaagaactgataagtcttaatgcacttgcaaatttgtgactgaaaatgttctcatatgagggctctgaactttaattccatccttgacaagagactggggagtcacgagagctggttcctggataatccacaggatcccaacaagatgaaaccatttcaccctcacccagggtgatggtgcacctaggccttgttcactgcaggctgtttcactcaccagctctcaagaaagatgaaacagggctagaaaaggtccagagaagtacaacgcaaatgtaaaagcaattggagacaaagacaaagacaaaccattttttccttgactttttatttggaatgattacaaactctcagaaaagttgcacatacagtaaacattcatacgctccatcgagatccaacaattgttcatgttttgatccatttgctttttctccttctatatttatatctctgtatgcttatgtatctacagctatatctatgtataatcacatatatttctctgtgtgtgtgtttgtgtgccctctcagtggatagagctaggaagcatgtacttttaaaaacatcatgagttaatacaaataactccaattccagttgtatacctcagggttgttctttgtcttcccccattccatattgatatctcctttctcccaccgtaaaaactctggttcccagcaacttcaatatgtgtattcatttacttgcaattactatgccaataccactaccagcaacaaacctattaagtagaggtcaagatttctttgcagttctttttgtccttaggatatattccactaggtataaagagtactgtgttcaaaggtcacttggattaatgatttttttttctgtgtggttatgctatcaactgatatatagttatgtttatttgtttctgtttgtattacatttaagggtttttttcccccacatatgctattgttttgaatatgtaaaatatgaacatggttcaaaagttacaactttaagttgttcttagagaagtctcagaccctttcaacccatttccctcttcttttatgggtaaacaaacacagtttctggtttatcttctctgtgtttctttttgcatgtacatacatatatacatattgttattaccctttcttatacaaagttgccaaactatatctattgtgttgtgtcttgcttttttctcttaacaatgtatcctgtaaatcacttcatatcaggtcattattatcttcctcatatttttttttacagctgcatgctgctccattgtttatatggatcatagttgttcaaccatttgcctatgtatgggcatttaggttgcttccaatattttcctatctcaaataattcttccattaataactttatgcttgtggactctcatattattagagatgtattttcagggtaaattgttatgggtgggattgctagatcaagatttagcgaatattgtcaaattcccttacatagggttatactgttttgtacttttacttgcagtctgtgagtgcccattttttcagaatctcatcaacagagcgctggtgaggcatttgaaccttcaccaatatgacagtgagaaatgttatctcagcatagttttagttcacttctcttattttgagtgaaattgagaaaattttcatatacttaagggctatttatatatagtctgtccattcctttccaatggagtttttattctttttatttaattttaggacttatttatatgttagggataacaaccctttgtttgtgatgtggattgcaaatatttttctcagcttatttagcgttgcttgtgattttcccccattgatcaggtagaagtgttattgtcgtttcgttttatttttatgcagtcaaatttatgactacataaattctgttcttgctgttgttacatctggatttttagtaatagtaagaaagcttcttccctcatcagggtataaaggaatcatctacattttttttttttttagtgcttgtatggtttcacgtttttacatttagttcttttatccattaggaatttacctattaggtataagtatggatgaaattctttttcagaatagcaatccagttatcctatcaccagtgactttttttttcttttttttttttttttgagccggagtcatgctctgttgcccaggctggagtgctgtggcatgatctcggctcactgcaaccacctcctgggttcaagtgattctcctgcctcagcctcctgagtagatgggattacaggtacatgccaccatgcctggcaaatttttgtattttagtagggaaggggtttcaccatgttgaccaggctggtcttgagctcttgaccacacgtgatccgccagccttggcctcctgcttcctttaacatagaatttccttccataggtactcgggtccatttctgggctttctattctgttttcctttctattttgtagcagtctgttttaagtttagctagtctccagtatgttttattatctgatagttatagtctcccctcattgctctttttttttttttctgagcttgtcctagctattgttgcatgtgtgtttctctattgttgtcagaaattggtgttgaattttgttgaatacctttcaacatttatggaaagaatcacatgattttcccctaaacacctaaaaagttagtgaattatattaatggatttcctaactcaaattttctacagataatctgaaattaataccactgggttcggaggtattattctcctaaggtagtgatatactctattaatggttcattggggaattttgcattgatattcataaataagaatggcctggagttttttgtggcatctttatcaggtttaattactaatcaatgttatatttgctttgtaaaaatgtggaagtttttctaagctctggaacaatttatgtagtattggatgctttaaagtttggtagaattctcctgtgaaaccatctgggctcagtgctagttctttgatatctttcgtatttctctgtcaccactgcagtcaatattttgtcagttgtgttctcctaggaaattatttgtttcatctaggttttcgtatttattttcacaaagacatgcaaactagtctttaatctggtctaataagctggactcagtacaatgtggtaaagaatgaaatcacttcttccttaccctatactgagtccaacccattcaataaaattgttacagaagtgtggacataacactagctctgtagaccttggtctgaaatctgatgacaacttgaagccactctcgtgcctctcctaaaggaatgtactagccttcttaatataatctatcgaggcagctctgttcaaccacttcactatggtgttgccaacacatcccagagaaaccactgagaaacagtggttatactgttatatggtggttatacttacttaatactaagaaggaacttagtattgacacagatgaacacttcaccagagccagaggctcctcttcacagggttctcctgctgtccggcttagcaggttctcagtcctcagtggcaaaatcacactgtgacagagtaacaaaatttgttgcaaaatgcaaaaggctgcaaagcatgactttaatagcatcacccttcagtgtatggtccaggtagcagtgtgatctagtatctctcatgctttaaagagccttcccttcccttcacatgcctataaatctatggcctatgttctactcacattttaacctcttttatagtcatgtccaccttccctcctgagtagagctcatctatgccaatggcctttaaaacatcaatatgccacatatatgttgtctagacctttcctctgtgctccacagtcatttatacaatttctatgtgacattcactggcatgtctttcagacagcttgacctttaaaagccccaaactgaatctcctccatctacttctcctccatctaaatggcttcctacagcagttagaataaaagacaagctctctgccatgtgacaaggctcatctagagcacccatgatgactaatcgacacctcgggtaccctgtgggtaagtccaggtgtgtgaggatgcaggcctagaatagggatgatcatggggtggagtgaagctgcaggacaggtctcaaggggggactgataggacttagcgaatgcagagcaatggctgagaaccttcttctgtagctgttaatctgtttcttgctgcaaactggtgtgttagagaggacacggtgagccttctgtgttttgtcaagtctctcttcacagctttgtccagaagcccacatggtgttgctggcatgcatgctgtaggatgccgtaagcgagcttctcccaaaatagtgtcaggatcttgcaacctttcaccacactagtgaggtcaggtagaaggccctggacccctgcctaaaatgggggagtatatccactagagcaactggcaggcctgtaagaccttcgtcctcctctgttctctcttcatccttaacttcccatatggtctgccttggggtctctctcacccacccctgatcccctttccccagcatgtcttagcccatttctggttcctgctcaggtggttggctctgttctgcagctctgtgtttggtaatttttttggtctctgagtacctaggtttgattcttctttcctctggctctgaaatatctggtggatggaatcctggcaagtgagcttgccttcttcaaggacttctctacgccccttgctgttcccccaccggccaccaggaagcagtaagcaataacagatgaagcatcccagctgaaacccacctctggtcctcacccagctccagcaagatgtaactctccaagttctgagtgaaatgaaagaaggggtcaaagatgccctgacattgcttgtctgggagctggggtagtggaggagttgggaacaggagtatgttggaggagaagttacagagttctgttgggggcatgttgagctgggaaagaacatgggatataaatgaatggggtgagaaatatggactggagcccaggtgaaagatttgaatgcatgtgtgcagagataacagcttcagccatgagagaagactctctaagatatgctggctaagtctgtgtgaatgtccccagccagaggaatcattaatttatctgaccatccatggtgttcaacagcattcttgcttctttttgtttgtttgttgttttttgttttgttttgagatagtcttaccctgttgcccaagctggagtgcagtggtgcgatctcagctcactgcaacctccgcctcccaggctcaagcggttctcatgtctcagcctcccgaatagctggaactacaggcatgtgccaccaggcccggctaatatttgtatttttagtagagacagggtttcaccatgttggccaggctggtctcgaactcctgacctcaagtgatccacccaccttggctttccaaaatgctgggattataggcatgagccacggtgcccagccatcacttgatgataggctataattgggccatgatggagaactcgatgccccctgtttattggaatcttcactctgaagttagcatccataaatttgagagaagagggagatttgggcagggcgaatcacaagtctctctcctcagtccttgcataagaatgcagaatctctgaagtggagggggaaatcaaggtgaataaatgctttaaaataagtaaaatctctctcaagagtttagatagcatagtgataagaaccatgaaaatacacagtttattcacattttattatgtagatttataaggtaccaaagactctgcaaattcaactctttcaatgtcaaaaatggttgcttattttcactctttttctcatcagtggttatgcatgtttctttactttctgaaatttatcaaatgccttattacaacctttatattcatttcaatgcaatacaaattgaaatgtattcccttgagtatttgaggacacttttgagatttagattttttgaaaaatttatgctcattgatatttcatgtgcaaagacgtatgtaaatctagactgatttggatattatggtgcactaatatctcattaggtagttgtttatttcatagacagctctgtttttcagttgttttgcatttctattatccatgaccctgacttcccagaaccaccaagctacaagggcaatctgagcttcttcccatatttactctaaagagaaattttcttcaagaaataacttagaaccaaccctcaaggaatattatagctcttgttcttcatctcagagcatttatgaggactgttctcctgaaagcccttgggcttttgtggcatatagagagatttgcaattctctgttatagctagctaactaggcttctgcctttcatatctttgcaaacataaaatcacattgtggaaaaagaaatgtgagttgttcagccctggaataccagggaatgacattctgtgcatagtaaaatgtgtgttggggagagcttggctagctcttattcacagtggatcagcttttcaaggcttcttcccaacatctatgttttgaggcccgtgttcagatcatctcataaaaaattaaatcactcatcatgaaagtgatttattaggtgggatctagcagcagcagcatctccatcagcctctccttggagcaccagtgaacttggccagagtcagcagagagcaaaatggtcatctctgcaatggtgtgcactgttgggacctagcccctggtgctgagcacacttccacggagggctcaagctgaaggtgactgagagagcacctgagaatttggatatgggggctgtttttttttttttgtagctagaacaggtaggaatcatgaactctgcttttcttagcatgaatggaaatttactgtggttttcttgtctttaatcattaaagatctgcattgataaaataataagaagaatagttttacttcactctcaaattatatctttctgattctcctgtgttttgaggactatttatatatggcacaaaaggcatttgcaacccattcctgaattttgaagtagggcatgatcacagtttttaaaagtcatataaagtataagaaaaatacaagtaactctgagagggggaatcctgtgaaaatatcctatgaaaacaaatgaacttatcaattgtcaaagactcaagaagagatagatagaaagatagatatttctaatatctatagatgtatttattattatattgtattgtcatattatataatagatatataataattagaaatgaatgttcctaattcattattagaaatgaatacaaaagttgtaataaggcatttatacacacacacacacaaacacacacacacacattcattgaaaggtgccaggaaataaaaaaacaataataacaatatactatgtttttaccataagaaggaataagtaaattttcatgtcctttaaatattgaagaattgctgtcctttgtatttgaggtttaataaaatgcaagccaattggcctcaattcaacaaacaaacatttgttgagaacttactgtctggctaacctggggatacaaagatgagtaagatgcagtccgtgctcttggagcgcatcatctgttggggaagatgatgaatggcaaatgctgatgaggtacaatatggtaaactctaaaatcagggtatgtatacattgctatgataacacaggtggaggagcaatcaattccaatttagggatcaaagaaagctagtgagacaggctccatttaagttgtgccttaaagcaggggtccactacccctgggccacaagccaataccagtccgtggcctgttaaaactgggccacacagcaggaggtgagcagcaggtgagggagcactaccgcctgagctctgcttcccgtcagatcagtggcggcattagattctcataggagcgagaaccctaccgtgaactgcgcatgccagggacctaggttacacactccttatgagaatttaatgcctgatgatctgtcactgtcttccatcacccccagatgggaccgtctagtttcaggaaaacaagctcagggctcccacagattttacatgatggtgagttgtataattacttcattatatattacaatgtaataatagtggaaataaagtgcccaataaaagtaatgtgtttgaatcatcccgaaacttttccgccgcctcccctccagtctatggaaaaatgtcttccacaaaaccagtccctggtgccaaaaaggttgggaaccgctgtcttaaaggatgtgcaggagtttctcagattggagatgaggtgggaaggaagtgactgcaggactggggtcaaggacagagtacaaagaagaggaacataatgagcggtaaggaccaagaacttagactgggatgcacacaccaaggaacaatccaaggaagggaatgcaaacatgaatgtgtgtggggagttctgggaaccaggtccagtatgcctaaagcatgagggaggggggtgcttaaagagcggagtggccgatgcagagtgtggcttttgaaggttttgccaaaagagtttggggcaatattttaaattggaatacggttatttaatcatttatttaaatctacttaacctactctaccttctacatggccatttctgcttgcatgagttgatgggaattagcattttgcatacagagatttaagccttttcctgccatcacataattcaggctgaagttggaatgaagataaacaagcatgtcatcatgtacagaatgacaagtacaacaataaaagcaagcactgagagctatgcgcacacatagggagaaagtctagggaaggctgtctagaggtgaagacatctaagctgagcttaatattaatagctagttaggaatgagctataatcgatgaaaaaatgagggcagagcattccaggctgtggaggtaacttgggaacagtcaaagaaatatgaggggagtcatggaatgcttgatgagcttcaggtaactcacagcacagggtagagtgtgggaagaagaaagaaggaagcaagagcagaagctggagatagaaaaaggcttagtgatgaaaaaggtttgtatgccatgtgaaagacttcagattttatcctgaaggttatggggagtcttcgaatacatttaataatcacttttcaaatgtcaaaacttaccttggaacagtggttggaggcaggaggatgtgttaggaggtgatggcagtgccgcacacagaggatgatcaggaagttagggggcagaactgaaggcagtggggatgacggtgggtcacggggaggggatgctggaaatgatttggaactagagcttggaaactaagaaggtctggggagccacagcaaggaggaagccatctctgagggttctcagttgggcaactgggcagacattgatgtcactaaagtagatggggcaaggagcagtccaggagagggataagggagaactaaaataataaggttttggatttgtttggtacaggaaacaaagagctctggggctccagggaaatgtggatgcacagagttcatgataaagtcagaggttcaatgttacccaggcttacctggtgtttcgtggctctctgtaagatgtcagccatggtgacacccctctgtcttccctaacatagcagttcatccacatattctatctgtagtgtacctaatgctagagagagctcatggagtaatatgaatcacatacaaatttaaatttctgaaaatgtatatagtaacatgtggatccttgacttttgttgacttcattttgttgtctcatcagctattttcattgaactttcttctcagacttatttgtatttttcttatacggtactttatatgactttttaaaactggggttgtgccatatttcaaaatgtcggaatgggtctcaaatgccttttgtgtcattttactagaatattgtgttctctgttcatgtattcaactgcatgcatgtttcaacttttaagataagtgtcttttgggatattccaaatccccaacatctgaatagaggttgctcacagaaatagtaaaagaattttaagttatatctaaaatatactatacagtcaatttttgttcattaaaaatcaggttttacttcattgatccttactgggaaagtcatgtatttaaaggtaatatgaagctaatattccaactctggatggagttacaaacacttgctagatctgatactaggaccctcgtatcactgtatctgactgaaagttctgtatgtgaagcatgacaccttatgcatttatcatggcatgacttttggaaaggatgcagatagttcgggtatgcatgtttgggtccagatgtggcattctagctgctaatcaaataaaaatgctgaagacagagcatctcctccattcttcagctttattcctaaatgaatccaaaggctgctatataggatttcctctactccccaccacacgcagctttttcataagcaaagaagcctggttaactttcccagcagcctcttaggattctgccaattcgtgtggcaaatttcacaaaaggctgtggaactgacaccagggaaggaggagagaaaaggatgcaattctctctttccatacactgcagagaaaaggcagaagggggcgctttctggtggggcataaagagtaagggtttgtaagatgcatctcagtgaacctgaaatatttgtccctgatttatctctgttaacttcttgacaactgtgatgggctttgccttatggggatttatttttctctgtttttcaaactgaaaatgatttttaatattctttattctaaaagtcctacattcttattgagaagcataaacaatagagaaaaataaacagcaaaaagaaactaataattacataaaaagctcatcatacaaaaatcctactgcaaaaatacccttctagtttttttctgtgtctataagcacaatattaacaacaaaattagatcataccataactgggtttgatgccatgttattttattctataatcccccaatgacacctcgcatgatcaatgaatatacagctacatcagcatttttattggctatatagatttttataaagctttactaggatttattattacaaatactgttataaagtcatatagattcatctttgtacacttgtctgattattgcttctaaaacagccttattaaacattgaataaatacaaaagaatatatatactgtatataaaatgtaaaggacaaatatacaatgttgcttttttacgccactctttctatgttttgcttcttttcttcttcttcctttttggcttttgctaaataagacttttcccatttcattttttttctcttctctagtttggaaattatgtactctgtttctgttcttttaccagttaccctagaaattttaacgtcagttcttattttggtctaaaattaatatatttatgctaggcatggtggtgtgtacctgtagtcccagctccttgggaagctgaagtaggagaattgcttgagcccaagagtgttaagtccagcctgggcaacagagcgagaacctgtctctttaaaataaataaataataaataaaatgaacatatttactttcctttctcttagataactttagctacagtcactctcctcctgacatttcagtattttaattttatcttttataatcccacaattagacatacaatgattgttttatactataatgcttatttagacttacctatgcattggcccattcttttctatacttcaaaccttccaacagaataacctccctcctttctaaagtatactccaccatgagggggacattcttttatggatgataaactcttctatttttgtatgaaaatgccttattttgccttccttttttgaaaaacagcttttatgagatgtaatctgcatatcttaaattatctcatttcaagtggacaataaatgatttctagtaagtttaccactacaatataacgttataagatttccatcactctaaaaagaaatgttgggcccatttgtgccaggctgtcatccccagcctcaggcaattgctaatctactttctgtttctgtaaatttaccttttctggacattttgcataagcagaattatacattatgtgatcttttatgtctggattctttcacttaacataatgtttttgaagttcatccatgttgtagcgtatattaatacttccttggtttttattgccaaatagtattccagtgccacattttgtttatgcatttaccagctgatgaatagttgggcatgttctactttggggctgttaagaacactgctatgaacattcatgtgcaagtctttgtgtggacatgtcttttcatttctcttgtgtagataactaggaatgttatgtagttattgggtcattgggtcataatctattcttaacatcttaagaaactgccaaactgctttccaaagtgactgcatcaggccgggagcagcagctcatgcctgtaatcccagcactttgggaggccaaggtgggtgaattgcctgagctcaggagttcaagaccagccttgccaaaatggtgaaaccccctctctactaaagtacaaaaaaattagctgggtgtggtagtgcacgcctatggtctctgctactcaggaggctgaggcacaagaattgcttgaacccaggagatggaggttgcagcgagcaccactgtactccagcctgggcgacagagtaagactctgtctcaaaaacaaaacaaaacaaaacaaagtgactgcaccattttacaatcccctctagcaattacgaaggttcaggtttctccacatccttgccaatatttgttattatgtgtcttgtgatcataaccattctttgtaaatgtgaagtggtagtattacattgtcgttttaatttgcttttcctaataaataatgaaactgaacatattttcatgtgcttattgacccatctgtatttcttctttgatgaaacgtttattcaaatattttttcttgccttcattcttgaaagagagttttgtttggcacacaattataggtatatagttattttatcctagcaattagaagacacttttccattttcttctggatttcattgctgctgttgaggaattgactgccagtgtaattgttatttctttctagataatctgctctttctctctggctccttttaagatgttcattttgtttttggttttctacggttttactgtgatgtatctacatgtagagtccaagggcgggagggatttggcttgccattactggctttgcaaatatagaaagtgggccacaagccaagaagtgcaggtggcctctagtagctgagaaggaccttcagctgacagccagcaagaaattgggtacctcagtcctgcaatctcgaggaagttaattctgccaacaacccaaataagcaaggaaatggatcctctcctacatcctatggaaaggaacccagccttgctgatgtgttgattttagcccagtgagacctgtgtcatatttagcacctacagaactgtaaaataataaatatgtcttgttttaagctgctgactttgtggcaatttgttatagcagcaataaatagtataggttttaagttttagttatgttttatttctagaacttctttttaactctttttcaaatatgctattcatgtttatagtttcctctttaatacttgtattttcagtctccttttaaaactcttcaatattgcaaatacagtattttgtagtgtgcatctgaaaagtcacttaagatctccacaggtctgattctgatttctgttgtttctactggctctttctcacagttccttgtttccttacaactttttaaacttttgactttgagcttatgtctattggaaattgactgttggattatttgagacctgagtcaaaggtatattgttccaggaaagagttgtgtttgcttccatcaggtgccacctaggacttcctaggaccaccttaaaataaattcttggcttgagcttttccaaattgcacaggtaatatgagtaaatgttaactaatgttacaaacatggtgaattcagaattttcaggaaagatttttcccccacttagtgctaagctaggtagaacaagttacctatcatcttcttctgacaggtggaggttactttctagtttacccttatactgaggttgtagctgtgtggggtcccagatttatgtaggaatttcctattatgctttccacctcaggtatgagggcttctctcctgtctcattgcactatccaaacagaaactcaaaaacaccagttagttgatgcccccagggtaaaatctggctttatctctctggattccagcattcactttatttccagcattcattttatttgaccctgaggattttttattgtattgccagttcagtgatgtttttaaaaggatgtttttcatatcttctccagaagttttagttgtttcagaagggtggttcacagtaacatttgcaccataccgtcagaaatgtaaatgtcaaatgtctctttctttttaaggattaattcttaggtgtagaattgctatattaaaaggtatgcaagtataatatttagatgtatatatttccatattacaatggcttgttttctgttcaagaaaataaaacagaaaaacaagccactaatctcaagcatttgctgaatcccttttagatttgcctctcacatctacaaaaggaaatatgaatgtggttaacatctggacaagagacaaaattagcaaacaaaacaataatcctccaaaataaaattatgtgaagtgtatagatggtaaattaggagttcagaaaaggctgaaaaatttaaatctgaccatgtcacacctggctagggaaatcttcagtggctgcccattgcctttagggtggtgttcagaatcctacaagttcccatataaccctgcatggtctggctcctgcctcttctctgtccttgtcgctcctcctagctcactagctccaagctcactggccttatctgtgttcctcaaatgcactgaaacccttttcaccccaacccttacttcttatctgaatgtccttttctgcctcccaccaccccaccccactgcgtggctgacctgttcatccttctggtctcagcttacatgtgactttttaacttttactaatcttctagtgtaaattacctctggcacacaaacacatacacacacacaggcacatacagcgccccaccccccacccacccacacacacacacacatttctactcaaatgtccaggtaactggtcaacccagcatctcagggacagagactaaattcatgcatctcagagtgtctggtcgacctgaaagaaagctagagagtgggaatgagagaatcaaacctctctgaaagcatcctgttctttccctccacagcacttgttagaatgggattatctaatatctatctcctccactagagaacagaactatgtcctattccctgccatattctagaacttagctcagtgcctggtacatggtaaatctttattgaataaatggatttaaagatgcatggctgcatttgaacaggtggagccgatgggcgtcaatagatttccctggaaatcataaaactagtggaaaaatgagaaaaccaagcagaaaagacgaaaatattttaataggttataactcagtgaggaaatatgaatgttcctctttgagccaacaagctgtcctataatgatagactcttatgaccagtctatagcaggggagagtgaaaggaggtgtgcccgctgttcagcatgaggtggtcaggttagctacaaccaagatggtgaagaagcgatttggatttccaagggtgtttttgggtctctttccttgaagatggagagtgtttcatttcagtgatgttcttgatgtcctattaggaggcagtagaatggatctctagtttctttcattcctctaggttgatggtagttaacttttcttcttttttttttttttgtagcttgctttgatttaagtgattctatcagttcattttaacacttgacacttatctcttacatgtttccctgtaacattctgaacagctcactctttttactaggtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtaagtcttgctggtttcccactggcatacagggctatttgtatatttaaacagtaagtttgattaccttgaaaagcaagaaatctacctgttggtgactatgtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacggtgacccatttatatatcaatttctatgataccttaagctgtgctaaaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacactgtccgaagtgcttcatacacattatgacactcagtgctcaggacagcaccagcagaaatcaagctaagtggcagagcaagaatttgaatacaaagtgatctgactctagaacctgcagtcttaactagttttagcatgcaatgagtgtcccaacaataaaaaatgttttattgcctcttaaaataattattgtttccattgtgtagataggtaccaagacctttggttaagatattgaaatcaatagcttcatgtagagatagttatagtaaggggagaaaatatttttaaatggataaatattgtaagtatacactttcaatagttttattggtgtgatcttcaaaaaacaaggcagcatacttgccttcaaagatttttaatactggcatgtgaaagtgagataaaacttactctaaaagattacaccacaggactgctattgccaggggaaaggttcaagaccttgtgataattcgagctgtccagtcttagctggggccacttcaccaacaagacctttgttctggtgattattccagcagaaacagcatcaggggtgtaactaaatggattcctatatgggaaagagtttgtactaagagacatctaaaacttgtccctgttccaagatcacttactttttagtgtcttattttatagaagagatctttcttgaacaggtggctgtaaagtgaattttgtaaatcaaaatataattataccattgagttctgtagtaaaaatgaagctacattattgtagagaatactacctggtcccagaaacataatgaaaatgctatataaggctacagcaagtcttaaattttattaataaaaagacaattttaggctggaacaataattatactcaaaatcaggactagaattacattttctagggtttaaggtttttctaagcatgtctctatctcaagtaaagtttcccttttaaaaccctaagcaggacaaggtgatttgtttgaaactgttaatatactagagatacctgggctattgatttgatactgtagtcaatacctgagctttattttccactcatggggttgcaaaagtatttctataatttcccttttccttaagagtgaatttccactcttgagatggattgatttaaagggaattatatatagatataatttatatatatatatatacacacacacgcacgtgtacgcacacacacacacacacacgtatgtatgtatgtatgtatgtatgtatgtatgtatgtatgtatagcatatacatatgctgttcagccactggaggttgaaggacttgggatggagatgagaatgaggcactggaggctgcaaaaatgtaggctctagaaccaagaattctgaagagtagctgaaggttgctacgtcggactgcgttagggacctccactggcatgcttgactgattttaatatagtttgctccacccgcataggtagtcctattcaggctgcctattttatatctgtgctcagtgttatatctccttccctttttgtgctttccgtcttcctctttcactcactagaaacaacccaattgcagtaaacagaggtgtcccttgctgaaaggaaacttctgcaccatactagaggcctgtcctataaaaggaggagaatggttcagatgactctgaagcccacccatctctaacattccaggctttatgagggggcagtgggcatctctggcagagaatcctgcagttcctggcctcctgtgatcctttggattgatacctcactttgagttctctcccactccatgtgtcccttccttgttcctttgattctggcatctctttgattgtggccagcagaaagttcaaatccctttatgagttcctgccagtatttgtagtcaatcttttgttgggcatatgtcaccaaattgaaatgtgtatattgcattggcttgttttccaataattgtcatattttattgttcccacaaccagaggcttttgtattgatctcttcaaaatagtcaataagtgatacatcaaaaggaacaaatgacagatatttaactggctgtcccacaaaatcaaatattttcattgattggattaggaaaggctctctttagctgtcatagctaaggcaacaatgatctttggaaactatagctaatcatatttgttggtaactgctctgtaaagatttttgctgtattaactttctatgacatttctaataactctgcaaacataatgaagaaaaaaattccactgtacccctatgaaggttagattgcaaaaagaatatctaactgacacccagtacttaatcatgtgaaaggagaaaaaggtacaattttatttcagctctttaaggtacatttccaattattagctaagtacaatcagtaagaaataaaaatcattttagttgaacagtagttttggaaacgcaggaaatggaaagtttaatggcaagtttggttctgcaagacatattttagaattcatttgggctggtagagatacatctagaggaagaaaaagaattgagaaagaagaggttattggaagagaaatgtcagatgagaaaatctcctttattgcattgtttactttgttttaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgaggtgagctgttattacatcagtaggcatttccttctttgttgatgtttcttattcatgtgttttaactttttcttctccagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggtatgtgctcataggagatttggcaagcttggaatttgtgtattgttggatagtagcatcgtgtgataaatatataccatataaaacaatatggaggcgtagcttgctgggtgctgcacatagccattcaaaggcgaaagaacacaaataattcttctgtatttgttttacaaattcaatctgaagctcttcctatcaattctttacaatgtggtagcaaaatccttcctttttcttttcaccaacttcagcaaaccatcagtctggggttaggacacatgaaagagtaaaaagaagtttctctctaacttatagtttttaaatgtttgtgaaatatcaaaaatgaagcaccaaaagatgcaaaaattgtttccagggtttagaaaattatattggtttcaaaaatgactgtgacaaaagtattcagagaacttcaggggggtcttcccccactcagttttctagttttctttttcttttttcctgaaagagtgctttataattctgcttcatttattccttccttctagaaatgtttactgagaaagttaatggcttgatgtcatagagtttgtaaggttcagaaacatgacacattttgtcttactaaaatatggatagttttacttcaagtaattcttggtgaaaatgaagaaatgttgaattccttatggttcagcagcttatggctccatttgtaataaaattttagaaacattcacacttacagatttaggatgaattattgtttcttgtagcaatataggtgcatctcataaaataatgttgagtaagggaaaccaaacagaaaacattacatgcggtatggttccatttatacaaagaagaagaacaggcacaatggctctatagtgttcaaagtcaggataatgactgtagaaggagggcagtgattagaaaaaggcacaaagggccaggagcgatggctcacgcttgtaatcccagcactttgggaggtcaaggtgggcaagttgcttgagcccaagagtttaagaccagtggggcaacatggtaaaaccctgtctctacaaaaaatataaaaattagctgggtgtggtggcatgtgcctgtagtcccagctacttgggaggctgaggtgggaggatcacctgagcctggaagatcaagattgcagtgagccataattgcaccactgcacttcaacctaggcaacagagtgagaccctatctaaaaaagagagagagagagagaaagagagagagagagagagaaggcacaagggacttctggggcccaggaatgtttcacttctagatctggatactggttatgtggctgaattcccttggtgaaaattccttgatattgctgtatactgatgatttgtgcagggttttttttgtgtaaagcatactttgatcaatattatacatgaaaaatatgtatttaattgtcctttgtatacatacattcattcactgtatgcattttccaataccttaaaaatgtttaaatttgaaacactaaccatggtgatttctatgaacatatcaaattatacatagtattttataaagtccgtagcctttagagttgtaaagggcagcccccagatttcacttatctatttttctcccagaatttccattgagttaggggaggaacattttttattatgggtctcagattttgtgtgtctacttatgagtctctttcctccgtatgagcctcaatttgagtaagtcgtcaccaggtaatttctggctggggagcatgaagtaatagcatttaacttaataaggattgtttgaccacctcccatttgccagcccctctgctaggtactttcaatgaagagagatttgagacttggttcctgccctaaaggagcctataatctggttggtaagacagacacatcagcaaccttaatgtaatgtgataagtgccccactgtgtgagaactaagtgccatggtagcccagaggacagagagattaattctgccaagagcttcacacaggaagcagtgagtagggtttgcagaagcagggatgccaaaaaaagagcgggtgctttccaggtagaggcctgagcaaaaacaagtcttgttcaggggaacagggagaccagtgtggccagggctcaggagcaaggctgggggtagtggggaatgaggctggagtatgaaaaatcttccggggcctcaggggttggggctgtatatcagaaggtaatcccaagagaaggcaagtgagggactggaatatggaggcccagtgcaatgagactcttgccaggtccaaggaagagggcctgggaccttaaccaggtgccaaggagggaacagatttgatggagtgattaaatgggggtctctgagagagcaaggagggacaatgtaggctggaggcaaggtacaagacagggaacattgggagagggacaggtagggcagagagacagggagcactggagaggtatgttggcagacttggagttgggagaggcgtaaggaccaatgattttcaaaagtgtgaggttattgaatgtatctttgatatttagaaaccaagggagtggagttggttcatccctggctttccatagtcacgaatgcacataatttttttcagtgatttttttcattcaaaatataactttaaaaagcaaagtgttaatatgaactgatctttaattgttaatatttgttaagaaatgttacaaagccaaacaatacttaaagaaatacaaatgtagattcacatgatatggtttggctctgcgtccccacccaaaactcatctcaaatagtaatcccagtgactggatcatggaggtggttttccccatgctgctttcgtgatagtgagtgagttctcacgagatctgatggtttaataagtgtttggcagttcctccttcactctctctctcctgcctccatgtaagacgtgcctgcttccccttctgccatgattgtaagtttcttgaggcatccccagccatgcagaactgagtccatttaaacctcattccttcataaattacccagtttcgggtatgtctttatagcagtgtgaaaatggactaatacatcacatttcagttaatgccttactttccttcatttgttaataatacttatcttttcccttttcttcagttctgctttcaagttagactttgattctttctctcaggtctctccatgtcttggaaagccctaacttattcaaacatcctaccctttacacacaagcacacacacacccttatccatgactgctttctgttagtcgcacagaagactggaagtcaactcttcctgcacactaatcacttctctgctctcttttcattctcttgacatgagggacaaattactttctgttccacctcacttggccaaatctggcaaataaagattacagctactccatacatgttcccagggagtgtgcaaacagatagagtcctttcccactggaagcctcgctggacactatttgacatcaacagttgatctcccaacatgaatgtatctcctgggttttatgtcctctaattcagtcctcttcaatgaagtaatttctttctttggttcaaaacatttaagtaaatggctttaaataaaaaaccctacataggcagggcgtggtggctcacgcgtgtaatcccagcactttgggaggccgaggcgggcggatcacgaggtcaggagatcgagaccatcctggctaacacggtgaaaccccgtctctactaaaaatacaaaaaattagctgggcttggtggtgggtgcctgtagtcccagctactcgggaggctgaggcaggagaatggcgtgaacctaggaggcggagcttgcagtgggccgagatcgcgccactgcattccagcctgggcaacagagcgagactctgtctcaaaaaaaaaaaaaaagaaaaaagccctacatatttaagtaaaacacagtgcagtttgtataaaggctgtagtttcatcacaaatatatatgcagtaatcaaaatcacctggaccataaggaagactatagaacacctgcaaaggctttattcacgtgtgattgctaatgtttataattgtataatgcaatgtggcatctgatgctgtttagtgtgtttccctcattgaccctctggtgactgctccacaggcctaagtgactttgaggtccgtgctacctcaaggacaagtgacatgccttgcttgcccctggtcagcacctgagcttctgctgtttgtagcactgctgtttgccttatgggtggcctgatattttgtctgtcatatttgaagaggctgagtcagccaccgtggagctcatctggcattttcagcacccctcacaatcatttctgtagcaattgatgagctcaaccatgtggcaattagactggatgattaaaatagtcaagctctctatatctgtgaccctgtgatagttttttcaatgtgcagcttttttctgtgtgtggatttgtctcccagcagattactcaggccaggggaacctttgtgctccactgggttttcccagcagttgttggtgcacatcttcccacattatttaagattgtttttctcgggtgtcgcaaaggatggccctggtctgtttttcccgaaggtgcgccttttcagtgcatcgtgtaacatgatttagattctggtgcatgagcttgcaagtgtgtgtacatgtctgtgctgtgtgtggggatgtgtttaaacccaaagaatatagtcgtaatgagcctgacttcaggccagggtattgactgcctttcagaacatcttaattgatagccatgctttgccatttgatgttagctatgactcacaggggctgctaatgaaatggaggcagaggctgagtgtgttccccaggtctcacacctctatagtagattgaaccatgcagtcccgttattttccgaacgtttagctcaatctggagcttgatgccatttagatgccaaattgtgcccacttttttctgttatttttttctcagtgtcttgacaagccatgccagtcagttgtgtcagatatcagtgacaacttcttccgtaatgcaaatcaagatttttcagttagaggcaatcctgctggatcaaagagatggatcatttttgttctgttatcttgcattctgtaaaaataatctacaactttttgcctgtgtgtgtgttttcagggaaacatcatcaactagctacaatctctgaatgcttgtcttgaagagttataaaagtctgccgtttgtggaggtgggaaagtgtgccaaggactaatggacctttaagattggaagggacttggggatagcttctaatctaatagcaattctaagcatgccccagtgccactgtttgatgaatgagagctacccttaaacatcttgggaaatctaggtgagtggacctcaagtcctaaacttcaacgtgagtgatagcactaacctgccctgtccccaaatcacagaactatagaaatgcctctgagtgaataacaacccatcctccttgactttctgtgtgagcagcttttacgcactggccttagacacaaccacatctcttgtaattccagtttctgcatgtgtttaccttccttagcaaccacctagtcctttgtaatctggctgggctccatcactgtgctgaagctgctctctccacggccctcatatctaacgacctccctgatgacatcattgcccttgactagagctagaatgctgactttgaaaactctcatgccttggtttccatccatgcccctcctctgatctcttcctacctcagagctcactttgtgtgctcttctcggcaacttctgtccttggcctcggccccctcgttgatgacctcagcctatgagtggctcatctaatgtcccactgtagcatgctcattcctcacttccacctgccaagtaggaatttcatcctcctgcaaaggtcaccagagccatgatctgcccatcttcctcctgagtcatctgtgccaggattctgctgaatatgcttgtgcaccatcctccaggtcacctggactcttgtgaatgggctcctcatgtcaaacagtgtggaagagggaaaccaggacagcatggtgtcatggaaggcaaggagaaggagagtagtaagtaagtagtggcaggtgctccaagagggcaagtaagatgggccaaaaatggccagatggatttttcaacaagaagactgttggcagaagtctcagtggaataggtggggaggtacaggagtctgatttgggggtgtgtgagtgaaacgaggaaatggagactaggtgagtatgcataacatggataattctctcaagacatttggctgggaagaggagaatcaagttggaggagtaggtataagaataaaaagttttctttctttctcttttagtgataggagaggcttaaacctgttcaaatactggtgggaaggagagagaaagatagaaaaggggttgtgggaggaatgaaggagggagagagagctcaacaatcccagggaggaggtaaaagaggcaggaggaggtggacacagcactcacagatggagaaatgtgctccaggcaggcggcacctcgcacactgtaacaagagtaataaggaaggaaagggcatagatgcttatggtgatggagcataggtaggcttgctggcaagaagttaagggcattcccatttgatgctttctactctctgtctgaagcaggaggtgaggtcctcttgaaagcaagaagatgttggtggagagatttttaaaagagtggtggaagtttgagaaagagggcagatgagggggacagggaaggactgataagtggccttgagaattctgttgaggctcttcatggtgaactgtggtgatggtggctgtgtgatggtttctagtttcattcagcagcctcgtatagacgtgagagaggggggcatttggattcatctgggattgcggttttgccaggcaagagatgaaaaggatggatctgaactaaacagggaagtaaatgaagaaaagggatggagttgagaagaaggtcataaaaaatgatgaggccaaaggtctgagaggtcagatgctgaatggggtactggagagacccaggtgttgtcagagtgcttaatgggtcgcagcagatgggtatatggcaaggacaatgagaggagggacatgtggccagaggctgtggttgtcaatgcagcagaaattcccttaaagggtggaggaacagctgggaaggacaaggtctttagggttgagccggggcaacctggcggaaggtggaaagaacattctgtgaaaaggtggaaaatatgagagtttgtcaacagagggaacattggaaaggtttgcgagagaggggagaagtgggaggttggttaaagggaaaggaagcataaactagctcaaggaaaagatagttcagggcagaaattacatttttaaatgggtttagctgatcccagccttgctaagacaggtagtcccaactctcctgtttataccgaagttttactggagccaattatgtcctggattagtcatttcagagaaggtgtgtgtctcaaggggccctggaaagagtcagcttgtactagtgacagtcttcttaatattgtgcctgtactcttcccacttgtcaaacttgttcttaaaacaactgtgcatcagtgactgtcaatgacttgtctgcagagctttttacggggcagtggttctcacacctgcctccacagtaaaatcacccagggagcttttaacacatactactgcctggggccccagaacaagtatatcagaatctctagggatgagccctctagaatccatacaatcaattttcttttcttttcttttttattttactttaagttccgggatacatgtgcagaacgtgcaggtttgttacataagtatacatgtgtcatggtggtttgctgcacctatcatctaggttttaagccccgcatgcatcagctatttgtcttaatgctctccttccccttcccccaccaataggcctcagtgtgtgtgttcccttccctgtgtccatgtgttctcattgttcaactcttacttgtgagtgagaacacgcggtgtttggttttctattcctgtgttagtttgccgaggatgatggcttccagcttcattcatgtccctgcaaaggacatgatctcattcctttctatggctgcatggtattccatggtgtatatgtaccacatttactttatccagtctatcattgatggacatttgggttggttccatgtctttgctattataagtagtgctgcaataaacatatgtgtgcatgtgtctttatagcagaatgatttgtatttttttgggtatatacctagtaatgggattgctgggtcaaatggtatttctggttctagatccttgaggaattgccacactgtctttcacaatggctgcggagaaataggaatgctgtcacactgttggtggcaataaattttctgaaaagcttccttggtcattctaatgagtgaagaaccttgaccttggacctttgctacccagtatgtggtccaccagccagcagcgtctgtatcacctgggagcttgattgaaatgcagaatttcaggccccactcttgatctacctactgaatcagaacatgcacttttagtacatccccctcctcaggtgattcccatgaacattaaagtctgagaatccctgccttaaaacaaatctggtgcctgggttccacctccagagattctgattgtatttatctgagctgtgacttgggaattgggagttttagaagattcctgggtgtctctaattttcagcagtttaatgtccctgccttacagcaaagaaccggggaaggtgcttggtgcatttttattcaacggggttgaccaaccctatctttgtttaatgatttctgacctttggtttaatttaccaatgaactacatttgcttctcatttgggggaaaaactgcctgtcttaaactcgtggcaggaacatcatttctcctcatcttcaaagatgctgctgggaagcttagtaactgattagacaggaaatactgcacagcctaaggcctattgcataaggaccagttcatttattaaagaaaagaaaatgttgcttatttttagtgtaaatcattacaaaatgccaaccaactccttataaatttgagaagagcaatcttcctgattagttatttctttcaccttttctaagaccttgtatgaaatgatatttaaagcactcttcagctttctttaagccagctgattgcacaagtcaaacaacagccgtgagtgtgttgaactgttggattactactattataggaatggacacataacaagtgttactttagacctgagtttccaaagtataatcctagcttaaaagggaattttttaaaagaaagaaaacaggaaactgtattgtattgggaggaggctggaggggagatgaaaaaaatcatttggattttgtgtgtgtgggtaagtggggggtagctgtctataactttcattaagtgtttttttttcttctctttataaagtaagctgcaggctttgggttggcaaaccccagggggatgcagaaatctgaggctgctacctttttatctgccttcacggtactgtcctcttcccccagctcctccctgaccctatggaccaggcctcagactttccagctaactgcttcctgtgagccactactctgatatcagcctataaccaaaggagctggggggtccaggcttggtgaccaacccttctcagcccactcaatcagggtgcttcccacctgcaggcaggaggcaacaccctgtctgctaccatcctccccttccagagcccacctgcctgcccagccctgccctgccctgcccagtcgagccataccttgctttgtcccacctgggggtgccctgctcagggatgggctggcagggctgcactcagcttctctggtaagcagagattcaagaaacctctggggtcttgttttctggtcgtgtgatcccaggggtgcacatgttccccttgggtgtctgaacagaagggcctgggagggagggccacacccctgcagtcttgctgtgctggtgtagtgggcagctgcctacccccatcccaccctgcactgtgggctccagaatcggcagattaagcattttataaattgtattttagatacatatttcaaacttgtgagttttttaaaaagaacaagcttgacaagtgttttaagaagtcattatgctttatgggtttgagggggaagaattttttttaaagcatctgatttagaccacatgtaactcagatgtttaaataatcaaatcacctgttttcatgtgggtggtttactctcatgaagaatagaaggttactattgttgaagattttccccaactttttgtttctccctttggagttaaacatatgaacataggaatcatttttgcaccactgatgattgaaatttggtttaggaattattaaaactaaattgtgccagccaggggtgcagtggctcacgactgtaatcccagcactttgggaggccgaggcaggcggatcacgaggtcaggagatcgagaccatcctggctaacacagtgaaaccccgtctctactaaaaaatacaaaaaattagctgggcatggtggcaggtgcctgtagtcccagctacttgggaggctgaggcaggagagtggtgtgaacccgggaggtggagcttgcagtgagcggagatcacgccattgcactccagcctgggcgacagagcgagacaccgtctaaaaaacaatcaaaacaaaacaaacaaacaaaaaactaaattgtgccaaaacaaaagtactgctttcaagctcttatagagaaaaatatatcaatagtctttaaaaattatacaggcttcaaaaaatcagcttttcattccattagacttgctatcagtctacaagaaagatggccattcattttttaaattcaataatgaacagttcattggatttgctaccctttgagtgctgcaaggatcatgctgtctttaggaagcagagacaaaatgatcaagacttgaaaggacatgtatcttctctacgttctctgaacatgggaatggcccattaacgtttcctatctccactctcagactgcaaatatatttaacattttcctttcttaatagtacaaggtaatgtaagtgtgttctagagttcacctcctggcattgctaagcattaggagacttatggctgaagtcagctgcccaacatcattcccattagggagtgcctctccccattagggagaagataagacatgatgtctccttattttcactagagtttttcagagctctgatgatggcttaagtctttgtagcagatgtgctaaataagcgagaatccagctctatcctcctctggcacctatgacattgtcttggtcattgtctagccacaaggaatgaggtcaaatttgcagtttagctggaactttaaatgttataggaaaatttaattattcaacttgtacaaatggatggttaagaccaggattcatgccttgtacattatgaccttgtagattcatagatcagtaatgaatcttaaaacatcataaaatagggttgatttaattccaagtccacaaaaccctactaggatatacagtgtctaatacatggatgcacgctgaatgttgaatggtgaaaatgacattttcatggagtgccttagaatggagaattgggttttattatttttgtcatatataccattgactggaaaacacaccacatgttttactgctaaagtatgggagcctggatgtttaaaatggaagttgcctggcacagtggctcgcatctgtaaacccagctactccagaggctgaggtgggaagatcacttgagcccaagagtttgagaccagcctgagtaacatagcaagaccctgtctctaaaataataaaaaaggaagtcaacatactcacatgctgatcaaatcccctgaagtgactccacacagagcacaggcattgaccagccattgctaccaggcaaacttccactacatttcctgcctcctatacttaacattttgtatcataaaaccagtctctcctactaggcactcggtttcatgaaactatagctttataagaatcttctataaaagtccttcactcagctgctttggttgattggtcaactcttcttttgggttaatgcaaaggcccttctttaccacacctaatcctattttagtgggcactccgagtaaatgtgtcaagatgcaaataaagccaaaccatttgaatttttatttaaattttcagtggcttctctccatccacagacttaagtccaaactctgaccttgaaaaatcactgctgtatcttcgttctacccttatctgctgtcactgactccacactctctcagccatccatgtgtgtgtgtgtgctgttcctttacctggaattgccccatctggcaaactcctatgtagctctcaagagtcatcttccacttcatcttctcaattacgctttccctgagttgtcttcccgagtagttaactttgttcacgccttttttcataatgacaacgttgtgtcaatgtccagcctcccccacactccctctggactgagctccttgaatgtggggcccatggatggcctcttcatctttgtggtcatcccacatagtgcagggcttggtacatggtggccacttcagcaaggtttgacagagcaatgaaagcatgaccatatgagtgcctctccaagtgtctcatttaataatggggagaacttgactcagtaaagccaggctaggacctattctttctttccaactccaagggatctcgactcagtgcttataattatgccttgcaactctcccctcccccaactcccattcaaacctgataaaatgttcacttttgtgttgttttgtgcatacattggtatgtgctggtttggttctcagagctcactaatctaggagtagcgggaacacacacattataaaattttactcattggagagctttatgatttttaatatttacatggaggccaaaataaaatatgtagatcataaatatgttttcttaaggttttgaagtccagtttgaagtttaggatatttttttctaacattgattgttactctccaagaaaggcttatcttattgaattgaatgcatggtttgcaaatattaacttcaaagaaaagccacagtgtacgtaactgcatattgtcttaaaatcactgtattatgcacattaaaatatgtagctttcctttccagggtgattgctttgtttggtcaaattgaaagtcaggttttctattttggcattatgccttatttccctagactaaatgaaattgttccattatagcaaatagaagcttgataatggtttgattcaaggctaattggaatgctattctcagaatatttcaccattccgatcttattcctcaatattatattttcaaatagagactgtgagctagaattgggttacaagcctttaagacttgagcagctgaaatctcaggagagtttcaaaccaaggcccagtttgaagtataaacagtactgctttcctgctgtcagcaggcgagaaagatttagctcattgcaggtccccacagaaacgaaacactgagacaaatgtctcccctggggtttggcctcaactccttttgagatggatgtgtagtttggagattgataagcaagtaacacttaacattgcttccttcttgtttttaaagcagattgcaacaaggcttcaacatctcttctttttttctttaaggcttcctcacagcaatgaggcaagaagtgacccgtgcccacaaaggctgggcactggacactgtgaccatccacaatgaagttctgagacagaccaaggaggagatcacgtcaccccctggggtaggcgttgctgggcaatagcagggaccattctggagccagagctgaaatttcaagttctgcttaaaactgagctatgagtgccttggttaggtccatttgctttgcagtgagggttccctccatcatagccagaagacatcagtgccaaagcctcccccatctgccagagtggaagattaatgacaaggtctaatgagctcttagaactccgtagactacatttctacaaaattacaagttacacttgtgtttgctaaaaaggctttttggccaagtgcggtggctcatgcctataatcctagcactttgggaggctgaggcaggaggattgcttgagcccaggagttcaagaccagcctaggcaacactgggagaccctgtctccaccataaacaaacaaacaaacaaacaaaaactagccagtcgtgatggcacacatctgtagtcccagctatttgggaggatgaggtgggaggattgcttgagccccggaggttgaggctgcaataagcagtgatcacaccaccagactccagcctgggtgacagagtgagaccctgtcttaataaataaataaataaataaggcttttctacacatctccagctactgctgtgggctactcacagattctactgtaggcagcagagcagtgctgagggcagcagagatgaaggggactagcaggttggagccaggggccagttccaggggtgtcccctttgagtggaaaggaacatggctggggggaagagcccccacttcctggacactgatctgctcaatgaatgtgggaaaattctttaacttttttgagtcttcacatcttcatctgcaaaatgagcatgataattcaaccttattaaaggagttgtggccaggcacggtggctcacgcctgtaatcccagcactttgggaggccaaggcgggaggatcacttgaggtcaggagtgtgagaccagcctggccaatatggtgaaacccgtctctactaaaaatacaaaacttagcctggggtggtggcaggctgtaatgtcccagctacttgggaggctgaggtgggaagattgcttgaatacaggaggcggaggttgcggtgaactgagatcccgccactgcactccagcctgggtgacagagcgagactctgtctcaaataaataaataaataaaattttaaaaaaggtagttgtgaagatttaaatgtgatcatttaggtgtggtgctggaccccatgtagactctcagtaaatcagtctccctttccctttctctgattttcattccctcatttgtcaagtaagggggctggaccagatgatttccaagttctagccaagttccctgccaccttataacgagggccacgtttccttcagtttccagtattatcttccacattcctgtctgaggcctcaccagaagcaccttaacctccaggttcccaccaacaatctcttttaggcagtttcaaaattcctccagcctctccccattatgcaattccagaataccttccacatctgtaggcatttgttaccacagcatcctgcttcctggaatcaaaatctgtgttcctttccaaaggctgtcataacaaagtatcattaccttgggtggctaaaaacaacagagatctattctctcattgcttaggaggccagaagtcaaatcagggtagggttggtttctactggaggccccaagggaaaatcttgttctaagcttctctcttcgcctctggtggttactgacaatctttggctttccttcatcattacaatctctgcctccattctcacattcatctgtataagtatatatatctctgtgtcctctcctcttcttataaagttaccagtcacattggatttaggacctaccttaattcagtatgtccttatctaaacaatgtgtgcaaagtccctatttccaaataattacattctaaggttctgggtggacatgaagttttgggtgacactattctatctaccacaccttctcactgactttttaaagttctgaggctgaaagcaccctggagagggatacaatttaccatatgatggcttttaagtggtcccattattcatgtagttgattgtcacccactgagttaatgatggtaaccatatgtcctgattttctgggactgcccatggttttactgtcaaatcatgtgcctccgtttttggttcaaaaaacacagtcctcacacggtgagcccccacagggggattccagaaacactttgcaatgaatcttactgtctttcgttctaatcagcatttacttccctgatccgatcctcactggagatggaaaaacggtcaccatcctctacatttacctatttggtgagctggcatgattgttggagcctcccctgtgattctccttcagcctttctttttttagtgaatatactgcctacaggatccagtttaaactcttcagcttagcacccagatccttccacagtcaacccctgacttcttttacaaccatcgagccctctgataaaggaaatactggggcttttccggctcgccctgcctttctttgtagtgttacttctgcctgtgatgcctacgctctctcctctgtctttccaaacacagccccctgctgcaagcccatcaaggcccatcaaggccatcccctctacagaggctcctgagcactccagccacagggaccttgcctcagaattcaccgccctcacccccagaacagttcaccgggcaccaccagtaacaagtgtgtgctgctattcaattcttatctttaaaaaatttttctgcacctatgcatcttatctccctgatttaatgatgaggaaccccagggtagggcctattgtatgagagagacactggggagggtggccagatgctgccctggccatgattcccctggctctaccatgcctggcctctgggggcgctctgactctcccgctagctgggcctggctgtggaaacctcacttcatcctgtgactgagatgaagttgagacacaggttggttggccgggggcaggctgagatcccacctgacagcagctctagatcctgttccatgctcccaccttccaccaactcaaaccagacctctcagagactttcacctccctatagaggtgatctggtgctaccggctaagcctgttgctcagggaggccaccccacacttaaataactaataacaaacacgaacatctctacagcactcatagcctcaacacaggctgcaggagaaaactgggctcagtatttcacgaatgcaatgtacccggtggtgctttctccctttggtagtgttttaagactggtgtgtgttttatttccaaactgacagcctttatgactaattttgcagcacctagtttaaaaaataaatcctattaccttatgcttgactcttccaggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctg

SEQ ID NO: 2483 - DNA, 29324 bp, Homo sapiens
attcttttaatataaaattgtttaatgtttttctttgttgcagtacactcaatccagatgtagtggatgaggtggccagattttttcaagattcttagtccaccaggagctgattccatttgtgtcatccctactctggtcacagaacattcacatctttaattccaaatactgagcgtgatgtaaatgatgtaatcagtatctaacacgagtatatactttcttggtggccactgcatgacatatcaacagtgcagcctcaaaaaaaagatgttttgtaacttggccctttccaaaaataaatatattaggacactaagcttataccttaaatgagggcagaataaatatgaatgaagtgcaagctcctgtgaggagcagtgcatgcagatgatgtacttgcttgtatggtgtggccagctgtaacagaaagccactggaacggcacagtgcctcctcacaaagcccatcctgggtatcatgaggaaaaagaatgacacatagcttggccaggctgctggaacccatgttccagtggcatctggagttcactgtattttcttttttctttctttttttttttttgagacagagtcttgctctgtcacccaggctggagtgcaatgatgtgatctcagcttactgcaacctctgcctcccaggctcaagagattcttctgcctcagcctcctgaggagctgggattacagacacgtgctaccatgcccgcctaatttttgtatttttagtacagacagggtttcaccatgttggccaggctggtctggaactcctgacctcaaatgatctgcctgcctcagcctttcaaagtgctgggattacaggcatgagctactgggcctggccagttcactgtattttcgaacaatttccaacagaaagcacagcagtgacgtttccttactggtcactgctcccgtgctgtgaggcctggagctgatcaaggaagcttacacatttcccggcctgagcagatgaactctagggttgctaatctggggacgtgggttccttcaagctctttgtgatgagaaggattttcatcctccttttctcactgccgatcgtgcggtagagagagcatcttcatttgaatgagagcttcagtttctgcttgagcctcaagccctatttctgagcgctgctcctctcacacacgtctccaatctgcagtaatgctcaaagaaacagtctagagctgggtgccaagctccggcagcaagaataagccctacctagttatgtatgatcaggagatcttccaaaggacgtaggcgagaggaaaaagcttattttaccaccatgcagacaacccatctaaaatataacccaggaaattatagcttcacaatattctggatagtatcaaatagataaatccttcaaccaaaagcaaatacggttcccttgaggaaaaacagatgtgaatgttgtggtctattggcaataaataaaacagtaccatcggtgctataaaaacagacaatcagcgtgacatttaatggagttagttattattgcttctatttagtatcatcacagattacttatcgctgccatgaagtccataaaatgtgtgactacctgattcctgggcatctaggacagggtcttttaacctgtcaagtcagtttcattatggccaattttctagcagtggttggggatggggagaggagagctttgatttttttgtgtgtagaagaactttccataagcctgtttggctcatggacatattttacaatgtaacctccctcagtcactcagaggggatcaagaagggccccctaaaaccaggaggacagatctagttgggcagcaaaatctggctatttctagaaatgctccctctccctgcaactgagcagttgtcccctacaagccactaaagcccccaatctttacctgtgaacccatctcctgactctgtggaatgcctgcagaggcatggtagggaacaaccgttcagatgttgatgagccatgctaggcacgtctgtgtaaatcatggccatgcattgggatgaagaaactttactttggaatctgtttaatgtagactctttttttttttgagatggagtggagtgcagtggcgtgatttcagctcactgtaacctccaccttgcaagttgcagcgattctcatgcctcagcctcccgagtagctgggactacaggcatgtgccaccacacctggctaatttttgtattattagtagagatggggtttcactgtgttggccaggctggtcttgaactcctgacctcaggtgatccacctgccacagcctcccaaagtgctgggattacaggcttgagccagtgcacccggccgactctctaccagaaacttttcttccaatatgaaggaagcatggagtgtaggctacagtcacttaatgatccttccaagttcagagtcatgataattcaggcagctcagctccacaggaaggcccagaaccacacagcccaggcagtgactgaattcttcctagtcaccagtggagggctgcctgcctgtgagggacctcttattttgtgtacagaatttatgttagacagggtcctgcttcctaaagagcagcagggatgttgtcctgaacagatgcaagattgccacagaaaagatgaggggtcatggggttggggaggacggaggcatcctcgggaaaggttctgctttgccagtctggctagaatcacctgagacatgaggatgctctcccactttctacttgacactcagcctaccgtcttgctctgccactacaagacctgggtcatcctctctgggccaatgttctcattcatagaaccagggataatacatctacttcagagttgtgaggaggtttaagtaagaaaatatgtgtgagagcccctgcttttatagtaggcactcaataaatgttgaatgaatgaaaaatcatctcaaatcacaaactataggatactgggttaaacaaagtggctgctggggccaaagctagacccccatatccaaggagagaggatctgtctcctctatctctaggcttgagcaaacagcctggagagctggcaatgcctcctcctgggtctgaccatctgcctctgtgggatgtaggaactcagcctaagtgcgatgacaccaatgatgatactgaggggaaatgaccgaagggacattctctgggttctatgatggagtagggaggcttcgtggaggagatgaggctcggtcttgcattataccttcgccctggcccccgcctccagatgctgctcagtagttttaatttctggactctctaaaggagagagggttaaggaaataaaggaatctcaaattaggcagtttgctaatgctactaactgagcagagattggaataatagaaaactattgactacaatagtttaaatttctccatattcccctagaaaatggaaagctgggcaggaacatgttccaaaggctaaatcttggcggagatgatgactctaatgaagggagaggtataattcttggtagacagtgtaaataactaatattaagctttggctaagcctaggaatgcctggttcttaagacttcactgaagaagggaagaaggaagaaagcatggatctgctctgggatgccctgaactccattcacataggcagggtaggcatggagcagggagacggaatccaatgccttgccattaatttaacttagatgaactactcctggtccctggagccactccccaggaaggatcctgtgaagacacatctggctctcgtgcccatgctcctgccactctgcccaaccaacgaagttagcaaatagtaaagtgttcatcattacctagttttgtattataaaatggaatcaggaacataaataggaacaagtagcaaaaccccagccctgcgtaggaccattatcctctcagccacctctgcgtaggccaatgagtttggaaagtttctcacagttttcaagtttcagcgactctgctttctgtttcaatcgttcatctctgtataatcctgccaaatttgtcagctctgactctgaaagataaaagaggtaaccaattcatcaagagctgaactcctttgtttcatttcaatgtttctggagtcaaagctccttttacttcatttcaagctttttcttacaattaaatataagaaacatttagtcatttattcacaaaacacgtcttaggtactagaccaggtgtggaggattaaagggcacctgtgaccctgcagtccaacagtatctgtgctctcttataaaagcactggacttagttcttaccaagaaaacatttggcaccagacttaggaaacctgcgcatgtgcagtgagaccaccctatagcctcctacaaacgggattccaacagcagctgggagagaatggagtccagtggcctattcctgtcatctgaaacagacagctgctttattcttctcctgcattgctgcatcataactcacatgtgcgaaggcacacagagcctactgctgccgggtgtgcgtccacagaaggccagggcactactggcgctgttcattccctcaccacacgtagggtccccaactcaaaggccaaaggcagctgggcctttctaaaagttgaatcatctggatccggtgacctttgtctccttgactaaattaatttcattttctctttatggtggagaaggtcattctatttttaaccagaatataatctctgctgtgtttcctgactcaacagtggtttggttgcctctattttttattcttttgtgaggtttcagacatattcagggaggaatgcctgaagagcacctttagagacgtattgcgtattaacaggatggcatgcttggatgtggtgtgtgtttcctgaaagcctccaacagcaggcagctactcaatgtttaaaggaccagacttgtaaaaatgctattttaattgttttgaaatatgcctatctattcttaatcatcttgctgacagattttgtttttcttggtggaacgaaagacacctgtctgattaatcagcaaactgcctggaaacggaattattatttagccagggggaacaatgggcattgctttctgaatacgtttctatcaacacaaaacactgtctggcatttctgtgcacaatgatgctatttacccccaagtaaggcccaaagtgcagattaagtgcaggactccagagtgagggatggatatgcataaaaaccctccctctacaatggaggccgcacagcctgggctctagcccagcagttgcttggcaagcagtgggtctcccaggctccagaacaatgcgctctccctgcttggtgagggtgcctgcagcgcctgctagccagggcttgccttggcacagtcacccttgcaggtgatggggcgtcatggaggatcatgggccatatccaaatgaaagctctctgctcctgcatcctgcccagggctcggcactaactccaatctcaggctactttggcatgtgggtaaccttgcccaggaggcctctgtgaagtcagtctatgcctttagtcctctggagtcacagttacaccagtattgaaacagattctgtggttttgcttttctttgaaatgatttcctcaggttttccatttgctcagcttttctaaatgcttcattccctgaaatcttgttccaggaaacattaagggctagtgactctttatattttctacattgaaggccacttcaacaagctgatgaaagataactgcttttctcaaaatatcacattgcttttcataaagttcactgaaaccagctcagagacccctgctccagagcaatgaccttgtacaaggtcagtgtttcaaggaatcatgtcccacatccccactaccaagcttaaagcaacttctctccaaactgccagtgaatcctttcatccttcaatgaacaaagggtcaacttgaagaatatgctacttttgacaaattctgttaatattcaataaattctaagtaattaaaaaaaattttggggagtggcaggttccagagaataccttttcttcttagcagaaagttccccttcctctgaatgccactgtaacagatggacagagcattgagccttaaagataaactgactcaggcaaattgccaagagaagcaagacccagaacctctcctaaggttctctgcaaaagagcccagattggtctcaacagctgaaagaccgcaacagatcccaactgccctcatgatccagccccatgagatggtgctacatccagtctacagtgcaaagccaggtaaagccaggactccaccagaaattaggcactttctatgtgccagacactgtgctaagagttacacccataccatcttccataacccacacaacctctctaggaggaagtggattctatccccatttcaaagcctaagcttctacccactaggttatcctgctcaagggtgtggaaagaagtgctcctctaccagtctgggccaggagctcagctcagctcagctaggccaagaggcagttcctgcctgctaccttcgtccagcccagcctagtggtgtggccacttgccctggcatcaggcttactatctagatgcagctgcgaagaagtaaacaggacaattagtgtttatagtaagggattactcataaaggtttgcccagattggccgggtgtggtggctcacgcctgtaatcccagcacttcggaggccgaggtgggcggattacctgaggtcaggagttcgagaccagcctgaccaacatccttgaaaccccgtctctactaaaaactacaaaaattagccaggcacggtggcatgcacctatagtcccaactactcaggaggctgaggcaggagaatcgcttgaacctgggaggtggaggttgcagtgcgccgagattgcatgactgcactccagcctgagcgagagagcgagactctgtcaaaaaaaaaaaaaaaaaaaattttcacccagattaaacattctaaggaagagcagagaaaaataaatgaaccaaacaaagatttaaaaagtcaatggctaaccttgctaaaaacagtttgcatttggtattttgccaagagtgaactttgttctcaagtgggtttatttttacaacctccaagtgctaaatttaaccttgttggctgcacttgctgctggattcggagggcagatgctgcttgttctcaaatggcacttgggttgtgtggaggctctgcatagccgctgtacttaaatgccagaaatagatttttaaggggtttgtgctgataactgccatttggaacttgtgggtacacgcatcatgcttactcactggattttttttttttttttttttttttagatggagtctcgctctgtcacccaggctgaagtgcagtggcacgatctcagcagactgcaacctccgcctcccgggttcaagagattctcctgcctcagcctcccaagtagctggaattacaggtgcgcaccaccacacccagctaatttttgtatttttagtagagaaggggtttcgccatgttggccaggttggtctcgaactccggacctcaggtgatccatcctccttggcctcccaaagtgctgggattacaggcatgagccaccacacctggccactcactggatttttatttatacctggagagtgccgaagctctgaactaggcctcatggggatggggacaaaagctgagaaactacctctggtgcaatccttaccatgagctctttgtataattccagcatcttactgccacagaggaagatgtggggcaggcgggtgtttgaagaatgtgaaatgcagattttcatccagttcttgcagaaagcaacaaagtcaaagccctcccaggacccagacaatggggattttcaggacatacactggctttcacctgatttggatccatgtatatactgcctttttattgagacaggatctcgctctgtggcccaggctggagtgcagtggagtgatcacagctcactgcagccttgatctcccaggctcgacctcctgagtagctgaaaccacaggcatgtgctgccacacctggcttatttttatactttttctagagatggggttcccaggctggtctcaaactcctggactcaagtgatcctcctgcctcggcctcccaaagtgctaggactataggcatgagctaccatgcctggcctatatactgccttttaatatgaggcctttatcctgctctaaaattctttcctgatttttgattcttgtaaaatctagtttagcaatggggtagagtatttcctgaatcctcagtgtttttcaataaattggaatttcctcttcctgtttaatttcctcttatatcccagagtcattgctcaccaacttcctaatgcaccttgagagaacattaggactttgccgtacagaaatagggggcagagaccaggtccctaagggtgagctaggacactaaccctgctgttgttattcacaatcctcagcattttcattgttttctactcctgagaatcctctcttcaaaagacatttgttgagcacttgttctgaagcaaggactgtgccagaaccctgggacacaaaattagtaagaccaagttcttattcccagacagtccatagtcttgcaggggagactgacatatatccctggaactctaacactgtgtgattggtactatgttagcaggctgaacaaagtgctttaagaacacagaggaaggagagcttaacttgagggcggggttgggagtgtgtgatggtcaatgagggcttagcagcactgtgactgaagagctaattttatcagactccattaggtatttaatgatactcagtaataaggctttagaaatgagtcagaatttgctttttaaacatgagccaaaacttcagttaaaagggtacctcctgaaaaataaaaaagaaaataaaaataatcaaaaccaagttttagaagacacagtcactaacgcggtatgtgtgtgtagaattcaagtgggaccaaaggtgaagctgttggctgagacggggctacccctgctgcagacactcctagtaacacttgctggagctgtaagccagtggcagatgctatcatccccactgtctccagagagggaaataggggggaaggcctgccacacccaaaggggcagacccaaggggtcgcttttgttctgtgtggccacaaccagctggaggtgagggtaggggacacctcattccataccagaaacctctaaacctttgttctgtttcaaaaagttaggctggctcgatcagatttccctctagggagtgtggaattgggaaactgtggaccaaatcagcgagcaccaagaacttacagacgtgtgtgctgcagaaaggggcactgactggtgagactggggaatttgagagagtgataagcagggtggcaaccactgtaaaccatggcaaacaaggttatgcaaaagggaagctggaagaaagaaaggaaggcagctggtggggagaggagagggggcagattggcagagagaggtagagactcaaagagagacagacatacagacaggtgactagtgccgcctaaattcctaagatttccaagtcctggccacatgtatcctgtcaataaatttcccctacttttttatagtatcctgaatggcctttgtcctctgactctgttcacataaacatgcgtagcctcaaacaagaagagaggagggatcaggaggctgggggtgcctcctgctgggaaccacagccaccagctaatgccccttttacagtatcttactttgttgtttctccttccaacaactagtctggatataatcaatgtaatccttctctattgttttctccaagtcatgcagagaagctcctctgtaggccttgtcaaagtttttatccacaaagtaaggcacctgcaggttctgagtttctctagaaatggtgtagcccaaggtcctgaaacaaggagagagaggctcatgtgagctcataatatttggcaatattactcttagcactgccctcacagatatcatcatcatcatctgctcatagagcagaggcagatatcattttctaatatacccaacacttcttatttccctagcaaagttgtaagtataacatcatcataattgtattatgtaagcaagttcatactatgaattcagcttcagcatagtttattctcttaaaggactcacctctcttatactgctctctgtgctaaaagtagaatgctgaatgcttaaaacaaacaatttttacgttgtgtaggatctagtatggtacctgacagagtaggctattataaatgctggttgaatgaactgattatgttatatagcaaattatttacaaaaaaaacagatagctcacaccaacctagaagcaatattttggacatgataaaaagtacttcgcacatagctgctaactgagaactgcaagaaactcagacaaaagatttcaatgatgctttagagctaactctctgtgggtccaagacatccaaaggtatctggtgcttagcaacattaataagagtactgagctgactaattctaaccataaggaaacatagaagggacctcaaactcaagttaaaacaatgtgacagaaatggttttcttcaaactggacaaattctacattaaaggggctatattttatttggcctttttccggccctctcctttgatcctctctaattagagtaagagctgaagccatgactgctctcccctcactctaaggttttgggggagcttacagagcaggtccgtgcttaccccgctggcctcacaagaaagaaagctaaagtgccatatggaaaaacatgagaagctgggaaacagagggaatcaggccagtgtggcctgatggcaaaaacctctctatgaaggctaggtgcagtggctcatgacggtaatcccagcactttgggaggccaagaaaggtggaggtcaggcgttcgagaccagcccagccaacatggtgaaacccagtctctactaaaaaatacaaaaattagccaggtgtggtggcacatgcttataatcccagctactcaggaggctgaggcatgagaatcgcttgaacctgggagaaggggattacagtgagccaagattgcaccactgcacttcagcctgggagcctgggtgacagagcaagactgcttcgaaaacaaaaacaataaaaagaaacctctctttcagcctcagcttcgctctctgtaaaaggaaaatactagccgggcgcgatggctcatgcctgtaatcccagcactttgggaggccaaggtgggcagatcacctgaggttaggagtttgagaccagcctggccaacatagtgaaaccctgtctctactaaaatataaaaattatccgggtgtggtggtgcgtgccgcctgtaattccagctactcaggaggctgaggcacatgaattccttgaaccagggatgtggaggttgaagtgagcccagattgcaccactgcactccagcccaggcgacagagtgagactctgtctcaaaaaacaaaaacaaacaaaaaaggaaatactgacctggattgacctggaatgatggtcttgtctacagtgatcactgacaaagactcttcctgttatatattgtctaataaattctacttttaaaaggtttttttcccactaaattataataatgaataataatttattattcattattaacaaaaaagataatctagtgattctcaaacttcagtgtggaccagaataatctagagggttttttaaaactcagacttctggtcctacccccagagcctctaattcaatggatatggaggggccctagaatctgcctttctaacatgttgcctgttgatgctgacgatggctggtctggggaccaaactttgggaactgaatcaactgaaagaattaattgaagaaatttttaaaaatcctatcagagtttataatctatacgcaaaaagcattacaaggaatttctctattttcaacaaaaacaaaaaaattgaaaataatcacttgatccccattattaatactatgctccgagacccacagggtccagcaatcctatcaacagcttaacagagtctttctaactctaccatggtgtgataatgagttcatctaaaccttaaattctactgatccttcaaaaaccagttactgctgttctgcagctgaccagatgatgtcactatagaacaagacaatctatttcccgaggcacacaggagactgcctcagtatttttgagtctcagcaccatgactacccagctgttcctttaaacatcaaatcggtgttttctacagcaaaaggtgaaatgaaatgttagtaatgtatcagcaaaaccttcaagtctttcacccccagactgttactgagaaagatttagaaataccagacttacgatttatagaacagactatatgggggattagtagccagcagctgagtaatgacagatataatcacaatcacaagaactggaagtagctgaataaatgcagaatatgtagtctgaaaaagaaaaaaaaataaaaacttgctgtaagtgttcttttttttttttctgtcgcccaggctggagtgcagtggtgcgatctcggctcactgcaagctccgcctctcgggttcacgccattctcctgcctcagcctcccgagtagctgggactacaggcacccgccaccacgcccggcttagtttttgtatttttagtagagacagggtttcaccgcagccaggatggtctcgatctcctgacctcgtgatctgcccacctcggcctcccagagtgctgggattacaggtgtgagccactgcgcctggcctgtaagtgttctttatcaatataaagcttattgaaaataagatagttgctccaaagaaaataacaaattatcaatgcactgcataggaggatccacaaagccccaggcttttctgggaaggctgtactttcagctgagaagtacaggttgggcagtcctaatcagaaaattcaaaatcacaaatgctccaaaatctagaactttttgagtaccaggatgacacttaaaggaaatgctcattggagcattttggatttcctttttttttttttttctgagacatggtcttgctctgtcacccaggctagagtacagtgacacaaacatggctcactgcagccttgacctcctgggttctgatgattctctcgcctcagcctcctgagaagctgggaccacaggtgcacaccaccgtgtccagctaatttttaaatttttgtagagacaaggtcttgccatgttgcccaggctaatctcaaactcctaggctcaagcaattctcctgcctcagttcccccaaagtgttaggattacaggtgtgagccatagcacccagcctcagattttcagattaggaattgtcaaatatataatggtataatgcaaatttccaaaatccaaaaaaaaaaaaaaatctgaaatctgaaatactactggtccaatttacttcagataagggatactcaatctataccaaataacctttactctctctgctgagcaggctgaaggaggtccaacaacaacctggattgacacccagtaatccccctgcagccccattaataagaccaatgaagcaaacatctctaggtaaacctgcccagactgtgcctcttacagtagtggggctctaggagccaggttagcatcatgcttggccacagctgattggactcaggggacatccaactctggcagaggtaatcacgttttctctcctaggaatttggggttgaaactcatcacccttcacttctgggtcatcactttaaggaagaacacacactctcaggcactgtagactggctatttgcaaggggaagtagaacaagcaaagctgcttggtgaaaacaaaacagaggcaaagagtggcaggaaaactggagacaatctgggcccaaagagtcctgcagagcacagctgcttgggagcctgacagtatcccagttccttgttcctgtctgtcatgaggcccagctgtgcttcttgtccttgagcttcatgagactcttttgatcccttaccttaaaccccctttagttctaaatattttgaagaggattcctattttctgcagccaagaaaattatgaagccggagcggtggctcatgcctgtaatcctagcactttgggaagccaaggcaggaggatcacttgagcccaggagtttgtgaccagcctgggaaacatggtgagaaataatctctacaaaaaatgagctgggcatggtggcacgcacctatagtcccagctacatgagaggctgaggtgggaggattggttgagccctggagtttgaggctgtagtgagctgtgtttctactattgtactccggcctgagtgacagtgagaccctctctcaaaaaaaaaaaaaaaaaaaaaaaaaaaaaaaaagccttgatgaagtcagccccacagattgctgagattctgggagagccacccaagaatgggcagagggaggggataccattctgcctatttaggccaattttccagctcttctaaccattgcttttgctttcctaaagcacatctttcctaaagcaacatatctcaggttcaacttctaaaacttgaccatgtaccatcaaggttggccaagtacaactgtttatgggcagcagtgctcctccctccctaggtacctgaggtttctcttcttcctcctccttctgagtctgtgtcctctcatgtcggtgccgtcgacggtaatagtaagtgtcatctgtcacatttgaaaacatatgaatatttcctggaaaagaaatacatggtatgggatatggcaaacactccttccctgcctttttcttttttttttggagatggagttttgctctgttacccagactggagtgcaatggggtgatctcggctcactgcaacctctgcttcctgggttcaagcgattctcctgcctcagcatcctcagtagctgggattacaggcacccgccaccatgcctggctaacttttgtatttttagtagagatggggtttcaccatgttggccaggctggtctcgaactcttgaactcaagtgatccacctaccttggcctcccaaagtgttgggattacaggcgtaagctaccgcgcctgacccttccttgcctttttcaaggtccttgttcccagctaggtttgttaaggatagagtattggcctattttacccagtagaaaaataagacaataggcaagccaagtgaaccagctggagctaaagcgtgctgagctctcctgacttcatttaaatagtcctttgcaactagtgagagagaaccccgaaaggctagaagagagagagcattagggccgtgaatcctatctggcatgttcacgtctgcttccgtgcccaataccatattgtgtcactggtatcttttaatagcaactcataaaattcaatttacttcctgggcattgaattataccaacttccaacttgctggggggtactttcctatcttctatctttgtaagtgctattttacacaacaataataggcattttgttacttatttataaggcacttaaaaatatctaatcctcacagtgaccctgtgaagtaggtattattaacagccccatttttcaggagaggaaacagggtcagagagactaaatgatttggtcaaaattatgcacagctgggggctggagacttgcctcaaactcctgctcaactgattctagatccttgctgtttccatcataccattgtacctctattcagattttcaaacaggagcttgctgagagccataaataaagaaatatgtttaagaatgataatttggggagactaacctgtaggaaaatgtcctccaaagaagacgttgaacagctcttctggagtgatgtcagcttcaaaatccctgtaataattataaggtctggctcgaggggcagtgaaagtcacctgttcatctccgtattcatcatagcgaagtctcttatcaggattgctcaggactgcaaatgcatttcctattgctgcaaccaacaagaaccagcacatgaggacacagtctttgctatggctgagagtgatcacagcagcagtgacaaagagcctagaggtgactcgtgctggacaacttcgcaggggcccaagaagagatgcttgggcctagaaagttctccacagtgcttgcccttcaggttttccctgatcgccagaaacaacaacattggaatcacaggaattaagaacttctgctgcagtgagttaactcccaatcaacagtcctgtagtcatcccagctgtcctagaagttaggaagcccccctcagttcgggttcccagtcaccacaagtcccaggcatgttggggaaatgttctccaactggtcagcactctcattcataaaaaatgtgttctggccaggtgcagtggctcatgcctataatcccagcactttgggaggttgcagtgagccgagatcatgccactgccttccaggctgggcaacagagtgagactttgtcacacacacacacacacaaagagtgctctttactttaaaaaaaatttttttagagatagggtcttgctgcattgcccagactagtctcagattcctggcctctagtgatcctctcaccttggcctccaaaagtttgggattataggtgtgagccctgcatctggccaaaaaagtgttcttatttcacttgagtgcaatagtttatgttggaaacagttcacacatcagtagtgatattttaacttgtagtccaaaaaatttcctgaattctcttctgaaacaatcttagtagaaaccttcctgcttgactaaaaacaaagtcttcatcatagtcttatttcagtttactttagacaaatattttctgaaattaagaaatgtatttccaatgtctcaaggagggttcaaaggctgaatagttacatatgtttaccaacatgtctcctttctatgtacagacgtgcaaaccttgcccaatttcatttaaacatacaatccgtagcaccaatcaatagaaacctcaaaaaaaagaaatcttttaaggcatcccgcactccctacctgtaattcagtcaacactgtcagaaacacagaaagagtatttcttcatgattcttttacctggggaattgttaaatgtttgccttgccactctgttacctacaactctatatatacatatgtacatatgtattgtaataattatacatttattttgctgaaccatttgaaaataggccacagatattacgtcaccttgcccctaaatacctcaacatatatctcccaagaagaaagacattctcctatgtgatcacaacaccattatcacagctaagaaaattaacatcagtccattatcatccaatgcatccatgcaagatcaagtatagcatttagtttcttttaagctaaaactgtcccaccttttttgtttttcattatgttaaattttttggaagaacagatcagtattcttgtagaatgtttcatattgattgtttcctcattattagattcaggtcaaacattttggcaagaataccccataggcgacaactacctagcactcaatggttttagcattcactgaagatctttgcctgtaacaatgacttggagtgcagtggtgcaatcacagctcactgcagccttgacctctggctcaagcaatcctcccacctcagcctcccaaagtgctaggattacaggtgtgagccactgcgctcagcctgaagaatatatttcttaaaatatcatggaggatgggcacagtggctcacgcctgtaatatcagcactttggaaggcctaggcgggcagattacttgagctcaggagtttgagatcagccagagcaacatggcaaaaccccatctccacaaaacatacaaaaattagccgggcatggtggtgctcacctgtagtcccagctactcaggaggctgaggtgggaggatcacttgagcccgggaggtggaggttgcagtgagctgagatgtcaccactgcactccagcctaggtaaaatcaagtgggagctatgctgattatcactatttaagaggtgtggcagggggaaaaaaccctccttatggccttataaaacaactatggggaaggctaaaagcaacttattatgaccaaccatgacaagggcaccattgagcattggttcaggatcagacctttgaaagcatctgttgctccaggagcacagttcttgtcagggtgaaatttcagggcgagttttctgtaagctttcttaagctcttcgtcactagcatctcgagaaactcccagaatttcatagtaatttctgcatttcttgatcctaaaaaaaatcacaagcatgtatgtctataaaggtcccttttgtacaactaattgcaagataatacatcgatcctacctccaatctgtgggacccaaaacaaacctataagaaaattagtgcacacgttaatgaaacattcaaattcattaacaatgtccttctcccacccagaacttaatgcctttcaaagtacttttacatctactatttactcttcctatatccctgcaagtgagtagaacaagtatgctaattgttacaccaaggttcaggctaagatcctgagagatgaactacaggacagcaaagccagaagaaacagttaatcaccctgtttgtttataattttttctctctttttcctatggctatctttttaaactgtattttttgcttttttttttttttttttttgagacgtagtcttgctcttgttgcctgggctggagtgcaatggcgcgatctcagctcactgcaacctctgcctcccaggttcaagcaattctcctgcctcagcctcccgagtagctgagattacagggatgcgccaccagccctggctaatgttggtatttttagtagagatggggtttcaccatattggttaggctggtctcaaactcctgaccttgtgatctgcccaccttggcctcccaaagtgctgggattacaggtgtgagccaccgtgcctggctaaactgtgtttttaaaaagttaacatacacatgatagaagaaaaagagccaacagaactaaagtttatacagtaaaaattttcctgcttcatcattccctgtcccccagtttcccaccacagggataaccatcattagaagttttctgtggatcctatgtacagagagtacaggtatagtcctctccattttttttcttgcctaaatggaaacatattataatcacttttctacatcttgctttaaaaaaaaattattttgggctgggcgtggtggctcactcttgtaataccagtgctttgggaggctgaggcaggaggactgcttgaggtgaagagcttgaggccagcctgggcaggatggtaagaccctatctctatgaaaaattttaaaaagttagccaggcatggtgccttgcatctggaattccagctactcaggaggccaaggcaggtggatcacttaagcccaggagtttgaggctgcagtgagttatgattgttccactacactctagcctgggcaacagagcatgatcctgtctctaaaaaacaaacaaaaaacaatttatcttggagatcaatccttaacatatagagatgagaagtatagaataatagtttagactagacagtagtttagattagagtggcagttctgaacttttgatctcagcaacgttttatactcttaaaaattactgatatgcatggtacaggaagcgaaaaaaaattactgaagacctcaaaagagctttcatttatatgacttctatcaatccacatctactataccagaaatgaaaacaaaaaatttttaaacagtgatgatgtaattacatgtcatgtagcctctcaaaaactccactgtataatcatgagaaaattagtgaaaaagacaagtaacatgtttatatcattatgactacagttttaaacttgcagacctatcccctaaaagggtcttggggttccccaaccaccctttgagaactgctggattagagatgagctctggagtcaaaatgccttggtttagctttgattttgctgtgtacttaacctctatagcttggtgttatcttctgaaatgggctaataattatatttcacagagttgatattgtgattaaataaagtcttcatcaaagtgcttgagagcatttaatactaaataaatattacctagtactatatatctacctcttttttttttttttgagacagagcccaggctggagtgcagtggcgcgatcctggctcactgcaacctctgccttctgggttcaagtgattctcctgcctcagcctcccgagtagctgtgactacaggcttgcatcaccacacccagctagttttttgtatttttagtagagacagggtttcactgtattggccaggctggtctcgaactcttgacctcaagtgatccacctgccttggcctcctaaagtgctgggattacaggcatgagccaccacgcctggcctacctcattctttttaaaatctaaatattattgcattgtatcaatgtataatatatacattacctactaatttgtattgagaaggtcttcagtcttttgctactatataattcagtaaggcaggcagagattcggagcttcgttgggaaattcatcgtaagtcagtaacacaggttggactctaatgcagggtctgggctgtcagcagatcccttccacatgagctgcccatggggagtctttgaatccccagcccagtttccaatctctgcttccatggcagacactcaggactccctctcctaaatttactatttgtttaataatgctttattgagaaataatccacgtaccataaagttcacccttttaaaatgtacaattcattagtttttaaatacatttttagaggtgtgcatctatcaccactatctcatttcaggacatttttatcaccccaaaaagaaactctatactccttagtagtcactcccacttctcccccagcccctgggacccactaatctactttcccctctatagatttgcttattctgaatattttacataaaaggagttatataacatgtagctttttgtatctggcttctttcacttactgtaattttttcaaggttcatccatgttgtagcatgaatctgttcatccctttttgttacaaaatagtatttcattgtatggatatacaccatgttgcttgtccattatcagttaatggacattgggttgtttcccctttggggtcgttatgaataatattgctatggacattcatgtacaagtttttttgtggaagtatatttatatttctcttggaatatactaggagtagattgctaggtcaataatcttaattttcttctgaaccttaagaggaattgccatattgttttccaaactggctgcattcctaccagcaatgtacaaaggttccaatttatctgcttctttataaacacttatcatccacctttttgactatagacattccagtgggtatatctcattgtggttttgatttgcatttccctaatgactaaagatgttgaacaagtttacatatgcttactaaccatatatatatcttctttattcatatatggaggaatatataggaggaatgcctattcagaccctttgcccatttttccaattgggttatttgtcttcttattgttgagttttaagagaactttgtacgttccagataaagtcccttatcagatatacagtttttaaatgttttctcccattctgtgggttgacttttcacattctttttttttttttgagatagagtttcactcttgtcatctaggctggagtgcgatggcatgttttcgactcactgcaacctcctcctcccaggttcaagcaattctcctgcctcagactcccgagtagctgggattataggcacctgccaccacacccagctaatttttgtatttttagtagagacggggtttcaccatgttggccaggatggtcttgaactcctgaccttgtgatccacctgccttggcctcccaaagtgctgggattacaggcgtgagccaccgcgcctggccacagaactttatttttttttagagacagggtagggtccctgtcacccaggctggagtgcagtggcacgatcatagctcactgcagcctccaactcctgggctcaagtaattctcctgcctcagcctcccaagtagctgagactacaggcatgcaccataaccctgagttaatccaaaagaactttttaaaggcagtcccttaatggcaaagtacttcctgacttcacgaagaaaatatcaatggagccagtccagaaaaagggctctcagtgcccaggccttcttgctgtacaaccaaaaggctggcagctggtgttcatcttttccattcaaggctcaggggttagcaactttatatataatggcagcccccatcataaactgaactgcatttgcacaaaatagcagagttagcctatcccttcctgccttatatcctgatgctcacttctcatccttactagtacaatgtcctttgtgacatttcttttccagaatagggcacttttgtctgcactaaaaagttgatgaggtagggctggccgcagggttcacacctgtaatcccagcactttgagagactgaggtgagtggaagccttgagctcaggcatgcgataagtaataatcacatcatggactgtatgcctttcttatagcagtcctgcacccatataaaagcttcattttcaatatgagatgaaaaggtattttgcaaaaagtgcaatgttttcttacctgctggcattaagtgcaggtggatcacaaggccaggagtttaagaccagcctggctaacatggtgaaaccccatctctactaaaaatacaaaaattagctgggcatgatggtgggcgcctgtaatcccagctacttgggaggctgaggcaggacaatcgcttgaacctgggaggtggaggttgcagtgagccaagatcgtgccactgcactccggcttgggcgacaagagcaaaactccatctcaaaaaaaaaaaaaaacaaaactggagaactgcaagagatcactttttactgctatacataatttactcaagagacaaactgctcacaaagagatgattagcatcatgtggcattttaagcagatactcccaatacttgaggctcagcaaaataacaggagctaactacaaaattattacagtagtacagtactactgttaattttatgcaggtgtgattaatactgcacctgtatgtttacatttttctcaaatgcaaatggtaccatgtagtctcaagtgtttgtgagcatatgttttgatagattttcactttttataatagatttgtgtatattttatgatagtaaatgataaaatagactagaatctagatatattttatgcattcatataattttcttaattttttggtatgtccatgctccatggtttgtgagatggtgatgatgatgattattatttgagacagagtttcgctcttgttgcccaggctggagtgcaatggcacaatcacagctcactgcaacctctgccttctgggttcaaacaattctcccgcctcagcctcccaagtagctgggattacaggtgtgcgccaccacgcctgactagttttgtatttttagtagagacggagttttgccgtgttgcccaggctggtctcaaacttctgagcccaagtattcttcctgccttggcctcctaaagtgctgagattacagatgtgagccactttttcaaattgttgcaaatctaaaaaatttttccaatgtatttatcttttaaaattgacatataaaaatccatggttcaaactgatgccactcaaacctgtgttgttcaaaggccaactgtatctcttttttaaaactatttatttatttatttgtatatagagacagggtcttgctttgtcacccaggctggattgcagtagggtgatcatagctcacctcagcctcgaactcctgggctcaagggatccacctacctcagccttctgagtagctgggattttgggtgcatgccaccacacctggctaaatttttatttttagtagagacagggcctcgctatgtcgctcaggctcgtcttgaactcctagcttcaagagatcctcctatctcagcctcccaaagttttgaattacaggcatgagccaccacacccagcctcaactatattttcttaatttcatttttttattgttcattgctagtatatagaaaaatgataatttttgtatattgatcttatatcctgtaactttgtccaacttgtttattagttctaacagtatttgtgtgtgtgtgtgtgtgtgtattcattaggattttccatttacaagatcatgtcatctgtggatgtagttttactcttctttccaatttggatggcttttatttctttttcttgcttaaatgccctggcttgaccctctagtacaatgttgaacagagtggcaagagtgaacagacatacttgtcttgttcctgatcttggtgggaaaacacctagttgttcacctttaagtatgatgttaactgtggatttctgtagatggactttatcaggtcgaggaagttcccttctattcctagttaagtgtttttattatgaaagagtgttggggctgggcgcagtggctcacacctgtaatcccagcactttgggaggccgaggcgggcagatcacaaggtcacgagaccatcctggccaacatggtgaaaccccgtctctactaaaaatacaaaaattagctaggcatggtggtgcgcgtctgtagtcacagctactcaggaagctgaggccagagaatcgcttgaacctgggaggcaggggttgcagtgagccgagatcgtggcattgcactccagcctgggtgacagagcaagaatccgtctcaaaaaaaaaagagtgttggattttgttaaatgctttttctgtacctattgaaatgatcgtgtgatttttgtcctttattctattaacatggtatgttacattgattgacttgtgtgtgttaaacaatcctgcaatactgggataaatcccacttggtgaaaatatataatactttttacattgctgtatttgttttactagtattttattgaatattttaaaatctatatccataagggatattggttgataatttagacttcttatgatatttttgtctggttttggttacagagttaatactggtctcaaagaatgaagccagctgggcctggacttttcttcattggaagtttttttttttttttttttttttttttcagacaaggtctccctctgtcacccagactagagtgcagtggtgctcactgtagcctcgcccttcctggctccatcaatcctcctacctcagcctcctgagcagctggaactgcaggtgtgcaccaccatgctcggctaatttttgtggggtctttttgtttgttttttattgtactaatgaagtttcgccatgttggccaggctggtcttgaactcctgggctcaagtgatcctcccacctcagcctcccaaagtaatgggattacaggcatgagtcaccatgtccagctagaatttttttgattgttaattaaatcaccttatttgttgtaggtctacttgggttttccttttttttttctttttcttttttggaaataaggtctctgtcaccgaagctgcaatgcagtggcactaccatagcttactgtaacctcagattcctaggctcaagtgattctcctgcttcagtctccaaagtagctgggaccacaggcatgtgccaccatgcccaagtattttttttttctttttttagagataatgtattgctgtgttgcccaggctggtctcaaactcctggtctcaagcaatcctcctgcctcagcacccccaaagctctgggattacaggtgtgacccaccatgcctggcctccatttttcttgggtcagtttcagtaatttgtgtctttctaggcatttgctgattttatctaggttatctaatttgttggcacacaattgttcatagtatttggattggtagggatatccctctttcttttttttttttttttttttttttgagagacagggtcttgctctgctgtgcgattatgactcactgtagcttcaacctactgggttcaagcaatcctcctgcctcagcctctcaagtagctgggactacaggttggtgccatcataccaagctaatttttgtatatatatattttttggaagagagggggtttcactgtattgtccaggctgtctagttccttaaggtagattaggttactgatttggagtcttttttaaaaaaataagcatttagagctataaatttccttctaagcactgttttagctgcatcctatacattttagtacgtcgtgttttcattttcactcatctcaaagcattttctagctttcctagtgatttattctgtgacttgcttgcttattaggagcttgtagtttaatttccacatatttgtgaatttctcaaatttccctttgtttttgatttcagagaacatacactgtatgatttcaatctttttaaatttattgaggcttgttttatgacctaagatatggtctatcctggagaatattctatgtatccttaagaagaaaatcgttctgttgttgttgaaagaatgtcctgtagatgtgtgttgtgtctagtcggtttctgctgcctctcttaaagtagaagcagggtagtcagttcatgttataccctaatattccacttctattcagtcttccctctgaggtcaagaagctagtatgcctcaattatcatcatcatcatcattatcatcagtcaatacttacatagcacatccaggcactcttctaagcactttccataaaatcactcatttaatctcaccacatgctcacctttgtaccccaagcagctgttcctcactatacgtggagttcccctcaccctgccgggtctgagtccactcattctcagacttcttttccttttgtgccttcatgcagttacagcagccacaggggtcatgactctcaggaggtgtgtcttctgggtatttgtttcttctaactgcgtcaatgtaagctgcaaacaacagcccctccattaggtctccatctgaccctgaaaatcaactttgcaacctgcctttcctctctgggaggctgctcgtaagcatgagaaggtaagcatgatggccagggctagaggcgtcatgctgacttttaagcactcatacaaagctgaataaacatgtttctctgtggtccgtggtcagaagagacactgctcgtaaaatagtattttttgttgcagtgcctcccacccctaaaatttaaagtagagaggagttcaattcttttacactaacaattatagaactaatatataccaaggaacttggctagaagatcaagagggcggatgggtaagatctactcctgaccacaaagaggttagtttaatgcaagcttgtccaacccgcggcccacaggtggcatgtggcccagcacggctttgagctcaatacaaattcgtaaactttcttagaacattatgagggccgggcgcggtggctcacgcctgtaatcccagcactttgggaggccaaggcgggcggatcacgaggtcaggagatcgagaccatcctggctaacaccgtgaaactccgtctctactaaaaatacaacaaattagccgggcgtggtggcaggcgcctgtagtcccagctactcgggaggctgaggcaggagaatggcgtgaacccgggaggcggaggttgcagtgagccgagatcgcgctactgcactccagcctgggtgatagagcgagactccgtctcaaaaaaaaaaaaaagaacattatgagatttttttttgcaatttttttaaagttcattagctgtcatcagttagttatttagtcgtcagttagtgtattttatgtgtggcccaagacaattcttcttccaatgtggtccagggaagccaaaagattggatacccctggtttaaagggagaagattcaataacaacacctgcagaatgtaaagagggtcataagcaatacagtcaaaaggggcagagcactcatgtcttctctggaggacctgagaaaggctttaacaacatctttcttccgcttaacatccctcagctacctccacccactgctcctggacagtcttcctctaagtcggcctggctaactccgacgcatccttcttgtcaccatttgtaacactttctgcaagaaacctcccttgacagccagtctgcgttaggtaccttgtaagtgtgctctccaaatccctgaccttgctgtgtagcccaggcgttttgtattattcgcccgttttgtaattggctgttcagtcgtcaaactctctcagtgggctgcgagttttgtgagctaagggacccatgtcagtcaaatccccactgcagaatcagcattaggcggggcacacaataggtattggatcaatattttttgcctgactgtagggtggaaaaggctggtcctgatgccggctggagcgacatgatcaaacagggactgaaggtcaggtggcccagttaggcgaaagataagggccaggttagcaagctgcggagagaccgcagcaccccacgggccctccagtcaccttggcatgggcggggcctgacagctgcgggccctgggcggggcacgggcgggggcggggctgggggccggaggcaacaagtcgtcaccggtgactctgggctcgcggtcggtccccagcttccctaccccatccgcaaccctactcaggctcagcatcttttcacaggcctctatccatcacctcagacccaggatctcagcccttgtgcgtcttcaggatcctcatccctgatctctcccgaaggccgccctatccctccttcaggcggggacctagtaccttccgtccagcgctccccgctgcccagagtcgccgccatatcggttcccaatcagcaggtccgccgagcctcccccgtgcccgaggctgaaagagaagggggcgcggagcgcggggcac

SEQ ID NO: 2484 - DNA, 1502099 bp, Homo sapiens
  misc_feature (369735)..(369735): n is a, c, g, or t
  misc_feature (455030)..(455030): n is a, c, g, or t
gttgcagcagagaaggaagtttaatcataaggctgccgaataaggagacagggggaaacctcaaatctgcctgtctgagccgtttaggtctaggtattttaagggagttggagtgaccgaggtgggggatcactggttgaagaatacaggatggtgagatgaagaaactgcattttcatgctgattcagttcctcttggggagaggcggggggcggtcttcaaactggttggcaatagctcttttgctggaattcaggatctgaaaaacatcttaagccatttttaaacaaacaaaggccttatgattctaacatcagaaatcttctctgtaggaacaatgaggaggcaaatggttagcatctggtgctctgggacttttggttacgaagaagtgggccaaagtgcagcctgattaatgcttaattacaactatatttctgtccagaacccagcatctaattcttgttaaccctgtgaggatggtttcaatagaatgtttccattgtccttaaagggaggtatagttagtcccattatactccaggtaatgatgacagtcttggcaaaatcttaggaccctaagttgtttgccacctcacaacctatattatccgtcctagtcttagttaccacatctgactgctgggaagactgagggtgatttgtttggtctgtgcacaaaacctttaaagagaaatacacatgttagttaacttaaaaatccacaggtactgtggcaatagtttgtgtaacaagttagggtaaatatctttctggtaagatgtacaagggaagtcaatttacctggaagacaggaggtgtcaggcctccaggcaagacagaagcaaaaactgacaaaacaaagcctacaggaaatttgggtaataagtttgaatcttcttaaagttcttaaagtgtctagaaaaagcattctaagacaaaactcctacaattcagcaagccttgggaaaaaggctaaagctttctagcctctacctgaaaatacccactgcatagaaaacccaggagaaaaaattcaacctaggcagtcaagtctgaggtattgtcaccccatttaaatttgaacagggcactctaaaatgacatactggccttcataagaggaacagaaagaggtttgtagtcatgcccataggcctatgttcttaggtaaactaaactagcttgatccttaaaaaacgagagagagatggtgaacagtggaaaaggttcaaaataaaatatgaaagacagcctctgttatagcacttgccatatccccccaggcaactgagtgcagagctgacaaacttatgacatgggagaatgaaataagctttctagaatgcaaggatctgagtacaacaccatatttgaacaacaatagggggcaaggtagtctgggtctttaactatttagaatactctaaaaagagggctggggagagaaaggccaagtgcacatatatttaaagctatccagtaaagacttacttacatttcaaggtgaaatcagaatacaatgaatgtgttttctagctaaaaatcatgatcactaagtggttgatacaattttttccaatcaattgctaacagcatttattcactaattttgttttttatttgtgtctgatctacttctgcaacttataacatgaacatatttattcacaggtcagatgaagaattgcctaattttaatttggaattatctaattctaaaaacaaaaaagaaactatttataggagaggatctgtaactggggtccatgggagtttattaacaggtttgccagaaaaaaatacaagataccagttaaatttgaatttcagataaacaagtaatttttttagtctagatatatgccagtattgcatggtaaccctatatttataaacaaatttcagagagatagatacatttctctctctctctctcctgtttttttgaaactgagtcttgctctgtcacccaggctggaatgcagtggcatgatctcagctcactgcaacctctgcctcccaggttcaagcagttctcctgcctcagcttcccaagtagttgggattataggcatgagccactgtacctggccttctttaacactttttgtttacaggccaaacatcaccctcagtcattccagcagtctactatgtgaactgagactaggagggataatatagattgccagatagatctaggcatgagctcgttagacactgcataaaaatttggagtagaagcattttgacaaggaaattggctatagctatctttctaccagagtcttaaacctatgatctctcaacagttagtcatcattaagacaaagattaattctatcaagccttgacttttccctgtggcctgagcttcctaggagccgaacataaagggaaacatgaagggcaatttaccaaatagcaactgaagagaagagtccactcagtgaaagcagaggagtttgcccgggggcgtgttagggaggcagagaaagctggtttacagggctttgcagacagacttgagcctaagggccatgtcacacctttaagttaagttggggttgaccttttaaacaagaagttgtgcatgacagaaggtctgctttgtgaacattggattctggaggagcaccaccgcaggaaagactggagaaaggtggtggtgggctgggggcactggcttggaagaagagagtgaagaggcaggagagttggaagagactgggaggctgggaatacagtactcaagggccagggttttctcccctccagctctttgtcctttgcagccaccacccaaggatgctggtgaaggtgtttttgtgcatccccattctgagagtgcagcctctttcctgaggcccacgggagggtctgggtaatgacgaaatgcagtctttacctgtgtcactgaaagtagacccgcagagctgcggcttctgctgccatttcctcctctgatctccaagaggcaggaaagtcctccttgtcatgtttctggagctttggagaaaaaaaaaggaagaggctctttcatgggcccttgggatctccttgaacaaatttcggggggctgggggagactgaacaaaatttgcaaattagaggccagtaggtgtatcttttaattgtttcagttgctacaacttgcaaataggctttatacaagaatccacatttaaaataatcagatcatttgccatcttgtaatcatctactgaggctgaggggggtgatgatatgatataggtctgtgtccttgcccatatctcatgtcaaattagaatccccagtgtcagaggtggggcctggtggcaagtgactggaccatcaaggcagaattccccattggtgctgttctcatgatagtgagttattgggggaccttattgtttaaaagtgtgtagcacctccctccactctctcttcctcctgctccagccacagaagacgtgcctgctttcccttccgccatgattgaaaggttcctgaggcctccccaaccatgctttctgtacagcctgagaaaccaggagccaattaaactgctgttccttataaattacccagccccgggtagttccttatagcactgtaagaatggactaatacaggtgatcacagattgggatgaagtgggggaatggggagcatttgccattcccagaatctcccccacactcttctaattttcttatgtttaacaggcatcattcatttattttacttcctggattttgaaggcattgagtttgccaccaacccataatcccctccttcaaggtggcctgtggtttacctcctactctctttggtttagactctcttgcatgagctctgagcagttttgttcagtgaaccaaatttatgataatgacacaagggccatgagaactgagtaagtaataagtatttccattaaaagagggttcaagcagggaaacagtaaaaaagagattaaatgagaaaacaacttacaaaaaattaacaatttgtctcaaaattaacacttgaatcatttaaattcctcctcagattacaggcatatttaaaaaattgtgtgtatgtctcagatttacatatagagtgaatacaatttcaattctatcagagaggatgttctcagaactctcttccttagaaatgctcaattttctcccttaacctcctattatgattcaatttcattaactaaatttattgttcctgtgtgtggctctatacattgtaaaatgccgcaggttatccgttcattcttcatgggaatgcacagtgtagtattttgtgttatgtgttaaaagtcatttgggattgagacaatttaatagcaccaatgatagctagcatttatgatgtgaaaggcgcacattatttctttgatatacattatttcgtttaatccttacaataactcataaaactgacgctacttaaccccatgttactgtggaggaaactgagttctgaggaagttcataccccggtccaaagatcacccagctaggtagtggggtaggtgccagtattatccccaacaacttttgcctttttattcatcctgagggatctacagtgtccctaaagagcatcccacagatactgttccactccattttgaaaaaggtcaacttaacgattaaaatatcgactttttaaaagttgatcctttaaaaataattttgccaactcagcaaaaagtctatcaactaataaatgacttttgctatctcaggccccaaactctaaatctaacctagaggcctctaccctggcagcttgcagcagatggagaaatttccccatttattgcagctcaacattgatacagaaggcaaaacagtgagggaaccatagcctcgcactcccgctgagctgtatttccactcctggtaagtaagtttgagcctaaatgaggctcattagcatataaccgggccacagatacatttatgagggtcatggatcttcccttcagaatttggctgccagcacgctgattttacattttgccatgtagatttaattctccttagtgaaagaaaaccacattaagaagtcatttcctttcttgcagaggcaaacatgctgcagttgctacaggcaaggcaaacgggattgctattcttctactcaagaactaattttcattttgatactaccttgacgtctgttataaatccatcttatcttataacaattcaataggatgacaaagagatatgcaaagcccaggaaatatggccttcccacttctgctactgccattggaagacacagaaataaagcattaagtggcctcaacaacacagatcataccagaggaatccaaataatttagagcctgtgaatgttaatgccttcctggttattaggcaaccgtctgttattgtcatatgccttacagatggcaacattgtgccaatccttagaagaagtttttgggaaataataggaaataaataaaacaaaaactaatcatctttgcaaaaactctgttgtacctagcttttaaaagttatgagatttccctcctaaaagccccagatggaagcatgtggttctgtttagaacagcggcactcaaccctggttggttgcccactgtaatcatctaggaagctttaaaaaataaaacccaccccagggattctgatttaattggtctggggcagcctgggtttggggatttaaaacaaaacttctcagccaattctaaggtgcacttactgttgagaatcactgctttttgggagaagtgtgtagatagagcccacacacatatagaaagaatccgcttgcctttaagcacattgcttgtgatcctatcaacagtactactgctgtcctttgcaaaccttgccctagaactgcttttcttctgtttatgctctgtccatgggatgtctggcctacaaggcttgtcttagcaacactaacatgcggatgcagttcagcagcctttgaatgtttttaatctctgcagaaatagggagcctgggaaaggccctggtgggcaagacttgtgtcctagaagatccatccaggtgacttgaagactaaaaatgctacagtttggagtaaagttccatttccctaaagcaacccaagaacctggtggctgcaacttcttgcctggctaacggagagaaagccctaatgatcttaaatagtagtttatccaaaaggcagtatttgccgtgggtgaactttaatggaggagtttcacttctgataagccttctagattactttggctgcccacaggggagggcggtgactacttgttaacacacaagacagttgctctgtctctgtaatgccaggggccagacctagcactggaacactgaaccagacagactcctttattgttctcctggggcacccaggtagggaggttacacaccaaacggctgattcttagtgagatgggattacaaaatgggaaggctgctggatagagctagcctcattgcaaaggcttttgagtatcaccttggtttcacaaagaaacgttatgaaaaacagtgatggagggaaagaggttatctacggatcatccaaaaatggctctccaagaaggcgagagttagttaggtctgagcttgaacaatgagaagaacaaaagttcctttaatctctttgtgtctcagttttcccctttgtaaaatgggagtaggaaaaagagtggtgagcagtgccgtgcctgacacatagttaagtggtatttaatattccctgctgctgctactactgtcagtcattagcattatttttaggctaaataacactgacctaatgacagcgagcactaaaaattccacagaggttgtttctaggagtaaaagtatttttcatctccatggttccccagtgatctgtatcttttggacctaactaactactttgtagaaggattaaaagttatgatcagaattcagatccaaaacaacttattataatgagacactcaaatctggggaggaaatgtacctccttcagctctaaagtgaccctcactaatccctaatcctcagagctgtcctaaggagtgagtaaggtattaatcgaggcttctcatggtaaaagctaaggtcctatggtaaaagaatgtggtggaggtcaaaggtagtcaataccccaggagtatggttgccagatttagcaaacaaaaatacaagacactcagtgacttgttttaggataaggatgtctcatacagtattgagacgacatcctgatatgaaacaatgatttgttgtttacctgaaatacaaagttaactgggattcttgtattttatttgacaactcaacatagcagaccccttaaaaaggtgtcacaggaagaacttggcttgcatttggtaactaggttgttcccaaagttgcctggctgtgaatcctggaaaaaacagaggggatcatgtgcaggaagataaaattcaaggccatcattttgtgcactccagggcttattattattgcatggtcttattgcacggaatgcagtgtaaatcaacctgcactattttaattccttagttcaccagttctaaggtgcacattttttcatattttaacatctttgaaatcaaaacatgtcctataaccaaaagtgtgtcatagtttaattggcagtgtttttctttcttagtagtacataaaataacagcacttccaactgactgtgtctgggattcagtgcactatatttctccatctctcctttctgcaggtaagtcacgtaagttaaatgtgactctgcttgctctgaaaatgctcaacaccaacgctgatgtattacatactggtttccttctgatgcaacaacaatagtcaaaacggttttcacagaagctttgttctttagaggaaagtgcacgccaaagtgacaacgtttgcaaaaacttgaaccaaagtctttattcacattcaacagactgaagtctgtgatggcctctccaagcaaattctatttctgcacagctttgaaaagagatttaaaacaaaaaatctatcttcagtcatcccactttatctgctagaaatggtttttggggaaggtagtgttaacaggatttctgactgaagaactgatacgtgtcgattttgacactgtgctccctcctgtgcactgagtgtgttatcacaaggtatatggggtaatgatgaattccctgctgtattgctcaaaccgcctttgctattgacatctttagagttctgtaatggaatgcagtaggaggaatggttcacaataatttaaatgtttttcagaatttggaacgaacctggagtaaaatgccaaattgtcttcaaacgggggaaaactactttaatgctcttcttacagaagcaaacggctgaatataaacttggatgtttttataaaaacatatttcattattatcacttttataaaacaacatacagaagcagagagcttaaataaaccatttcttatgggttgacggttctgtttacacaggggtttatataaagtctcaaaaggaaaataactgtattgtttttttagatctgatcctctcttattactttctattcaaccaagttttgatgaacacatgatatattccaggctctgttctaggtcttatgaaagatgatacaaagataaataagcccaagatctttgcctcctcaggttcaccatgcaataaggcagacagattcatgcatagataatttaatactggcctaactaccgaactagaagttccatcaaagtgttcttggagtatctggggcagggggagacaaaataattcttgctggaattcaggtctgagattgacttttaaaaatcaaggacttggactgggcttaaaagatggtaatgagattttgaagaaagggtaattctgggcaatgggaacagcttcgttaaacacatgatgcgagtaccagttccccagcaaggcaacttgtacccatggtcagcttcaccaactaattacagcactgttccctgatgaatcctgacctggcttctaggcagctactaacaaacatgtatcagagttagcaagagagctgaaatttgccactttgagaagccttaacattccattgtttaaagatggaataggcacgcacaacaggggtctaaaagatggtctccggccctacaaatgcaaagctgcaaacagctttgaatcttactgagagaaacttattcccttttcagtgatctttcagtccctctgactgttcaagaataaagtctcagcggactagtacgtccttgataaggcatcaacaacacctctaagagaaagagaagagccatccagactggctagaatataataagattgttttgtttagatcatatttatttttagggacatctctcatttatgacaaatcatgtcaagtctccttttaaagtaaatttaagttaaacataaaagaatcaattttaaaaatatatgaaatgaaatggtgtgaaaatatggcattaacagcttgagaaatggcccctggggaaggaagtacaactgaggtgggaaagggtgactcaagatgtgagggtgatgcattggcctttaatgcttgtgggtggcagtttctactgggctgagttctagaaagctacatttttcatggatgcatgggagtcaaaataatttcatgttataagaactccgtcaaaaaatggtatgggggatggtagaactttgggtagggcaggcttttaaaggaaggcttcactgaagatgtagcatataagttgaggtgtgaataatgagtatttaagtaaaggggcaggaaggaatatttcaagcagaaagaacagcaagtgcagaccttcaaggaagtgtggtggttgggtaacaggctggaagagtgagagagaggacttggggggatggcagatcatttgcaccctgtgggcagggctgagaagtttggattttatttttggtgtgatgagaagataggcaaggaagtaaaaggactagaataattgctcataaagaatgtcctggaaggataatgaattaaagggagaaagtgatggcaacaatcagaagagaaagtttgggagagggggctcatttgccccataggctagttagcgtcatggccactaagtgagaggacttggcccctcactatagatggaccttgtcatctggcagctttctccctggtgcttgtctgtaaagcacacagagatcctggcttccctgccaagattgctctgaactagtgtgaaaatcactcagtttttgcccaatatccattctgcctctcttctatcattcacttctcaaagttcccgagaagccttcctggaccattctgattgagtcatatttcacgattctggatgctttcatgcttctggcacctccctggcactgtcctttcagtacatgtttcctgccagacatggagcttcctttgtctatgtgctggttactgagcagactggcgcccacgctggactttcttggtggcccaatgaatcaccaggtgctttcacttgaggcagaaaatggtcttggaccacaaacctctgcctgccacttgtgataccttagaacgctgaagttctttgaatattacttagtagaaaaatatgttcattgcttcccttctctatcctgtgaactggaccttggactaagcactagactgtgagatatctatgtgcaaacaaattaccttcaggtccttctacttactgtgaaagttcaaaagcccagttcctcctccttttctgaacagaaattcaagtaatcaatggagcattaatcatttgattagttgccaaagctttgacttaagcataacttacttgagtaaaagcaagtatttttagtgctgcctgtggggccaaaatgctgaaataagctcttatattaattagtggcatcccattttcaaggggtatagagtgttggatgtttaagaatttgtaacccccaaaagtaagtattaactagaaaatcacagtgctggaaaataattatgccaaaccactgtactataacagaccccaattgcttatccaattatacattgaagtatcacattgtcaagccgattgccaaagcggcaaatgagactttgctagcatcataatttggaccagatattactccactaactacactatgaatagtctttggaacatgctatgtaccctatataaacctccacgaaccaaggtgggcatttcaggtttgttggagtacgcccatgccatcaaaaaaaaaaaaaaaatcactggaattgattagacatgaaagttcacagttttccattgaaagcctgttaggagcatctcagcaaagagcaactgcagctccaggttctgagcagagttgatttcaattaaaatatcaaaggtagtcacttcctgtcagggagaccatcagtaattctatcctcaaatgtgtatctgagaaaaacaaccccagacactgcctcctggatctgcaacactgctccctgattgattggccaccatttagaggtaatttttttttttttcgagacaaggtctcactctgtctggagtgtagtggccagctcactgcagcctcaacctcccaggcttaagtgatccagccacttccgcctcctaaagtgccggggttataggcatgcaccactgtgctcggcctagaactttcttacaacacaacatcaggacagctgaagaacaggagcctggaactgggctgtgaggagctactaaggggttgatattcttaggacaccccattgctatgattttcttctcaaccttgtaagggattggaacgatcttgcccaacagttgggtctgatatgtcagacgaaaatcccactgtggcaagagcctgactcccagggttcagtagagaaataatttgcactcgcccagtagttctttgcttttcaagtaatagtaagccctaaacaatatcaaacttggtaaaaacaaaatcttcctgtctagtccccacattgcccagtcagagtaacatccatcttcgtatcctctcggctagctgtatctgataccagtataggaatcccccttcttcacccagtggatgcctgaaaccagggatagtactgaaccctatgtatgctctctgttttcttctacacatacacaaacctatgataaagttgaatgtataaatcaggtacaggtacaggttaagagattaacaaccaagaataaaatagaacaattgtaacaatgcactgttcacaattgcacaaacagaagatccctgcttgcagaggatcttagcaatttattttattttttttttttcgagatggagtcttgctctgttgcccaggctggagtgcagtggcatgatctcggctcactgcaacctctgtctcctgggtacaagtgattctcctgcctcacccttctcagtagctgggactacgggagtgcaccaccacacctggctagtttttgtagagatggggtttcaccatgttggccaggctggtctcgaactcctgacctcatgacctgcccgcctcggcctcccaaagttctgggattgtaggtgtgagccaccgcgccctaccagcaatttcatcatataatttgttttatttccttattaagtcaggaactttcaccttttctcttaaataccttatgtcctctttttggcatatctgaattgccagcatcactactcttatgctttggggctgttattaaggaaaatgaagggttacttgggcataagcactgtgatttcatgacagtcaacctggtaacagagatggctactcagtgactaacaggcgggtagtgtagacaacatggctacactggacaaagggaggatccgcatcctggccaggacagagtgggacggcgtgcaattttgtcacactgctcagaacgttgtacaatgaaaacttatgaattgtttatttctagaatttttcatttagtagtttcagactatggtaaactgtgaaaagtgaaactggagataagaggggactactgtagtaggttttcaataagcattggtcaaatacgtcactaaattacacttttcctcccaatatactggctatgctagctcatcatccccattttccacataaaacaaggaacttaaatcactcaaccaatgtaacatggataactcagagtggtatttgtttggatgagacacacaaacactggatccactagtggatccagacatgcagcaaactgtatgtctcatccaaacaaatttgctgtatgtctagtgctcttctgatccactctataaattcctgggaacgttctttcagttaacatagttgaaaacatgggtggtaaaacagcatagaaagcaaaactaacactgcaaatagggatcaacctctaagcccggagggccctgctggaaaacctcttctgaggggaaaattgcatctcagggcagttttcaggaattaatcgctgatcaccaacacctcaccccaggcgccatcatatctgaacccttctggtttttcagtgggtagaaaactggtgaggcaaaagggactagagatctctgccagtttgatttcctcaggcctctgtttctaaaaacatgctcactgagaaatgaaatgaaactccttctgaaaaggaggtttgtgatgaagcagacttcggagaaggaagcatttattcaaaaagcaatttccttggccagtcatgttctgtaagcctttttcccccccgccggtgtttcagatattggtgtttaagcaagactgttctcctttaatcctagagtgatgtcaacccacagtactcagaacaaggaatgggaagaggcatagggccaatttctgcctttgttggaatctcctgaacatttcatttcctatttgcttctgctacatatggcttcttttttcaaaggtaccttgcagagtcttcggaagcacagtgtaggcaaggaaactctccaaggagaaagaaaaatctgcactacaagatgctacgcaaacacacaactaagagagggaggcaagcacacagcacgcaaccaataatgcacagccacagaatccttctcaacacaacattgcaggcagcagcaactgggttgtcaagataaaacctatttgaagaagctgatctagctgggacctttgaacaatccagatccccaagcatttaaagcttgtttctctgcagaattcattcaattattcaacaaatatgaacatgtattcagtgtattttatagtgtaatagtaatcaagctggacaaggtagtgcctttgggaggcttacattctaggagagaaggcaggcagttagcaagtaatcatctatcactgccttgggagggaataaaagagggagctacctgagacaatatggtcagaaaagactgctctgaggaaaggacagtcagctgaggagtggcaagtgcaaacaccccaagggaagaaggaggcatctgtatggtctgtgcactggctgaaggcaagtgtctgaaggcgagtgaggaagttctcagatagaaggtagaagatgaggtggagaagtgggaaaatctcccttccctttagcactggaggcgaaagggctagaagacgagagactgaatgattctttcagtcacatcactcttttcaagcacctactttgtgctaggcgcagaagactattaaacaggcaaagctgtaataaatccaaactcagtgagctgaaggtagaaaggccgtcccagaacagctggacccagcactgcctctgaacatgggcaatgacactttggggctcaatgtttgcttactgggtctctcacacaccctaacatcagccctgcctataatgaactttccccagaaaagcaggtgagcagcaagctatttgcacatgtggtgactaccatggagcagcaaggatgcaggctgacctcacagacttctttctgaatgcataccatatgtttggcagagctaaaagagctatcccagcaccatctagccaggtgcttggcactggatctcatatgctggcagatgaaaaatgactaatatgaaaatctatattccaacggtactcaccagtccactggattggtcacgattccttctttctacaataggatcattctgcttctgattacaaaactgcaccctctgaagctgctactcacccgttggaagttacatgccctgtgcagcctacaaatccattaagttctgatggagctattccaacgcccttcaaagaacctggcccatgtgagttgcacaaacaaattggagccaacctttcccaaatgcctctctctatttcatttaaaaaccctctttaatgaagacataaagccttgaatgcatctgaaacgctatgcttaccatgcatgacagcagatcgtcacagaggatttcaaatgcttttttttttctaaccagaatacttgaaagaaactgagatttccttgttatgagttcaactgttcattttatatgccctataattgaccattctccagaagtcagcataggcaacagagatgtaaggcaactgcaaacacacacacacacacacacacacacacacacacacacacacacacacacacacacagctttggcacagtgaaaaattaaaatgcaatgccaggcttgggactattttgaagcctcaggctaggaaagcaataccctcacctttctcagctgcctactatgtacctaaccttccaattatttatggctgagatgcttaagatgtactggagaaacagccatggctgagagatacacaaagctgaaatattatagagagttataacttcatgaatgaaaaacctataaaaatcacttaagggtcctaatctttcagttaatctcacctcagtgccactcaagggtttaaaggagtttcactgattggtttttaaaggacaacgataaaaatgctttgaaataactaattataatttcaggtatctatgtaaaggtccagacacaaatatttgaaaatggactgttcctagaatcagggattgacacagatctttaaaactttctagcccaaacatccatgtgacatttgtatccctttggccatattgctttcaaggcttcaatgctctaggaaagaggatcttactgcagtactgctagatttaggtggagatcaaaattaccaatgtttgaaagtgatatttttacattaacttgatcaagagttagaacttggacttattactcagacagtctgatccttcattgacaagctgtgctgagaaaccattctgtgggctaaagaggatatggactcccaggattgctctggcattgcggttgagaagatatactggaataacctcttttgaaaacagtttagcattacctcctaaagttgacatctacaacaatatgactgccaggtatattaccaagagaaattctcatatgtgtacaagaagacatgcatgagaatgttcaaagaaactctgattaaaatagatagaatctagtaatgaccaacatcccaccagggagtagatgaataaaccctgatatgttcacataattaaataccatggctcaagcaaaacaaatgtttgatagtgacacacagctcatagggagaaatcttaacaatatattagtttaaaaaaattccctaaagacaataaaaatatacacactttaggaatccatagagatgcctaaaactatatgaaaagtcacaaagcaatggtgagcatagattgaggatgctggactgactccatgtgaggagacaaggggatggttttttgtgtgggactatcatactgttagatgtgggatagtagcaaaatcataggttttgttctgggcaatgggtttgcagatactcattaacatcattaaacataactacttacacaactaaagaaaaggaggctatgatggaaaacaaagagaaatgatcatccttgagaggcatgtaagattacaacatcggatgaccgcagttttcctcaagataggaatccagctcccattccaaaatgtccaccaaagttgcaacatagtagcatttgccatataaaagtactggagttattaactggattccagatgtctgaaactgatgtatcccttcactgaatcccgactaggatctattttgggtatagcacttcacacaggttgctgttcttaattaaaacttctctgccttaagagctttatgtctgtgagatagtcatccaaatgttctcctctccataaatgtgctcttatgttttattttcacagcaaaatgcttgcccagattttaataaacatgtccgcagtagtaatatacatttcgcatgctttccacatttcataatctctttagtccttttgtttatgttgattcccacaccaagaaggctgtttggaaggctttgcagctctgtctccatttcttctgcctatcattggggaatgaaacagcacactgattgctatttgggtaggaaacacagacaagacgttgaaagaagtaaactaatttccaagcaattttgctcctttctctctttttgattgattttggcaataactcaccccagttcattgacattagagtaaagcctagtagccaatttattgcttcaaaatctgtgagagttcctaattggttatcagactgtgtctaccagatgccaaaattaaatttcttttaaatcaagaaaaaagtgattttctggcatcccagatgcaaaacaaccccgattaactgttctttcacattgcaaatggctatttgggccttgggtggagagaaaactcatctacttacaacaggagggggtcagattctggactcgatccttcagccaaaatgcagataaaccacaaggaacaaatactactctatgaaaaatggagagctgggccgggcgcggtggctcacgcctgtaatcccagcactttcggaggctgaggcaggtggatcacctgaggtcaggagttcgagaccagcctggccaacatggtgacaccctatctctactaaaaatgcaaaaattagccaggtggggtggtggacacctgtaatcccagttattcgggaggctgaggcaggagaattgcttgaacccgggaggtgaatgttgcagtgagccgagattgtatcattgcactctagcctgggcaacagagtgagacttggtctcaaaaagaaaaatggagtggtgttcctggctgaaggagagatgccctcggtccaatgttggggaaatttttgctcccggaaagtggaaacatcaaaggactggagcccaacattaaggatggaataattatgttgttgttattgttatttttaatggagctctattgagtgcttgctgtctgcctggcaatgtgctcagtgccaagtacaaacatgatctcatttactcttcataagagtacctaccccatccatggtgctgtcatttccatttttagatgaagaagttaaggcttagagatgtgatctcatagctagtaggcagttgggactccagggtcccactccctttctgtctattccccctcctcatataacaatacatagcatttgctaagcaatacagactaaattgaggctctaacttaacttaaagctcttttgcatacagaatgttatttgatgaactctagggtaggtagaggcacaatattattatccccattttatagagaagggaacaaaggcccagggagattcagtgaattgcttgagtcttctgccatgttggactaaaagcctcagtgttgctctactaaaaaggtccctcaactaaatataacaggggtggcctgcatctagtctctgaattggaacatcacaactgacagagcttatatcgtgggttctcttatttaaaaagcagaaattctaggtaatggtccagtgcaatttcgactccatctcctaatcctttgacatcaaatgctctggtcctgacttactggtcctggacatggttttcttggcacagtagcaggcctttaccattttacctgcatctctcaaccctttgtcctgtttccatctcatgtgagtaggagttattctttaaacaactgccttgtatctcactaccagccctttgcacatactgttctccctgcatggatggcatttcttcccctgatccaccagcactggacttaggtggccctccaagatggttccatttcaggacacttattgtacatgccttctaatttatcttccactctataggtttcctgggggcaaaatcatgtcttttcacaatagccaatcttttctttgacttcccagacatcaatgtcatatggttcaatctaataccttaaccatgaccttataaaaccaaagctaggcacataggagaggctcactaaatacttcttgcccagataaacttatcacagtagatattcagaaggatgacatagttgtacccatcctcagtcctcaaataagagtttaattatgttatgtaaaccatatgatatactagtgaggcaggaacagatacacattgtaaaagagatccagaacaaaataagatttctctgtggccttcgccaatcttaaaatgtaactatatttactgaatcaaactcttacagcataataaacttacttacaaagaatcagggtagacagcctaaccttgagtacctcaagtctttgcccctggatcccacataacaatatccttccctcttttaaggaaagctggaaagaaaaccactctgccagcagaagggcaaataaaaggtatgtctgtgcctgcacacagaggttggcatcctaccctgatttgtgacccataattaatgtcaatttcataatttcggaggatagaagatcaacaaggaagctgacctctggctgtctcacagctaatcatcttttgaggcggaaacttgagaggaaacagaaacgacaggctggagcaccaggctgtggctcggagtgtgttttgggtgatctgccaagcagtgagaacccatggtcacgtgccctctctgtgctggccccacagtgacacctgctcaccctccattgggtaaggtgggaacctgcatcccaccctgtagaaggcttggctggacgcctgctagtctctacaaagttccttctcattgtgtgcactcttctacatggcttcttaattatgtatgtgcacaggctgtgtcgaatggagttgcctttgcctctgctcaccacgtattacatttttaatcagtatatataattacttaccgcaagctgccaggccagattttctgagcattagtctaattaacttaaacttgataattatgtttcggataccatagcagtacacacggaacggcagactttgctgccagcttatttgattccaataacgtgttttctcaatactggactagttttgattttttttttttttttgaaaaaaatggccatctgataattactttggtttcaaaatttcccctcagataaacccattctgctatttaggacagcttctcaaatgatttacacggattgaactgttatagtatgtttctgtgtatttttacacacacaaatctgtttttactaatataaattcaaactgaggagaaatgacagtagaaggaattctgatggtcaaatgacagaattgtccatgtttcaactgctctatgcattgccttttccatttcaatttgggttgatgaaaaatgagagacaaggaaaagcaaaacaaaactaaacaaaacacagaaaaatgcccagacttgtaagggagaaaggtcagcttctggttgaacgagggcatgataagttcccacactaataaggctcaattcacctagggcttaccatgtgccaggcactgcaaaaagctcttttttgtggactatctcatcgaatcgtcctaacaaccctatgtggtaattagttattactataggttgaattgcatcctcctgaaatatatgttgaagccctaatccacaatgtctcagaatgtaacttggtttggaaatagggtctttgtagaggtaatcaggttaaaagaagggcattagggtcagccttaatctaatatgactggtgtccttatacaaagggaaaatttggacccagcagctgccatgcacgcaaagagattaagtgaagatgaaggcaaagattggggtgacggatctctaagccatggaatgccaaagatcatcagcaaactcccagcagtgaagtggacacactgaacagattctcccttagagccctcaggaggaacagctctgctgacaccttcacctcgggcttgtagttgccagaactgtaaaacgacaaatttccattgtttaagccacccacccaggttgtggtacttgattacggcagccctagccctctaatacatatactctggttaccactactccccgtttcacagatgccaaggctcagaaaagctatgtgatgtgtccaggtctgcacagctgtcaagtggcagggaaggagtccacaacaggcctttcggactcccatgctcaacccttgacctcacccatgcctgtgccactctgcttctgcccaggaggctgaaagaatcaatacaacaaatcccagaagtggatgaagcactatgaacactgtaatgcttctaaggtaaaagtcaagcttagatggtgcctgttttcacatttgcacatcgcctcttttatttaacacgtaaaatgactgcttgaaatacctgcactctagttttggagggcaacaacatggaatttaaattttcttagggtgagggtagcgggattattttgttctcttctcacataagacaataatggaccaaaaataccacttaccaattacaaaagacaacaaataacagagcacaactcaatgaatcgaattgcagaaggaagaacaggtgggctttcccaagatgtcataatagatggaaggagaacaagagagaatgaacctgctctataaaggccaaagacaggaaatgagaatcattctggggaaaagatacaacctttatccaggaggaaaagcatgggaatatgataataatttttaaaaaagacaattctccaagaatatctcctggaatagatccaacggaaagcttgacaccagataaagaagggaggtcaggttcattgagggcctattacatttggggtatgtttgagggtgaaaccccccatagagtgttgtgaagtagaagctatcgcctcccactttgcagatggggaaataaagttctaagcaattaaataattactaaagggcagctactccttggcccagcaaatcactggaaatgctgacatggaagaacagcaggaagggttgtcctaagaagaattactttccttcttcagactagtagtgtctctatgtctgtggggaacgtgcacaagctcacactcaagacacagacttctcgtcataaaaaaatttcacaaattacctctaagttgctctaaaacgggagtgcttatcatttttaggcatgtcagcactttttagaatctgatcaaagctatgtatgactcctttccctagaaaaatgtgtgcacacacataaatgcatacactttacttgaaatttctagaaggtttgtacaccctcagggatccatgagtcacagctttaaagcccacaaaggatacatctgcctccaaggagcccagcaactttatgacacactaaaacaaacacataacatgcactcgcacaaccttgaccaggacagtccccctccacagtcactggcttgtatctccatgttagcacacccacctccaccactgagggggagctctgctgtgcttcgttgatctgcattcactaatctacattccaggccccacataaagcaagtataaagtgaatgttaagtgaatttgaagttagaagacctggacttgagctctatcactccctctgggtcatgttgtttcatctccttgaatctcacttttatcacccacgctattaggcagaaatcaccccggtttgcctcaccttttctgaaggattgctgggaggaacatatgcagcaatgcaggtggaagccatttagaacagtaacagtgaacactgactgtgtgcaaacactgttttaaacactttacatttattcattaatcttcatgaccatcttatcagggtggcagtgttactatccccatttcagacatgaggaagctgagcacagagaggtcggggaactggcccaggtaggcacagggctgggatgcaaatgcaggcaggctggtgccaaggccagctctcgtaaccactgtgcatagtgcctcttcaggagaggcaatgccacaaaaaatgtctaaaattatcctaacgagaaggcaaaagaaccctgtgagccttctatgaacattagtggagtttggaggtgtggggtttgcagggctttagatttagaccacccagaagagctcgatgttacatataactgcaactagcttgtgcatccacaactccaaattcagccctgtggtggtcagcgaatatcgagggagaaaagcagcagcctcatgtaggaagtgtagggccagggccccctctcaaagctcattcacatgtacttactttgactgccacaacgaacacatttgtaggctttccggcttgtggcttacctgcctgtgaccacaaagctcatatgtaccacaagtcctctttttcctacttcaaacaaacaatgctcatctccctcctctgaatttttttgtttgagagtttccaccttaaggttttcaaggggtccacaattcagttgtatcttgagtggaaatcttattctgtaaggcccctgtcttcattctcacacagtcaaagcacactagctgacaagcaggcttcgagcagagccatgataaagcttcaagccctgcctgcccagagctcacagccccggtgggtgacccggaaaataagcaggcacctgcaaaaggcctgtaaagtgctgtgatgaggaaaatatgggcaactgtgggagtcacagaaagggggtacctaatccagcatggggagagggagacactagagggtccaaaaagctgcgtatcttctctgcctttgtattgtcacaaaaatctaggagtcctcatgagctcaatgttaagtggttgcatgctttgactcacttaatcgaaaatgtttttaaaatcctgcttagacctttttcctcccactgttccctgagttagctccttctcaccctctgggtctcaatttccaatgtaattaattccctcttttcacgaagccttcctggagcaccctacactgcctggcatctcctgtgccatcttcctgcactttcttcctttcttcccagggaggcaggcttcatcttgatgtcccgggtgtggactgcagaccaacatcacctggcggcttgttagaaaagcagaacataaggccccatcccaaatgattcctcaatactttaaagctgcctcgcccaggaccttagccatcagccccatgtgactaccaggcccctgtaaaacggcttgtctgaactgagaggtattgcaggtgtaaagtacataccagatttaggagacactgtgaaaaagactgtaaaatatctcattaataattatttcatgttaattacctactgaaataatatttatgatattttggattaaataaaatattacaattaattttatctgtttttttaatatggctactataaaactgatagtcacatgtgtggttcccattatgtttattttggacagggctgccctacagcgtgagatgcgctggtttggataatgatcaagaacaggcattggcagacgacagccactgggtcaaatctggccaggtgcctgatttggtaaaggggcttttattggaacacagtcacactcactcatttactgtctttggctgcttttgggctacagcagcagagctaaggatttgcgacagaaactgaatagcctgaagagcttaaaatatttaccatctggccctttttagagaaagtatgcagaccccagtcaagaacgttcattccagaactggaccgattgacttaaaatcacgtctctaccactttttggtgtgtgaggttcggcaagttacctcacctgcctgtgcctcagtgtttgtatctgaaaacagaagatgagcatacatacctaacagagttgttatgaagattaaatgagttgatatatgtgaacttccttaaatagtgcctcatccatagtaggttctcaataaatgttagccaccattaatattactgctagcagttatcacaaattgtaatgacacatttttgctttaactttttttcctgtctgtctccccatcaaattaaagacctaggagagtggcatcattttctgtcttgttccagctgtttaagcacagttaaacagcccacacgtgagattcaatacatatttgttgcatgaatcaagtgcagaggagggaagtaattttcctaaggctccacggccagaaagtggccaggacttgaatgtggttctatctgcttgccaaactcaaattcttaacttctcttgatacaccaagtgtagtctatagaccagcgacatcagcatcacttgggagcttgttaaaaatgccggagcttaggcttcatctcagaccgactgaactaaaaactctattttaacaagatcgccaagaaattcataggcacattaaggtttgagaagcactgctctgggctataattcccagtttcgactcatgtgcttatttgttcaacaagcaattaatttagcatcaatcattccacagagccttgtgtttggaccccctaattccagagctgatgatttctattcatcccgatcaggtcctgggggtgtttagggtttgcaatgaacggcaatgtgctgtgtcagaagtgccctttctcctaccaggttcaaaccactgcaatgctggagtgacctctctgcacagaaatctgcttaacattccttacccgcctgtagtgaccaggccacaggctccggcagatgcagaaggtctgaaaatctagttgtaagtaattttcctctaggtgcctacctcagtgaattggttctcctgtgcattttatacatcagtggtcgcaccactcaaacacacaatccattcccgagtttaacagctcaggcaccttcctttttgattttataaatgaatgcaaatcatctcccactcatattataaaccaattaaaattctcctcacacttttaaaaaaacttgttacctggctcaaagatccttagctcttttcttagaaactggcccttatgtggcctgtatgtgaggatgagggtgtttgaaattagcaggaaatcttagaatggtttcccctttgtcacagccagaagtttcagattgtggtcatcagatgaacgctttaaatgagaaaaagactgattagcataattcttaaaggtctgaactctacactcacagatggcctctgagaggatggatggtacagaaaggagattaggataaatctaattagtttgggggtgttctcatttctcaagtggtgagcgatggagaagaagtgatggatggacagatggagataatgaagccccattaaagccttttttgattctcattctccatgatggagcacattatcccattaatgtttctgtgagctaacacagccaaagtttggcgctgtcacctcgaaaatgaattcgaattgcctgcccagctccttacatgtgtccacaggagttaaatgagcctgaaaactgtattcctgctgagaagcccatcctggcagcatgggctggaagccctcccctttgggaatgggccttcctcctggctggtttctaacagcactcaggccagagtcccatagcttttctgctccggggttctacaactagaatttcctctgaaatgggctgtggcttgcacgtatttccagggtactgagacagaccgctgctgttctcttcagtggaggtgacagctacaagtgctcaccatcacactctgattagggacctgagggcagggtccaaaaacaaaaagtggcaagacaggcccatgactcagtcacagagatgtgacataaataataatacaggacattgcacaggctatgtgcaaagtaagggcctgactggctccactagctcagagaacagtgagacagtgatgggccatccaggaaacagcagggaaaggggagagactcctcggggtttgaaaaaagaaccatgtgccccctgatgacagcagcctcctaaatggaccccttgcttctactcttgactccctacagtccagcatcatttaagaacataaaccagatcaaatgattctccccttcaataataatcagagctgacatttattgagcacttacttatgtgtgctcagcgctgatccaagcacattgcatatattatttcatttcacaacagccctttgtggtattaatatcatccttttattacagatgaggaaattaaggcacaaacaggtgacctggcccagtaagtagcagaatttattgacaagctcaggtttcttgacttcagaactccgattcttaacctataactcctgttccatgttcattccatgccctcccaccacacatggaataaaatctaaactcctctctgacctcattttgttccagtgtctcccatgctcactgtgctctcgtcacattcttcaagaactccaagcacggtccatgtctaggccctgtgcacttgtagttgcctttgtctgcttagaaaggatttcccttctcccatatccaccttcgaaatgtcagggtggcccacgcttgattctcagctctcttactttattctactgctcttcccaaccaggtggtctcattcaaggccatggctttaaatactatctcctatgactcccacatttatgtttctagcctggaacgtttaatgagttccaaccatgcgtgtttaatggctcatctaatctttcctctcgcatgtgtagtgggcacctatatttatcacccaaagataaaaaaaaaacccctgacttgtaactctcctaccctacttcagtctgtaaagtaaatagcactatcatccagctggttactcgagccaaaaaccagcaattcttcttagcttctgagcctttgcacccaatccatgaacaaattctacctgcttccaaggcacatcccaaagggcctatttctctccacctccactatatcatctctgatataaaccactgtgataattttgcttgcacttttacctctctttaatccagccagggagtgacccttttaaaagttaaatcagatcatgtcattcccttgcctaataccttctaactctaatgtcatgctaggccctgaagacctctaggccaccgtctgcctctttaaccacaactcctctgcctgctcaccaatgctccgggcacactggcctcccttctgtttcctgaacatgccatgctcatcctggatgtatggcttttgcaatcactattcactctgcttagaaaactctctaccccaggtttccccgggcttacagcttctcatttagttatcagttgaaatgttacctccttggtgaggccttttctaacccctctaaccaaattcatatgcataaatactttctttatcataccaagtttcatttccttctcactctctgagatgtctgtgtgtttaattggttttttctgtctctcctactagagtaatctctttggcggtctgggtctgatctggtttgttcacccctctatcccccagtgcctggaactttatcagggatcaataagtatctactgaatgaagagcaccatttatttagaagctcacaaaatgctaatggaggaggtaagattgaagacagatgataaagctgggacttcaatcctatagtcagtgggaggggaatggataaagagtaaaagtgacgcaaacttgtagggagtgggaggaagtctaaaatcttccatttgttgaatgaccataacccaggaggccctggtaatacacaggtgaacaaaaccaaaatggcccctggcctcatagagcttgtattgtagcatgtagtttaaacttttttccccattttaggatggagcaggggtaagcaaatgttttactgtaaagggccagagagtaactatttctggctcttcaggccatatggtctctgccacaaatactctgccactgtagtgaaaaaggagccacagatcatacacagacttggctgtgttccgataaaactttatttacaaagacaagcagcaggtccaacttggcatgtgggccacaactggacaacccctgggacagagacttctgtcccttctaaagaactggggagtactttaggcttgtcatgtagagaaacaggctttgaatcataagaaccttaagggtcttgtggagaaaaacatagatttattatttaccttaagttttctaaagcgcttagaaaacagtgagtggacctggagctgctgacctggggttcctgctagtcttttgttttactccttcccatgaatcaactagcttttgtaagaaacctcacagttacatggatttgaatatacttaacctgacaaagactaactcaaagtggctaatgcctataccagatggtggacctgcccttattccactgttagaaaggaagagaatgggcactactgattacttgtactgatttaagtttaagctaatagcttggcattaccctgacttcagccagggaagaaaatcacatccaagtttgcagactccatgaaacattggccatatatttgttggctcattagcttggacataaagactttctagaaagagatgccatcattaggtgccactcagactctaggggtgcttttggaaaccactgtgatcagaaacgtatatattgttaagggaagagagagagttgttctggacaggtaccgagaggcaggttccaggaagctgaagccaacagaatcaaaccttaacgtacataagccattcctgggctttgtccatgggttgcctttgtggtggttgtctgcctggtttccagggagccttcaattagaattctgagctgagatgatttatcctgtgtgctacattagctccatttgccattaacataaataaggctttagttacatgaggcaggcataaagggtatgtatgccttccattcatgaaaacatcattttttcaaaacaccagtttcttcttataagctaagttacactacccaaatatgtagtaatcagtaatacagaacaataaaaggccttgatacactgatccgggcatacgaggttatcaggaaatcctcaagtcagtgtctctccccatgggaccaatcctgtacctctttttccttcacctccattttgacttgaaatgcagtagacaacagagccagttcagtgccttgccatgctcccagcacttagcactgttcgataaatacatgagggataaacaaattgtaaggaaactcccatcccatgagaggagaaggattctaaagtgcatgaccacacggacacacaggtaacatccatctctttgggaaaaggagtaaaatggactttcctgaaacaactgctaggcagaaggtgggtgaaagccacaagcatagcctgcctcatagtagttccacgaaagtccattttacccctcttcccatagaaatggacactatctatgggtccctgtgtgtggctgtctcctgccatgtcgctggattttctcaggatccctgacaagtagggatttttggtcaatctttcatagacactcttatctcctcaaatggagacaccatcactggcattgaaatgctaaggtgagaactcaccaagacacactgtaggtaaagttccagctcagcttagggtttgatatgtaacgggcccaataaatgatagtgattggtattaggattgctttgttcttgttacagatgaagaagtagaatgtcagtggattacagtgaacagtccaagctacaaaatgtgttgcaactggaatttgcattccatgtgtctggttccttctctatgtacaggaatgaatcaggagagcacactggctctaccttcttccactctgacttctcagctttaatccctggagttccagggtggtatggactgaatgtgtgtgcccccaccacttccccaaaattcattaacaccacaatccagttaagatatttgttagtagggccttcgcagaggtgattagggttagatgaggtcatgaaggtggagccccaggatggatttgtgcccttataaggacatgaaggaccagagctctttctctccaccatgtgaggatacctcaagaaggtgaaccagaagcagggtcctaaccaacaccccgaccatgttagcgccctgatattggacttccagcctccagagccatgagaaataaatgtttctgtttaacccgtttagtttatattctcttatagcagcttgatctaaaacacagatacctcaagatggctacaaattctcctctaagtgcttcagagaggattagaagataaattatatatctattttgttttctatgctaggcctctatgatataatataaatataatcatttgtattataaactagaatataatacaaataaaattgtattataaactaccttaaagaaagtcctccttacactgaaccaatgctaatgttggttaagccaatttcccttagaaaaaggcatgtaggatcttgaaggcattggtgggctgcattccctgcactgtgagcaaggcctgacctagaatgacctgtaacatcacccctgtcatgggtcccaagcgcacagccaaaggtcttcaaaacatatgggtatccttagcaaataagagcattgctaagtgcatgattaataagccagaaaggctatggcacttgacagacggatgaggcatttcagaaagataagtcaaagtgcactgtgaggtgagtgcctcccttaactttcttagctgtgctactcggttcataaaccagggattaagtccattttcatttcaattttttatttcacctttaagcaactcctaaggcttccaggagaattttgtttgacctttagctaaagttcaacttctaccaagttacgaattttggatggtccctaaatgatcacttaagacagatttcactataattcaaagaaaggataatccctggcccaagagttcacaaaggaaggattcccagtggtcccagagatggcaaaagttatggatttcatcctgctaatgcattttagtgatattttcattgtgcaacattaattaccaatgtcagcctggatgcatttgctgggtattgaaaccacgacatttttttatctctacctggtcccagatgaagattagcttagtgcttccttgtgtcctaggccctagagaaaagatgcagcctacgggatggggtaaccttggcaagttgccatttgcttctaaagttatgatagcagtgttgaagccgtcactgagactctggtgctcaagccaagtaggagccctttgctatcatgacatatgctctagatttgcatttgtctaaaatctagcttttaggagacctctcagagatgtctcagggaggaacactcagaaaatgtgaagaggagcaatggacagagacagagacttccaatttatagtgaagaacagacctttgaagttgacttgttacataacctgacttatctaccagatctgtctgattcctaaagaagtatatgaaaatctctcaatttatatttcaaactcctgaccttcaggtgatccacccgcctcggcctcccaaagtgctaggattacagtcatgagctactgcgcctggccatcaattttgtctaatcagagttttttttcccttgaattttggattttgtagttaactactgggttgttgtgtgcctgtaataaagatagagttatttttgtccacaaaagttgaaaacagagctgccagttgacatgaaagtacaactcatttccatccacagcctctacatccattaaataaagagaaactcagtgctcatctcactcatgaatcagaacaggatatctgcacatgccatttctctaacttcccaaatgcagcaggaacacctcagccccgctctctcagtatctcagtggactggaagcacgttcatttaagaggaagggctcatagctttctgcagacagttcaataccatgatgcatccgattcagtttcgtccattctatttcttattgatcagcatacctcaggctattagttttattaattaaatgataattttggggggtgagtacacaaggagataaatgtctcacaaacagactccaagcttgcaggcaggaggcatgcagtgatttacaaagtatttatctttctggcatttttttttcccccaggaaaaagtaatcatcactaccatcttctaaaaacagagatgcttgttttctgggcaggcttggaaactagccaagacagcaggaagattgctggaatttcaacacacttgctgtggtaccatggtgctagtgacctgcccttgcagatataccttgactccccacagaagtcacctcaaagtctctgctatttagcaaatccctaggtgtctggggagtaggggtccagtctggggctgctgcctcttctgattggctgcctggctctgactctgatcccagaatacccagaggaatttgtttccatcctcctggcccacaactcacacaaacctctaatagtacacaggttattaaaagcaaataatagctgggcacagtggctcatgcctgtaatcccagcactttgggaggccaaggcgggaagatcacgaggtcaagagatcgagaccatcctggccaacatggtgaagccccttctctgctaaaaatacaaaaattagctgggggtggtggcgcatgcctgtagtctcagctactcgggaggctgaggcaggagaatcgcttgaactccggaggtgtaggttgcagtgagaccaaatcatgccactgcactccagcctggtgacagagcgagacttgatctcacaaaaaacaaaacgaaacaaaacaagcaaataatagtgtcccaatagaagcacttgccctaccacagccctctctctctgccatcaccaggcactttctgacatttccatctttctgacagggtttctcaacctcagtctctattgaggttttgggtcagataattcttagttgagagaggtggtcctgtgcattgtagggtgtttggcagcatccttggtctccacccacttgatgtggtgagcacacacctccccatccacaaacatctccacacgttgccaaatatcctctgggggagctgatttgccacaacccccacaccccaccagtgaaaaaccaatgtcttgggacaagtggaaagtgatgggggaaactgaaacctccctgacgctttggttcctgtaaggaaccacaggagactacatcattgtcacctctccctggtttgcagacattatttctgagtcatgtgaatgaactagaaaccttaaataggaagtcagaagggaagctggggaggagagtggggaccgagttgaaagatgatattgactatttgtacttttcaattagcacaggtgcaacgcttcaggattcttggccaaaaaatgatataaaaatgattggaccgacctgctctttctagggtaaaggtctgtgagtcatatcactcagaaaacatttttgagcacctatgatatccctcatccagtcaatcaagagatttaacagattcttcttctctccctccctgcagccattcttctaggtcttgccactattttcttcctcctggattctcccaagagcctattctctaccttctaccagccttgtttctcagtatccattctctcactgaaggtgagtggtctttttgaaatgcaaatcagatggtgctagtcagagggtgctagtcagccatctgctagcttccctggctttccattcttttcggataaaatcccaactccttaacaaggcctagaaagccatacattgcctttgttatttcattacttacaactgtgtggtccaactccactggaccagtcttgcctggttcctcccagagtgtgggacactaaccaccactgtgtaggtaggcacagaaggtggctttacgtagaacgcagtcacgaccttaaaaaatgttgaatcacatagtgattctttaggttcaacatcctttttcttccttgtgctctctcctagagaaagtcagttcggtgctcctttgtccttcctgcaccaaggcttattgatcaaccttcttgtgttagaaaagaacaagcctcaggctccaacatagaatctagttggcatttaataatactattttatttttgattgtacttacttttacagttaccttttgtattagtctgttctggcactactataaagaaatacctgagacagggtagtttataaagaaaagaggtttagttggcccatagttctgcaggctgtacaggaagcatgatgctggcatcatggggaggcctcaggaagcttccaatcatggtggaaggcaaagtggaagcagacaggtcacatggcccgagcaacaagagagagagaggggagttgccgcacacttttaaacaaccagatctcatgagaactcactatcacgaggatggcatcaaggggattcatgagaaatctgcccccatgacccaatcacctcccaccaggccctacccttcaacactaggtattacaattcgacatgagatttggtggggacacatatccgaaccatatcacctatttatggcatattataaatgtttccagtataacattccagaagtgattagtgatgcaatcttgcctttttttttttttttgagatagtatctcactctgtctcccaggctggagtgcagtggcacgatcttggctcactgcaacctctgcctccagggtttaagcaattctcctgcctcaacctcccgagtagctgggtttacaggcgtgcatcatcatacccagctaatttttgtattttttggtagacgtggggttttaccatgtcggccaagctggtaattccaagctgaactcctgacctcaagtgatccgcccaccttggcctcccaaagtgctgggattacaggcgtgagccactacacctggcagcatctttcctttttcagtgcatgtattcaggtagaaaaagaaagtttacttgaagaaacataaatagtagtagcagtagtttctagacatggcaaataccaggattaatgcttggtatttgggaaacaaggagttacttaaatttgcagcatgctctcatatgccagacgtccttcagccaggctaagaaggtggagtgggcaggagtaggagacattggattgttccttgtaatctctcatgcaatctttggagtttgatgcagatgtcaccccgccaaaatttgagtcagtgccccacctatgcgctccgctaataccttcaacaccccgcttagaggatctgtcatggcgcctgtgagctctgagatcatgtctgttgtgttcactgttgtttctgcagtgtctgacatgcagcatggcagaataaacaagacaccaggtaaatatatcttggcttgatgggtgaaatgggggtaaggagggaaacttatcatccttttcagccaggtctgggccacaccaaaagtgaaaggcagaatgagatgcctagataatccgtgccaataaagatgctgacccacctcctcctggacaacagagacaaaagagttaataatgtgaattacttggggtgcagcttccatctccctcaccacttaaagtgtcagaatttgacccccactggctaatgcaaaaaacacacagaagctggcaagacatgggcttgcttgtccctcctctttctttctacctggagctttacctttacaaatttgtagcacttgaaggtatgtttccctagccatttctggatcataacaattcctttttcctactgacaaaatctgaaacttagccggaagcactctcttgccagggaaagaactgtgtcagacgtgcgatgcgtgataaaatactacggtaatgtggaataatgctttcaactgttgccagggtgagcatgcatgcagaatgatggaaattgcctgcaaatacaaatggttgctctgtggctcatctgtaacctcaatgtaggaaagcggagatattcttttccctcctttgcaatttgcacagcctcttgttggaaactatggagattatgccattgaaagtaactgccatgtttactcaacacacaatttttactaatacagtctccccatgtagtcatctgtcttgtgaggttccctcaatactccagctgttcctgtggctgctgctgcgaacacctcattgaagaaatcaaggtgccaaacccaaatgctttatgtgagggtgtggaggtcatttttgcattgctgaaaatgacatccactttctaccttagaaacaaaggctgcataactgaatgggattcagtgcacccctacccccttctcagtggtgaattcaatgggaattatcagagggctggtctgtataactagaaaagccaaaattgttgggtgtttactatgtgttaggtattttgccttcttttaggtgaacctcataacatgctatatcataaatattatcctcctcattttggtgttgaaaaactgagagtcagaaaggttaactaacatgctcaatatctcccagataataagtgaccaagccaggatttagtcccaggtctgtatgactctaaatcttgaattatttccatgacaaataatgttaaactaaagccagcatttttctctttgagttgtggttaaactttcattatctgtggcctttaagcattatttgttggttttcacgtacccataactatcaggatacatgaaccaatgggaagtcacgtcctcatgaagagccagtagcctaaatgtgaaatttctcatgcataccagaagcacaaggggcaaaacacacacacacacacacacacacacacacacacacacacacacacacgtcaaaggcttctccctctttatgaaaagtaaaatgccattttctttttctacaaagggaacaagataattcattcacggatctcttgattagctcaattgttctgagatgataatagttaccatggattaggtacttactacatgccaggaatcaagggaagcactttgcaagaaggataacataatatttataacccaatgatgtaggcactactattagtcccattggacaaatgtgaaaactgaggtttagagattatgtatcctgccaaggtcactcggttcagttgggattcaaacctaggcctctctggctctgcctccatgttcttacctgctatgttatcttgttttctacaaacccttcctagctaccatctatgtgctggataaataagggaatctttttaccgtagagtgaaaatgagaagttctgaggaagtgacatagtgttctaggaagtgccctcctttaagaacaaagtaggctggtttctcactgccaatcaaagtgtgacattggcccttctggggctcacctttctagtctgcaaattgatggtagcaaaggacacaatgtgtaaggacccttcctgccctaacgttctgtcattctattaaccacattttcccctctcccatcatttctcctgggctttgattttcactttttcatggccagtagaagtcacacatacccaaggcgaggctgccctcctctagtgaactgcaatcatttgaacatcctgcctcaattgaatcatcctgacagctatccctatggctggccagtcaactcccaagcacttcctggaaatgcagatgctgtatccagggcagaaagtacttcccctgtcatctcactccctctctgggctccagccccaaggccttttaggtcttcagactggctccgtgccacccttgcaccagtgcacatgctgttcctctgcctggaacacattttcttccctgcctcctgtggttaggggccaggcaggtttccctaaacagggctaaaggcaggctacgatcctcattctagattggccctctcctatacagtacttctctgaattggtccctatttattcagttggatcagtgtcttagtcttccactatactcacccttgtgtccctgcacccagcccagggcctggctcacaggaacctctcaaaacctgttggtagaagaatttgcacattaacctgccacccacatctgtgttctcttattgatgaggtacaagaaaggaagatggtaggccaatttacagtggggttatgaggctaggtctcctctcagcccactaatgtctcagaaccacgttctttgctgagttcatatgttttttttttttaccccatctccaaacagcaagtaatcttgcagatcaatgcctgagaccaaagagacttatgaatgttaagaagattatgcacataaatgtaccactatgacagccccgctaagaagaatagtgatatcgcactgcgtgctagtttatcaacctttgctacttaaaaaattcacagccaatttaattaaaaatataacagctctgaaagctgctaaaatgactatgacaacaatctatcattttgtaatagtgctgaagatccattagggactttgcactggatgccaactttttaaagcccagatagtaggggcatttcattctgcacaattaatgtcactgcatttaaaatattgactatctatgaagaagaaaataccaaacatctttataacccacattttttatggtcaaaacttgcttagaaaggtgctttgaatttatttgttataagctgcacatttcacgttcagaaaattaaaatggtttctactgactaactcatttaatcatttagttgatttaatgaaaaacactatgcatttttctcttctccgttgctaagattaatactttctgttcattagcaatcaaatattgcaggaaggtttacatcttattctcacttaactcattgccttttatttttaaaaaattctaatagaattgaaatggtatcttttaaatcaggaattttcctcttggtaactcgttttgtcttgtggaaaacacatggctagcctgtgacattgaggcatttatgtctgaattgtttttctagtctttttaggggatgcattatagggaggaaagggagtggacactttagaaaaattatgaatctagttttcagggcccctaactcattaatacatcagtgacattctagcatcctttgaaattctgttaagaagggccctttgatttattagtgggattttatgagctacctgggaaagtgaacccattaaaaatgttaactgtaagcatctggcttccattgaataaagaatcgaagccaccacataaaagtgactctgcacaaacatggcactcctctcccatcactcccaaagcttcccattgtaaatgccacttcatcacagcagtgccatttgcagttgtagtctcatctctgttatccactgctattttcaggagtgtataaatgagcagcgaaattcctctcccctggaaatgcctgtaagagcagattctaaaatgggaactttttgtgacaagattgggtacaaaatagtataattactgtaaattgttcaataatagggccagtagtttaaaagcagcatttccagatttcctttgcttccataccaaaaagcattttcttgaaccccaattgcttcataggaggaaataataaaaggcaggtgatagcattttgtacttagcatagatacaatggtttaaggacacggtgcactgagtcaagaccactaagaggtagagggcaaattaaccatttggacagtaggaaaaggaggcattttaaggtggcatgcaatgagccagccagctaattatagtaagagcagcttccctaacttttactttctatttcaaggtgttcattgcttctctctctctctctttctctctctctctctctctctctgtgtgtgtgtgtgtataaatcatctgtcttcatcattgcattattgatattgattgattgtaggaggagaaaacaagaatttttccattttatagttaggaaaactgaaacacaggcatcagtgtgctgtaaccctactataatgctcttctctttttacgcacttaggaaaaggataatttttttttaacatttgtgcaattatttaatatgtgtctccccaacactgtaatatctatgagagccaaatcactacctgtcttgttcatcatcacagtcccagcactaacatagtccctgctatatggttggtaggtgctaagtaaacttttttttaatgaatgaatgaatattattttctgaggtcattcctattggagcattagtaaagcaggacaaaactccaggtcacattcctgtactattgttgaacttctattcacccttcaggactctggtgaaatgtcagcatctttgggaagcctttctgagttctccctgactttgcctgggctccattaatgcttcgtacttaggcctgttgtgtgttgtttcttttgcttccttctcttcacggaactactctttcatgtgggtaattatcctgttcctcaggctttggatggggttgactccatttctaactggccttgggatgggttcataatccagatctggcctctcagggaaccctatccttctggccatggttattggctcagcaatgatcctgtagcttaacttgggccagcatggtctgtgcaaagtttttataggcattactgaagcagcgggggtggggtgggggaaacccacaatctttctaccataagctagtaggatgtgagcctccggctgctggtgttcgcattaccttccctgaggagaggttgcctgagagaagcagagagacacaaagcccctaatgacattgcttgtgcccctggatccagccgcgcctgaatcaacaatactattagacttttcagttacatgagctaataaactcgttctcattctcttaaggctcttaaggcaggttgagttgggtttctataacttgcaaagggtctctaatttctctatgttgcagtctattgagcatgtactccatgaaatgtgggtgattcatttctgtattcccaatgctgagtataggccttgtccttagtaaaggcttgttgaattaaaaaaacggtgcaattctagggcaaggacatttccacaaggccaggtattttggggatgaccctgtcaataagggctatgtatcttttggatcaaactctcatagaagaaggaagacctcataaagacacccagaaagtaggggcgccaaggtcaaccagaagagagaaaatggccttcagccagtcaaggagtagcttacggcagctaagaataagacagtgggagctgtgcagccccagaatggatttcccatgcctggttttaatcatggctatggtagtctatgtcttggttttaatcatggctatggtagtctatgtcttggttttaatcatggctatggtagtctatgtcttggttttaatcatggctatggtattctgtgtcaaatggaatgactaatcctaggtgctttggaaatgttaaattgttcataagtcccttagagctttgtttctcctttgaaccccatggagggttttgggcctcagaacaggtatattaaaccgtctccatttcaactggtaattgagggcctctcaaagtctacctagaagagaatgtcttctactatagaaagaaacagatgatgcaaaattttgattttttaacctaaagtttggtcctgtctggcaaaacaattgaagaaacatgactttccaatctatttggaaggtgagggttccaagtacaccctcactgtgatctgaaaattgtgaaaatctgtactaatgagaagcttaggaatcacctagacctgggtttaaatcctagatttgccacatttctggggtggtggggtggactgacaggccctgaacagacaacgtctatgagccctagtgttttcatgtgtaaaacaggactatactgcctcacaaagatttgatgacaattaaaggaaattacagatgttaaatgcttaacaagaatctagtacatagtaagagctcaatgtatattaactgtcattgtggtgacaacaatcatgataatttcaagcttttatatccaattttgtgttggatgcttcattaggtaggaatgaacatctcaaacatatttgtccatctatcattatttctatatatgttgttcacccaaccatcatatcaaattcctgttcctttagtttggaggtccttattttttgggggggggggtcatgaacctccttgaaaatctgatgaagtatgggtgatgtgctcctctctgaagctccaatagcacctcacaggttccaccttaccccactgtacctccatccgcctgcactgtgactgcttgtttattcctttttccaggctctgggaggtcagggagtgtatctgcccagatcatcattttctttaccttgcttagctctgtgcctggcagagaataggtgtttgatattcactgaatgcataaatgaaaattgcaaagccttccccctgaccccttaaaaattcacctacactcaagtttttgcatctaatttcagaccctgtctgaggactccaggtaagaagctactattaatgactacctattgtaggtcattaaaaatgcagtagggaaattttcaggccaaataatgaagcagcctgtttttcaggccaactaatgaaacagccttaccacaggccagaaagaaagtgtagatcgtcttctcaagagaggaaggacaaagtcagaattgacactgtgttcgtgatgaaggcaacctttgtccaggtcccttgttttaccaaagacgacaagaggagccagccttgcccaaggtcacatggccactggtaaagagacttgagcctcctggcttccagaccagtgctcatcaaactcaaaccttccccctcttcccctctcgcactgcctccccagaagctcagtccttgcgagaattcaatgaaaatttccttccaagcatggtccgaagacaatgtaaggaaatgcaggatttacatgactttggtcaagtgaggggacaggactttaaaccaaagagttgatttaaatcttttaaaacctacagagtgaagggcttgcctcattgcctcatttgaaagatgaaatcattctgtctttatttttcattgatgggagtttggctttggagggaaaaagatctggcacttgagagctggcccagtgaggataggggttgtcattttctcctcactgaggcttagcaatgcctttagctaaggcccggcccatgtatccccaaaagtgacaaaggtacagtatttcacacaggaacacttggggagcatttttccatgggacacggcgtgagaatccattaatctcactgccacatactcaggctatttctcacaagcttagccagacatttgggtttttttaaaccatgaaaaaaagagccttatcctcctcatcataccagattgctccagcggataaacatcagacatggtttttagagaaatatcacacgatctgagaacatctgcaattctctagaacgtaccgttgtcagaacttgacttaaacgaaacaacagacatcagactttctttcagacgttttgcactgaagctttccattatagcacgaatgcctccttctgaaatggcaccaattgaaaacgcaccaggacacgaacattaccacaactcaaattcagatactcgcatgttattaacaatggtgctaattcctgtttcagagatgaaacttacagaggagataccagtgggttttcctccattgctacttttcatttgctatggaggccacaaattcaagagatcactcattcttaaattaacaaaagtagccaccacctggcaaaacatcaggccctgtgcaggcgctttatatgcacctttatatgtatcgcctcttttaagcccctcagtggtcctcggagacagctgctgttatcttccatgtcatacatcagggcactgaggcccagagcccaagtgatattgtaacagcacttcctgtgtgctaagcactctccatgcattttatttatagtatctcattaaatctcaccaaatcctttgaggtcagagccatcataagctccaatctacagctgaagaaactgagacagctctcaaagctaggcctagtttcctccaaagttcagtcacatttgttccatttgacagtatgagggaaggcctttttttggttaagcgtatagactctgcagttaaacctcctggaccctacccttgttagcagtatgatcttagataagcacgagttaactttaccatggctcagtttcctcacctgtaaagtggcataataatggaacttacttacttacctcaaaggatgaagagaatgcaatgcaaagcatgtagcatggggtctagcatacagtaagttctcaggcagtcattagcagtattaaaaataatactggccagtggctcatgcctgtaatcccagcaccgtgggaggctgaggcatgcggattacttgaggtcaggagttcgagaccagcctggccaacatggtgaaaccccgtctctattaaaaatataaaaattagctggccattggtgggtgcctgtagtcccagctactagggaggctgaggcaggagaactgcttgaaccctggaggcagaggctgcagtgagccgagattgtgccattgcactccagcctgggtgacagagcaagaccctgtctcgaaaaaaaaaaaataccataacattttttcttcttatttttatataaaataaggctgtattcataaaggatacagggattaaagcaaaccaaaagagaagagtgagggtaagtttaattgtgtgataaggatttaggtaagacagcctaggcaacatggcaaaacctcatctctaccaaaaaatacaaaaatgagctgggcacggtggtgggtgcctatagtcccagctactcaggagactgaggtgagaggatcatcacttgagcccaggagtttgaggctgcggtgagctatgattgcaccactgtactccagcctgggcaacagagcaaaacccggtctcaaaaaacaaaaaatacaattaataaataaaaagtaaaaaattcaggattaaggtaagaggtgccccgctgtgcagcacagagctccatcggattggaaaaagtggctgccaggggatgcctccccttattagttcagacaggcttatgtaccggtctccttgcgggaagtcctgtgctgctcagcgttgatggaacacacaatgaacttttccttgcttttgtctctaccagaactcgactgagtgcgccctgctgtgtggttttatccctggtcttgggataggtttccatggctataggaaagaggtggagacagggaatgccaccttctgagttcatcagaatagaagtgtgcacctgcagcaagacatgattctccctaatttgctttcaagacaaaactgtgtctactgattgggtagatattgttgaggcaagatgcggtatgtctagcctgtgtccaacacatatggcgttaggtcattcctttcatctcctctaatggtgcccagtacaatgagaatgaaatgcaaatcccttaccctggctctgggccacccagacccatttgcgggtctctagcaacacccccagaccctctatctctcccttggtcacaagggcttcctttcctctttaaggtccttacaccagctcctcctttgcctgtgacactctgtttccaggtttttcatgtacgttcttcttctgttgggtctctcctcgaatgtcagtcttcaaagaggccttccttgtgactccataaaccactgcagctctctgattcacttccttactctgtcttgtttttctgtctgctaaaatagaactgataatcctcgtcctccttctctcacagcatttctttgatgagcaaatgagattcatgtgtatgtgtctatgaagatgcttttataactgtgagtaatcaccagggatgcaaaggagggttcaatttctatgtcagttcacactgggtgggtttttctgggtttttctgaagcacagccctgagatgaattccaagactgcagtattctcagtgacaaagggtgcagcaatcccttaatgatgtctgacttgggagagggaattagaggcgtgggtgtcacatatttgctatctgtgccaaaaataaagtcatatattaatagaagcccaaaatcaataatttacaaatagcttcctcaaactttcaatggtacttctggaaaagtgagatttgaaattttactctccttcctttgcactctaaaaatttattcccctgatattacttttatattaaaaactaattagaaaacttcataggtttcatcatatatttaacatcattgctaaagttctaacactatttttggaaatcatcaaaagagaaaagtgtaagacagacaaggaaaacagagaagttttccatgtttaatattataagtcaccacaaagtattattttgatattacaatttttttttttttttgagacagagtcttgctctgtagcccaagctggagtgcagtggcacaatctctactcactgtaacctccgcctcctgggttcaagcaattctcatgcctcagcttcccaaatagctcagattacgagtgcccaccaccatgcctggctaatttttgtatttttagtagagatggggttttactatgttggccaggctggtctcaaactcctgacttcatgtgatccgaccaccttggcctcccaaaatgttgggattacaggtttgagccactgtgcctggtcttaacaaattttaaaaatagtgataggcaaatacatctaatgaaactagagtattatttgtcatttctttggatgaaccaatgcatgtaaggaggatgtagttctgggtttctcctgtttcatcacacagtaacccaccgtggctctctcctccatgccgatattatataattgtcaaggcattgagacagattttaattcatttaataattaggtcaataaaaaccattattgctgacagtgccattaaaagtccataatgtcaccttcatgggggaaaaactaatatagttccgttggattttttccgtgaaattaatatgatagcatttcagtgggtgtcttaaatagcttaaatagacatttttattaacagaactaatcatagaattaaaacaaatgaaaatcgttacatttgctgtgatgaggtatccatgttcacaggattttatcagcctcattcctgtgaagaacctgaacatttactaccacaagaacagtatattcaacttgcctggagcactgcttagggtcccaaagaggctgcccatttgtgttttggtgatttcctcttcaacaccatggctccatttctcagagccaccctactgggaaacatgccagaaccataacctcctaaaccaaaaaccttcttcatgtcccctttttggctggtagtatttcatctagaatatctaagacagtatttcagctcagaaaaatactaaagcagaaggggttgcacctacgccgcccagcaatgttttatcacctctccttcctcagcttaatcactaacggtagatagatcttaacatgaactaaggtaaactctagtatagtgctatacgatttaggtaaattctcactagaagagcaagatagcaggaggaaagaagattataccaagagtttcctctcagacacatgaatgctatggttctgtgagttattcaaatgtgcaagtcactgtgtatggctgcatcattgctgcttgggtacctacaactcttcataatcagatataccaggattcacaagaattcaggggtggtcaatattgatcaaaggccaaggccacagatgtagctagcacattatacactgacagaacgcttgctaatgtacacaaagaagtagcggctggagcctgtgaggctgtgcaaacagtataggctttgggtttgggaagacccgcattagatcttagtaacttggttcccaacaggatgaccatgggcaggttagctcccttcagttttcagtttcagcatctggaaaatggattgatgaagtccacagttgtttgactctgtggtttttaggatggttcgaaagagatttcagatgaaacatatctaacaaacactgtggctggcagagagtaagggctattcttcagaggaaagagtcatctcagttggcattggacgtatttaaaatatgattgggagggtagcctctgctaacctccagccacgttggtgaactctcagaaagccttgtgcatgcccagacatgctgaatctaaacaaaccaaagggaagctgcacttctccactgattactccctttcctgccctttggaagattctagaaacactaggaaatctacttaaatattttttaactcagttttaaacaacatctctcagaaaataccattcttagtagaataaaccttctttgaaggcgtacatagacttacatatgtgatatttgcaaccaatcagcattttgggtgactgggcaggtcttgggaagtgggaggcacagtaaaaatgaaagactttgtttgacctccctgagttctaagcaagatgtggtgcctgagaaagcttatgcaggtcctactgggcaagactataaagccaagcgcaacagagaaaaaaataccttagggcacggacgtttggtttctcaaggcctgtgatggggaaggccctgaaactcccctaacagggatggaagaaatctgtggatattttgttcatgagaagtagaggaaaaggggaggggagaaagtggaaacagcaacgtgtctggaaaccagctggcacctgtgccttgaagtaaataaattgggtaaagaaatatgatagctagatagtcctagaaatgaacatcctgaaatcatcccataaactttattttggagggggatagggaagagaagagaccctttcttccatttatttcatttagttggtgatattattgggcattaacttgggattcactattcctgtggcaagtacttacctttgctgaaattaccaaatattctctgaaacagactcttatcagaaaattgatctataatacataacggtgtcttgcaagaaaaaagtcccttgtgggggcgattttttaaaatggttcactgcaggcctttcacaatcacatggaaatttggagattgctcagatattgtgggaagaggagaaagggaacaaagagagacataatacttgagactttacaggctcctaccattttctagtctattcgacaagagcagcagaggttcatatcaaggaagtgaaaaccattcaggaatacaaaaattgtttacaaaaaacagcctgtgctttgcattcttttctgttacttcgacaattgccaagaagtgtaactgtgcttgctcggtattatttaaattaaattatcaaatgcaaatgctaaatatgaacctctcagcaaagcactgggttataatgccatgtcctctattcagactaaaagctgattactggttctggagttacaaacatgtcagacaataatttaattgctttgcaggtagaggaatatgcagcgttcttgttctcattctggaactcaacacgactctttaatacaacataatgatcataaacacacacaaagtcttcgcctcacacctgctttatggtaaaaagaagctattgcaaatttctgcaaagctcaaagaatgaggcagtgccagattttttaatcactaagcaaaacaggtttctcaccaagtggcccgggcttttactcctggttcagagagttacaagacacattttcaaaatgagtttaaagctataatgaatttcaggtgcaaaggaccaccgtctaacagctaatttgcttcctgtcttcaactgagctgttaaccataggcagccagcatgtgcacccctttcttgggccactggtgaagacagatgtcacaatcaatactcattaactctgggatcagtgtgtatcttcctcaggaagagaaagggggtcttaaatgtaactaggaggactttgtaagcattttctgagcattgcagtggctgagtgttaaaccacaacaggacaggagtgcaggagggggagagaagaaaggggagggtgagagagggaagggaagaagaaaagaggccacatttcgtgatctcctctgtctctggagctcttttttatcagctcgtgaaattcccaaggatcctgatcatctcccccttcccagctcatcgcaaagagttgttgtacatttctttgcaattgggtagggaaagatcttgaaaggtggatccaacttgaacattagacttttgtgaaacatgatacagaaattgtagtgttgcagagctgtacctgctcatttgctgactatgatgacccaacatttattgagcactgtatgccaggcctgtgctacctcaatgcttcacctggagtaccttatttaatccttatggcaatcccataaccctataggaagcagtcatccttttatatatgatgcacataaaactgtctgaaatgatttgcacctaatgtaatgatggtaggcttaaatgctttcatttttgtactttgctgtgttttaacaagtttttgtgatggatttgttcttgtttttgcaaaatcaagaataacttaaaaataaaagactggatgccaatacaaatctcccaagatgttaaccttggttaattctgggtgatgagaacgtagatgattgttatttccttctttgtacatttctgaatgtttagtttccctatataagtgaaaatatagactttaaaaaagaaaaacaaaagaagaagcccttcactagtgccacagtgtgaggagaatgaagcctaagcctaaattttattaaacagcagggtgacccaatgctctgtatcaatgctagatacaccaccaagcattcgctacgcataatcccaccagctccttccaacaactctgggaggtaggtgtcaccaccctcactgtacagacaagcagagtgaggtttcgagtgggtaaaggaccagcacttgaggtcactcgggtatctggcctccacttacccttctggcctgaggctccatggcatgccctctgacctttgctcataccctggtctccagccgcctgagtccttgtctttttctgaccacaacctcaaagtccctaggtccatacctaatgttcacactctctcatttacttggaaagccattttccagactacacccattcttccaaacgtgtatcaaatactcccccttccacaaagattctctgagtcacctcagccttagtgtattcaccttggtgtagtatatgccacaggctgccacatggcaggtgccaggccagctcaggcacactgaatgctctgtatggcttatgcagtgtttaaaagatttaaaaaataattagacttgtattaaaaaaaaaaaatgtgtacctagtggctcaggttcccctaccctgcttggcaataattaactgtagccaaagcgtctgccctattcagacagaagcctgtgtgtgctctagttcccaacagtttccttttaatactccttcttatccttggcccatttctcttaattcattgttgtcaggcctctgagcccaagctaatccatcatatcccctgtgacctgcacgtatacatccagatggcctgaagtaactgaagaatcacaaaagaagtgaaaatggcctgttcctgccttaactgatgacattaccttgtgaaattccttctcctgactcagaagctcccccactgagcaccttgtgacccccgcccctgcccaccagagaacaaccccctttgactgtgattttccattacccacccaaatcctgtaaaacggccccaccccatctgccttccttgactctctttttggactcagcccgcctgcacccaggtgattaaaaagctttattgctcacataaagcctattggtttggtggtctcttcacatggacacgcgtgacaattgttttatgtgcccagcacatcacaggtgttcattgagggccagaaactagtcacttcactactgctataatcctagggagagagaatggtggtctgaattacaagcagtgagaatagagaaaagatattccaaagaatctgtcctctgaaattaggggctttatttatttattggaacactttctatcttgaactgtagtgatacgggtatacatcttacctattctacttgactgactgcatccccctgaagacacgtgtcaggtgccatgcctgccctgtgatatccccagcgctgcctagctgaatggtgcatacataccaggcacgggatgaatgttggttgactgatcattcattttaatcctgaaacctggcgtttatgtttccgctacatttaaaagctggcaaaacacatctccttccctcccactcactcaattaaaagctcagtacattaattatctgaattaaagtcaagagtctgagatatccctcccaatttataaagacagggacgaggtaaatttttttcccaagttgtagggacagaaagaagactaaagaatgaggaccttacaggcgagcacggggccagcgaaggattctgttttaagatcatctcctggtgctcattagtgctgttgctcttcacctgggtgagcgggcttgcttccatggagaagagacctccgccagctcctgctgcattaacggtctccgaatgtgatttggcggcagcacgggtctcattagagtgggggatgtgcaaaggcagaaggcctcactttgagaaaacactttgcgtatgaacaaaggtggaaagatgtcaggcttttaaagggaacctgcatctcgctcctcacttagcaaagtcatcaggagattctgctaagtaaagaagttctggaccttttcaagctattaaaggtgacccaacaaagcaaaatggctttgttccccaaatttctttttgtcagttgccttgaacaaccaagcctgaacgaaacagcctaagggagattgccaggtaataataaatccctatttgcttcagtaaaggacatctcaaagaagggataaaataaaaaatatcagaattaaagaggcacaaaaaaccctgaacatccggggcatgtagatgctcggtagcaatgaatgtattaggttggtgcaaaagtaatagcgattttcgccattactttcaatggcaaaaactgcaattacttctgcgccaacataatacttggggcctggttctcaggggtagggcttccagcattttaagtagcagtctgccatcaggcaagatgtgcatattcatcattgatgtggcttgatcatgacatattctgttttcttgagcaaggaaagaactcagcaacatctcgcagagcgaccatcaggttatgtccttgtctctggttcatttgaggagagtaggaaattatgaaacccacaagaagagtttatggctcctcctcacactcctacacttaaatccaggaagagactgccaggcgtcggtcaagtttgaagatatttaatggactatgcattatctacactgccccatttcaaggtcaatagctgtctgtctctttatcccataaggctaggttttcccttgaagaagaaggtactgctgttactggtagagggtgcctatgttcttggcatcttgaagaactggacaaaatgcgcaaacaaagcaaggaaagaatgaagcaacaaaagcagagatttattgaaaatgaaagtacactccacagggtgggagtgggcccgagcataggggctcaagggccccgttacagaatttttgggggtctaaatagcctctagaggtttccattggttactgggtgtatgccctatgtaaatgaagaggatgaagtaaagttatgaagtcatttacttggcgtatgccctatggagaggatagcccctgtcatagctcaagtgtgaatcagccttatgttccctgcctgcagaccctattttcctgtctcactgccacttgggtctcctgagaaggccctttgctgactctgccttctgggaactggcaagtcaggtgatctctggagctgccccacggtagaaagtgcagagcgaacagccgaggactgtcatgcactaagcatttggggaaaccaccctttctcccaggttggtgggctctctcgagacaggtacctgtacttacttggtattggagtgctctaatcttagagtctagtgtaggcttcaggggagagggagctaaggcggccattctgtttgctttgtttccaggccttgggtttgtctctagagggagaaagagtcctcctctgtctagcttgaagcagtgggaggctgtatggggcacggaataagaaactcaaagtgtccctttccggcgtgtcctgctctgtgggcacttactccttcagagcttgtgaagacagagataaaggtcagtcaagcccaggaccaggtgttgggattgttcttatccccaagttttctaatttcactaggaatattaaaggcaatttaatgcaatctgcattttaaagataaaagtgatggagttcaggacatgcttccccaaaatatggcaccttggcatagtgaatattttcagctaaaggaatgtgagaaggtaacagaagtaggaaggtctttctgactgttcgctccctgtttgtccttgcggcaggttagaagaccctcattggagaggtgccctgaagaaaggaatgttcttatctctgaagacaaagggtcacagagaagaatctgaacaaaactctgtgctaagtgtccccagtttattgccattagactacatcctttttgacctagaagctccaccttcaaagtttttaggtagccatgaccagtctaactgtagaaatggaatggaacattggaaagactgtaaacttggagctctaagaactaggttcagtttcctccacttatcagctttgtggccagagtcaaattttgcctctctgtgcctcagttaccttactacaaaattaggactattctgaggcttcaatgagggttaaccatgtactgagcatgatgctgggtatgctactctgtagacactacttctctcccctctcctctttggtgacttttaaagatcatggggaagctgggcgcggtggctcatgcctgtaatcacagcactttgagaggccgaggcgggcagatcacgaggtcaggagatcgagaccgtcctggctaacacggtgaaaccccgtctctgctaaaaatacaaaaatttagccgggtgtggtggcgggcgcctgtagtcccagctactccggaggctgaggcaggagaatggcgtgaacccaggaggcggagcttgcagtgagccgagatcacaccgctgcactccagcctgggagacagcgagaatctgtctcaaaaaaaaaaaaaagatcatggggaataatctacatgaaaatggatgttgtaaagcctaggacattacatgtgttatgtggcaagaggggtaaatggtagagttaatttttaggcctctcttaagcctcacaatggttctaattttgtaataaggtaactgaggcacagggagacaaacacttgactatggccacaaagctgataaatggaagaaactgaacctagttcttagagctctaaatttatactctttccaatgcttcgttccacttctacagttagactggtcatggctacctcaaaaccttgaatgtggagcttctagatccccagcggcaattcccatcaaggagaattttgcctgcttgactctctcctaccatccacagtcattgttactgcaagtgagttaaagcagttgagcaaatcatatatatatatatgggtacagggtttatatatatatatacatatatatgtatacatatatatgtgtatatatatgtatatacatatgtatatatgtgtatatacatatgtatatacatatatatgtgtatctccccagtgtatggggttagaatgcagctgtggaacatgggggtgtcctcttagtgactcaaaccaaattatcactggagaaacaatgagaacaacaaaatcaaatgcaaaccaccaaaatacaagtgtagtcctcatatcaagaaaaagataagggaaagatcttcagaaagcccctctattaattatttagtctcagctcagacagttccagaaacagaacagtgataaacaggaccattgccatacttctggagatgaggaaaacaccagaatagaaatcttcagtgggctagtatgggactctggctgtgatccctctcttatccaaaattctgctaagggacttgcctgagaacacacacagatttctctatgagagcaaaataagagatatatacataggttagataatgcaatgaagatcaaaaattacattttggaatgttgtattccatcttatggggcagcatttaatcaggatcctagtgcaatcttccatctggagccccaaatccaatgtcacacattgcgggttggggtgcggaagatctagcttaaccctagtgaggaagatgtcctgcctggttaacttccagctcagtgggtattagtagcatagcagggatgccaaacaggaacacactatggggtgtcatcagcaagaataaggtccagagctatgtggtgggttagaagtctgaaagtcagaaaaggctttggaagccctcttgtcttccattttacaggtgaagaaactgaggctgaatgatttgtttaccattcaggttacacagagagttaaagtcaggacccagaccttccaagtcccaggccaaagcaggtgattattctgtagcatgtgctgtccatattcctcggcagcagtatatcccagcagcagcataatttcagaaaaggaatgagaaaaggggatatatccattggagggtacccaggatcaggggtttcaaagatgcacaattctgggacacagggtgagtagtcatgagaagtggagatatggggtgggggtgcgtgatggtttccgcaaacacaggagaaagaaacattaacaacgtgggccgtggaaaaggaattaaacttgtttggtttcatggagcaggtagataactagtgggtggatcggaagaaagcaatttatatgtctgtggtgaaacatacacacataacgtaaaatccaccatttagccattttaaagtatatcgttcagtggcatttagtgcattcaacagtgttgtgcaaacatcaccgctacctagtttcagaacattttcattatcccgaagggaaaccctgcacccattaagtggtaactcccctttcccctacccccccagtccctggcaaccacttatctgctttctgtctctatcaatttgcctattatggatatttcatagaaatggaatcatacaatatgtggcctttagtgtctggggaagcagatgcttttttaacataatgaaaattgcaggatgaagagtgtggtttgaaagggggcttggtaatgacttaggatgcttgaattcaggccaaggctagaagtccacatggtagggatattgcggaggggcctctgaacaagaagtgggcttgaaaggctggctcttcagggcttttctgacctggagatggaggccctctctgacaagcccctgggactatctccctttttccccacaaccccacctctgccagtgatgaccagtctctaccctacggtaaaactcaggtccaaccacgtccactccttttgctaatttcccctcttttcattctcctcccacctccgggtctgttgacacttgcttgccaatttgcctgacacactgcagacaatcttctcactcaagcatgtttgacctgaacatacagctttctgctgagctgatctggagtttcagttggccgtttgggcagccagacatgaattaagaacagggataaacaaggatggcttgagctttaactacaccgatttggcccaataggctcggggataatctataagacctaacagctgagggcaataaaattagctacaaagggactgcggggtagaaacaatgtcttctgatacttcacacaacacacactcacacacaaaagacaccaaaaactctccgacagaagccttacaacagcttagaggagaggcattgtgcttgaaaaactatattttaaaaagcagagaggaaacccacggtgactgaagtatcattttcccggtggtgatcatggatttcatcccaagacctggaaatcatgttagaactacagtatcagcccagctttgtgtctagggcttaaacttgaaatgttgtttacataaatagttaaggaacacatactgggttgaagagtgtgctctccaaaaatgcatgtccacctagagcctcagaatgtgaccttatttggaaagaggtcttgggagatgttattagtcaagatgaggtcatactggattagaatgggccctaaattccgtgactggtgtccttataaggacatcaacggagggcagaaggccatgtgaagacaaagcggacactagagtgaatctgctgtaagccaaagaaggccaaagattgcggaaaggaaggattcttccccagaactttcagagagagcatgattctgctgacactttagttttggacatccagcatcttgaactgggagggaatgcattttggttgttttatgccactcatgttgtgccaatttgttacagcagtcctaggaagctaacataatacactcccaattccctcttcttttatacaattgtacaaccctatttgaaacatggaaaaggctcttagttctcacaaaaaaatctcattatatttggagttcaacttctgaacacgggtttagaaacaaatagggtctgatttcactgattttcaaagggctttctttgtaatgactggggtttgttttatttgtttgcttgtttccaggagaagagaagattggcctcagacacttccgtcttcagacctgtgcctctcctttgaggatcccttccccgaagctgccaaggagaaccttccctcacattgttcctcctttgttccccgctctccttttccaggctgagagacctggggccttggaagcaagcacacgctggctgagctgtgattcctccatgttgattataatttttatcacattatatgggatccctctggtggttactaggggatacgtcagttttgagagattggaacctaaccaaagaagcttcaaatctagaggataaggggactcagagtttacaagtcacagcaagcagatgctggtctgctttaggtgcctcttacggggattgtgagagggctcctggggcctgaggagggtcttctgaggtgtgaaaggctgtactggtggtccctgaaagccatcgtcatttgtgtgaggaggagtactggaggagctgtcttaccacatgaaaaacagcatggagcatcccagccacatcaaaggcacggtttgagccttgggctgtagaggctcagagagagtgacaaataagaccctggtgagagaccaatggggacagtatttccagactttggcatgaaacagatttctgagcacctcatgaaatgtctgcaagggcagctcctcagagtgaccctcccaaatcaatcaaagctggccccctatcttaattatgacttacaaatagaagcatgcacctggctggatgcagtttgccacatggtttacaatagcggtagaataagaaataacttaccaaacgagtacattttcttggctggctggggcactcagagttgacactggtaaggctccattaaaatgcctttatgttctgatatacacagatgtgttaatttatagcatattcatcagaagacataaattaattgctctctgatgaattttataacacctcctttatgcctctccaccctccccctccaaagtacactgaaaaggtcaacagcactatcgaatgcagcacacttcaacttccttccaagcttataattaaagctaattagtagctttggtaattagcgcatgtaagctttctgctttctgaattaataagactgagtcaggttttgagccaagtagacttttcactcactggttctgattcttgaactgtgtttggctggttaatttaaaacatgtctgttgaaagtggaatactagaaagaaaacatacttgtgatggtctgctctcaagccagtgtgatttatgaacaggccaaagtggaactgttgtcacaagagaaaatcagaatgctctgggtttccaataactgaccagtctcaacctctcagtgtgaaatgagttgtgcccagttactatgtcacatggacacaacacaacgtcaaggatgcccttgcacacttatgtcaccctctcataacacatctgtactaagcacatcaaatcctctttattttaggagaatgcagaggcaatggcagtggggtgccaagatataactaactgctcattttgattcaaataaaaatcaaagaggagaaaaatcattagtcaaatcagcttctgcttttgtgtagacaaagtgattctccaaatagcttcgtgtttctttttttagccagcatgtgggcatcctgcatgcccagacagaattaaaagtgcatgttttaaaatcaagaaatcaaatctatattctattaaaagaaaaaatgtgatttgttttcagactttagaaacagttgggataaaaatttccacgggtgagctcatttgctttttcttttcccatactaatctcagaaaatttatttttgttttttaaagaaagaaaggaaggaagaaaaagaaaatcacttagtgatttactggactccttataagtccaggacaatggtgggggttgctcacagcgctagtaattttgatacataaagaaaaggaaacagtcactgctgcagagagaggaatatataagacagctctgggtcactagagtaaatggttttcattttaatggcgcacttactgccactgtgatagccacatttggatctgtaaggggcagttaatactattcaagagcaaggcacatttggtcttgtggatggctgtgattgtgaaggtgacaaggggttatggattcccacagcctcacaggcccagctgaataggaagccttgtgcccccttggcagctcatcctaccccgtggcagctcatcctacctaggtggatacactccagtaagatctatacacagtggttctcaactgggggagattctgcccccaggggatacttggcaatgtttggcacagttttgattgtcataactggtgggagagggtagatgctactggcatctagtgagcagagactaggaatgttgccaaacgatcagccatgcacacgacagtcactcctcaacaaagatgatctggccccacaggatactagtgccaatgtcatggaaccctgatacagaaggtctaaacagggtctgaggccctccttgtctttgaggaagagttaaatgttagctttccagattgactctggactgatcttggccttatacaagtcagaaagaagtgagtgatagctcacccacaggggctagatctgagtcagactggaagaagtcggcacactcagggtaacggcagctgcctaaaagccaagcgctgggcatttttatgttgcagctaaggccagcatgctgcattatggatgagctcatgtgccatggcaaacagtttaagaacgatgcttatatttaatgaatcctaaatggtttattacagagggtcaagtttctgcttcctgtgggaatttgacatttatgaaaatgcacgcacattaattattcagtggagacgtccttcctatggaaattcactttcctgtacactcgacaggactacattccctgtctgcatgggctactttgttgttaatcctctaagcattaattaaataaaatttgcaaccgagccaggatgcatctaccctcaaatgttatgcaaaagacagttaaatgctgtttgatttttcctgctagtagccaatcattacccatagctatttatgttcttccttttgttctttaaagcataaacctggtatctcttcccactgagaagaaaactacgctcagtaattaaattacaccacattaaacttacttaagttcaccagcagggaaaattccgtgcccctgggtttaacagtaagtcctaatcacgcttgcaagccatatcttttctgtgagttgttatagttttcattcctggaattccattaaaaatggtaatgtcattactcctgttactgctcaaaaccaacagcataatcctgaattttaattagtaattacaattaatcattatttcattaatgaaatgtttagttggtaattgtctttgagcaccttactccctaggcttataagcatttcataacatctaatttgttgcctgtttctgatgaagtggcactgtcaaccttattttatgttaacactttgatggggctctgcatcccaggcctgcaccaccggctgcatatttacaccttggaaatgtgtggcttctggctctcgataaggttcgcctgaggacgtaccctcgcattctttcctgccagcttaagaaggcgactgtttgtgctcccagagagcacagcatgtgaagagagaaataataattcctggaacgcttacttaataataaatctgggatccaaattcatggatttttgagaggggatagagcaaggatttggaggtagtctttggaacaggaaggttgattttaaaagagcttaaagaattaagaataagctgggagggttgtcaagaatttaacacgaggcaagatttttgttgatccttttgcaatagcaaagatattcttatttattaggatggttttttaggggtgaggggaagcttgtcttccccaccaaaaggtcagggacccaagtatgccttgcacacagttgtattcctagctcctggtgcggggttgggcatacacgtgactcaataaacagctagataagtcattgttcctgcatggcctatggttaggctatgaagggggtaactgaggtacaagagttaatggtggtttggtgatggtagcagggtgtgggatgctaggagatgccaaatcagtgggctggtgtgctcacaaatgacctgatgtcatagttgtctgtcactgacaattctaaaaggacggattcatccgactgccctctatgtaaaaaaatttacacatacacacacacacacacacacacacacacacccgacggtgaattattcagggaggagaaagcctgctatccttggcaaattaaacaaggaggatttgagcaaagaaaagatgtgctgctgttatttcaaggaagtattcacagcttcagaattaaaactgagatggaacaacatcagacttgttggaaaatgctccgcgtctgtggtgtatttcagacaagttagtcagaaaattcaaaatatctggaagaaataaatgacggccaacagtttggtgttggccaccaggtgccagagcacgtatggtcttggcctaaggtgagtgaaagacaggtttctgggtcaagacaggtgtttccaaatggcaatttttgaggctgctgacattttacaaaataaaagaatgtgataaagcttaagtttttggttgtattttataaatgtctatatttaagaagttcatgctttagcacacataagacattcaacaagtcatttggaaataacatcaaatgtcgaaatttgagaccctttataattaggagtggaggaccaagtggactccatcccttgtccccacataggtcctatttctttcctaggccacacagcttttaaacataatatttctcccctattatccttcagtatttatagagcatccggcctgtgctaggagcttgaaaagacagtccctctctcatggagctcccaatatagaggccctttccctttggactttcttctactggaaattgccttttcttgtgtagttccctttgctgactctgcttgtcctcctgttctcacaaaggctaccatgcagtgggggaataaatatgaaaaaaaatataagatcattgcactgcagagtgaaggagcaaatcccttaacagtcatgagtacacattccagctcatgagcataaagccacactattcatagaaatgggtgatactgattgtacacttaccatgtgtgaatattgtgcttagtatatcacatggattacatcacttcacctgcttcggagaacctggattgagcataatggaaattaagagttggcccatccctagatccacatctgttacctgctttgctggctgcctgggaatgaggtcttgtctgtctgttttttgtttttttaacttcagctttggcctggagctgcagcccaggccactatggaaggaaagggaatgtagcctttataaaatcatctatagcctggtgggaatgtcaactagtacaaccactatggaaaacagtgtggagattccttaaataactaaaaggggaattaccatttgatccagcaatcccactgctgggtatctacctagaggaaaagatgtcattatatgaaaaaaaatacttgcacacacatgtttatagcagaataattcgcaattgcaaaaatgtggaatcaacccaaatgtctatcagtcaataagtggataaagaaattgtggtatatatatatacaatggactactactcagccataaaaaggaatgaatgaattaatggcattcgcagcaacctggatgagattggagactattgttctaagtgaagtaactcaggaatgaaaaaccgaacactgtatgtcctcacttataagtgggagctaagctatgaagacacaaaggcataaaaatgacacagtggactctggggactcaagggaaaagagtgggaggggggtgagggatgaaagactacacatcgggtacagtgtacactacttgggtggtgtgtgcaccaaaatctcacaaatcaccactaaagaacttattcatgtaaccaaatactgcctgttccccaataacctatagaaataaaaaaaaaatttaaatcagctagagccaagcagaaataataaggaaagtgaattccaagaaaaagtatggaattctcttcaaagcataacagaaaatgttttgccatttctggttgttgtcatgaagcaaaaaaacccacttgcccacttggcatgtcttacctgacaaaaactacaaagaaaggcctgcccagggtttctgcaagtcctggatctgggaggctgtgtctcacagagagtgacagccaagactgaataactgtgagactgtgggcaagctggtgagttcttctgtgcctcaagttcctctatgtaaatggggacagtgatccttgctcttgggcttgttgggaggattccatggaatgatatgtgacacctggcacacagtgtacactcagttatcatcacatatgtcatcttcaatatgatttttgccaattagatgtggactttttgcgttcattaaaaatttaaacaaacaataataacaacaatcacagtgagtttgggtttataatactgtggatttcttccttggcatgattggagataaaagaaggaacattccatgtgatgctgtgaggtcccaggaaaggtgtgacagagaatcctgagtcatgcttacctgtcattactagtgggaatgagagccatctgggatgacctaagtgcatattgtttgcagacagtgataggtgctcagggagcaggaaagtggagcatgaactcacaatagaaggtaggagcagagacaatcaagtcctatcctaccagatcaactgagagatttctattccctaaagttccacagtctttgtacccctctcaccatgtcaactttgctctccttgaacgatcttatcccctctcttgaaccatactccctgtttttctcacatttacgtccccttcaggatatggcaaattgtcttatgctcaggaaacatttgctgaatgaatcctctggagatcttcagaaaatcagcatattccaaatgaagtgactgagacttaagcaagagacccagggtgggatggacagactcttgaatagcatcttgatctagaccagtataaactcgtgggacctaaacaaaagtggacctttgttcagtgaagaagattcccagggagcaggtagaagcagatggagctaactccagatacaggctgtgctctccgcagaccccagcgtcttcgtagataggaggtttagcagatggtgtttttgcattaagtttctaaattaccatctataagatcctctgttttctaaaaactagttgccttaaggctttaagattttaatgtaattttaatgtttgtgtgtgttgttagtgtacctgtttctcaggtttgctatcccagataggttatttgctaagatcagaagaaaatcaattggcaaaagaacatgctcacatgttacatgttattaccagttggaacaagagccatctgggatgtaagactatccaccaaacgggtgtgtggaactgtcccttggcattgcacaggaggaccacttttagtatgatttcctgtgctgtggctatgacatcagggaggctgaggcaggatcacttgaggccgggaggtcggggctgcataatgagttctgatcgtgccactgtactccaccctgggagacagagcaacacccgtcactaaaaaaaaaaaaaaaaaagaaagaaagaaagaaaagaaaaaagaaaaagaagaacaaattcagaagctacaataggaatagttcagaaaccatcctccagccttttaaaggcacagaagagctttgtttcacattcgtttcggcttccaaagcaactagtcaagtcagtttcacctgttttattcacaacagttatctctccaatccagattccttctttaaaaaaagggaagaaaaaacattctcatatttcttgttttgctagcaagaaatgagctgcagaacactttcagagatccactagctgttttccttaagctgaggctgagagcttcaggggcactccaaagaaagaaagaaaggaaagataaaacaaaggacgagaggctggggggaagaaagagaggaagggagggagaaactatagagaccactgtgtggacacccacaacttctggttctgaggctggtgggaaaggaatttgcaatagaagaggaggggaactgagaggagagcactgtattaagagcttataggaattctaaaaagaaaaaaaaaggaggcctttgatccattccaaagagggaggcagaaaacttcaaagcagaataacagtcccctgcactctgccctactctaagtacccggagcattcattatgaatcagcccacctcccctcggcccacgtggggctgtgcaagccagacacgcaattcagacccacagcttgttcagcctccccgagaacacagcgtgtgcaaggtttgggaatggaaatatagcagggtgcccactcctaagtggggttaattcacggatgtggaaggaatctctacctttcgcagagactgctagaaacaccagcttcccttctttctcttcaaaggaagatggtgtttttttctccttaatcctgagtcatttacagtaagatacacgtaaataatagtccaggaggtaaaatgtgatctacacagtctctacctcaaaaataagttttttgggggacttgtttaccattccgaatgtgacccggcagccctttacaaaaagtaacatttgcttttattagatacagcagatctatttctgtgagcaccgcagatgtaactgggattcatttttactggatgtctcagaagaccgggccgactgccagctctcctggacacaggaagttacagggtgcggtcacttctgctcacccatttctccttcaacagcgcagatcacatgcacagagttcttaggagacaggtcttccccaaggcaaaggcacacagaaatgctttccttcccagctgccccttgatgaaagaaactaaacacctcttcagcatggatatgacactagccctcggcttcttattttttgcaatgactactctgtgtcagagtcagtaaaaatcgcaatgcagagaagagagataaaaagaaacatcctggagaattctcctggttatttttaaaatattgtctctgttgacttgaagtggtgtagaaacagttccatatgctgtgtttcttttttcctgttgcatcttatagtttaaacatagatcttttatcggatacaacttctgttaacaatatggcctactgggttagcaaagaaaccgttcttttcttacagttctggatttggggaggttgctcacatttaactgtggaaagcattatgctcttatggtctttgccaattcttttctgtaacacaaacctaaattacataccaatttctcgaggttcttgcctagtttggaccaaattaggtcccacaaattcctgatcttagcaactgtgtctctcagttattttccgtgagacaatatgtttgtctgtacttcatattgctttgtggagacaattaccagtgctatatccctatttttctttttcttgaaaaaaaatttaatttttagaaattatttgtataggaaaaatgttaaaatagaaataagaatataacctctttgaccaccctgctccagtcctggtcccctccctggaggtagccgtattagcagacaggctcgtgttcttccagacatttttctgtatatttgcacacatctaaatacatagtcatatgtcttgtttttgttgttaccatcattatacaaatggaatcataccatagaacagatgcctcataatttatttacctattcctctattaatggatgctacggtctgaatgtatctcttcaaaattcatgttggaacttaagacccaatgtgacagtattaagaggagcctttggggaagtgattaagacatgggggctctaccctcatgaatggacttagtgcctatataaaagacactgaagcaagcactctggtcccttctcccttccaccatgtgaggacacagtgtttgtctctttcttcctgtgaggacacaacaagaagactccatgccagaagcagagggcaagccctcaccagaaacccaatccgctggcaccttgatcttggacttcccaggctccagaactatgactaataaacttcttttttaaattacccaggctaaggtattttattgtagaaacaggaatggactaagacaatgaatatataccttgcctgttaatttgctgagaaccaaggtttcattttcaacatttactagctaatctagcctagagaagtacaaagaacccaggacttggattttagtccaacaatactactaatgtccaggtaatcttcggcaaatgatcatcctctttgggccaacatatcctcagctgtcagaccagtgggcatgtacagtgaacaacttagtaccaggtactacaacaacttacacatgcctaggccccagggcaccatggtgattctgattcaaagctagggctaagattggctacccttagcaaagaagagttactgatgtgtaggtgagaaaaatgtctcacgatttagaacaggatgggacaaactacatcccatgaaccaaatcagacctgccacctattattataaataaagttttattggaacacagcaatgctcgtttgtttatatattgtctttggctgctttagtgctaaagtggcagagctgagtagtttcaacagagatctcatgactcacaaagcctaacatatttgtcactgggtaccttgcaaatgtttgcagacctctgctttggaaagatccctatggtcacacagagggtggggaaggaagacaatttagagtggtggtggtgatgggggtctgagtcagggcaagagaaaagaacaatgtgcgagacacaacacaggcagaagcacagaagttgtgactgactgaatggataaaagtatgagaaacagaagttaccagtttcatatttccaacttggaggcttgggtgattgtcattaaccaagatgagtgtcatgaaaggaaagaagatgtttatgggaaggtgagtaagattcgaattagggactttctgaattcaaagtgcagataaaggtgtccaggaagcagttggaaatatgagtctaatattcaggagagaggtggggctggaggtcaagcttgagcgccaccatcttggagatgagagcaggtttcaggtgagcagaccagaccaaagagggaaaaacatagaggcaagatatttgaggaagaaattctgagaaaccccaacagttaaaggactggcaaaggaataaacctgagaaggagcaatcagaagagtagaagaaaacaaacatgataatatttgtgaaagcagaagcaactgatgttggcttttataagaggtctttgttgggctcatgtcggggtaaagagtgctctgaggatttggtgcctcttgtcagtgtcctgtggtggcttccatagaaaacactccacacccattatctgcaaggagacagctgcagttttgcctcttcatgtggtttcctcaaacccaccccctgggaaatgcaatatgattctctcacagagcagatgggatgctaactggaatcacctctgccttgcagagttctccctcagttgctccaacagtgcctggtagtgtaaacaagactggcttaccagtgcagcattcaataccagtgcttacccagcagccattcaaccagtcctgctgatgccccaccatgtgccagccaccaaagcatctagtgccaagattacaactgtttccttctgctcctggttcttagagtttttttttaaaaaaaatatataaatgatctgcatttagtgatatatttatttttaatttttttatttccataggtttttgggggaacaagtggtattcggttacatgagcaagttcttcagtggtgatttgtgagattttggtgcacccaacacctgaacagtatacactgaacccaatttgagtcttttatccctcacccccaccaatgctttcccccgagtctccaaagtccattgtattattcttatgcctttgcatcctcatagcttagctcccacatatgactgagaacatacaatgtttggttttctattcctgagttacttcacttagaataatagtccccagttccatccaggttgctgtgaatgccattaatttgttcctttttatagccaagcagtattccattgtatacatataccacaatttctttatccacttgttgactgatgggcatttgggctgtccatatttttgcaattgtgaattgtgctgctatgaacatgtgtgtgcaagtaccttttttgtataatgacttcttttcctctgggtagatacccagcagtgggactgctggatcaaatggtagttccatttttagttctttaaggaatttccacactgttttccatagtggttatactagtttccattcccatcagcagtgtagaggtgttcccttttcacagcatccacgccaacatctattactttctgatttttttttatcatggccattcttgcaggagtaaggtagtatcatattgtggttttgatttgcatttccctgatcattagtgatatcgagcattttttcatatattttttgaccatttgtacattgtctgttgagaattgtctatttacatccttagcccactttttgatgggattgtttgtttttttcttgctaatttatttgagttccttatagattctggatgttcgtcttttgtcagatatatagattgtcaagattttctcacactctgtgggttgtctatttagtctgctgactgttccttttgctgtgtagaagctctttagtttaattaagtcccacctatttatctttgtttttgttgcatttgcttttgggttcttggtcataaagtctgcctaagccaatgtctagaagggttttttctgatattatcttccagaacttttattctttcaggtcgtagatttaagtccttgattcatgttctgttgatttttgtataaggtgagagatgaggatccagttttattctcctacgtgtgacttgccaattatcccagcaccatttgttgaataggatgtcttttccccatttctgtttttgtttgctttgttgaagatcaattgactgtaagtatttgggtttatttcttggttcactattctgttccattggtctatgtgcctatttttaaccatgctgttttggtgactatggccttatagtatagttcaaagtcaagtaatgtgatgcctccagatttgttctttttgcttagtcttgctttggctatgtgggctctttttggttccatatgaattttagaattgttttctctaattctgtgaagaatgatggtggtatttttatgggaattgcattgaatttgtagactgctttaggcagtatggtcattttcacaatattgattctactcaatatccctgaagaacacagatgcaaaatccttaagaaaatacttgctaactgaatccaacagcacatcaaaaagataatccaccatgatcaagtgggtttcataccagggatacagggatggtttcacatacacaagtcaataaatgtgatacaccacaaaaacagaattaaaaaaaaaatcacatgatcatctcaaaagatgcagacaaagcatttgacaaaatccagcattgctttatgattaaaaccctcagcaaaatcggcatataaggggcatacctcaatgtcataacagccatctatgacaaacccacagccaacataatactgcacagggaaaagttgaaagcattccctctgagaaacggaacaagacaaggatgccctctgtcaccacttctattcaacacagtactggaagtcctagccagagtaatcagacaagagagagaaataaagggcatccaaatcggtaaagaggaagtcaaactgtcgctgtttgctgatgatatgatcatatacctaggaaaccctaaagactcatccaaaaagcttcagaactgataagtgaattcaacaaagtttcaagatagaaattaacgtacacaaatcagtagctctgctatacactgacagcaacctagttgagaatcaaatcaagagctcaaccccttttacaattcctgcaaaaaataaaatacttcagaatatacctaaccaagaggtgaaagagtgtacaaggaaaactacaaaacactgctgaaagaactcttagactttctctatccctatatttggaaagaaggttggaggaggggtacagaaggacggagggaggtagagagagtgttaaagaagaaggaaaggggtaaaaaagaatgggaatagaggcatggactagaaactaattagatggtgaggcagagaccttgcattgcgtatcttacatgcactggcttggcagccttgagaactgatgtgtatattgaaagcaacagcacatgctaggtgtccagcataatacctgacatatattaagaactcaatacatgtctgttataataatatttttgagtatccagaggaactaggccagcctttgaattgataggccctttggtaattttcatacagccatgtagcaaaacttatattaaataaattgggggaatttcatattatactacattccttttgcattctcactggcaggagtatttagcctggatgaaacttgatacttcaaaaagaatcacttgctaaagggagaagtgagccccaccttctgttaggaagatgtggtgagtacatcaatattacaaagattcagtgtgttaaatcaatatgttcaaagtagtttaaatgtccaatactggtttccaacttctaacttttctctatcctctctctcggcctcttttcaaccattccttccttaatccttccacccatccctctcctaacccccaccattgtagactaatttcttttggttatctttctaagcctttgcacacttttccctattgacgagctttgctgttaggattctccagctacttctgcaaagaggttttcaaaggacttttgaaaatgcagcactgtgtatgttttggtaaaataaagcaaacattttgtgtggttgggtttgttgtttgaagtgttgcagtctccctctggggcctcctactgtcttctgactagcacctcaacagcatcccttcctgctgatttgcagagggtttgattctttttcaatagtgcataatgctgctgtcttattgcctgtttgctttagttcatatttcttctccagatggattttctatgaagatcatccctatttgtttgatctttaatttcagaccttgtcattttcttttcgagtatgcttttttatggatgtttcttttggcagaaccacttcctatgagcctcagtgtgtgttaatggcactttcatttattatcatagacaatttcaatttctagagggatagttgagttctgttgtggttcaaaggagaaataaatcctcttgcaactttggctattttatttcacttcacttttggcctcagaggacgagagagaagctgagaacattagccacatctgtccatgaagatttctccaatatcaatttgctcccacacctgatgtactgaatactcagaaaaatgctcaggctataaaaccatgtctaaggcacagacagtttaagatcaggctttgaatgaaggcctcagtttatcttacacattactgaagcccattctatagaagactaatagtttccacaggtgtcttgggtggagaagggaaaaaagtcaatggactgagatactattggtctcaggaatcatttgcccaatctaccctaggccaagctttgaaggacaggccatctgaattcactgagtgactgaatcccagcacaggaaatgttgatattcttattgattctttaatggccattttatatccaaccatccagccatccatctatgcatttatccatcatttatagtaatgtccctaaggctgctttcttgctaaaaataaggaatattgacagctgaaactcactttattattctgccacagttttaagcatccctgcaaacacgacttctttaacgatctccagtttaattccacagtatggttccctatctgcattattctctcctactctgatcatcttatttatttatttagacccagggtctcactctgacacccaggccggagtgcagtggtgcagtcttggctcactgcagccttggcctctggggctcaggtgattctcccacctcagcctcctgagtagctgggactacagttgcgcaccaccacgcccagctaatttttttgtagagatggggtttcaccatgttggatcaccctactttaaaattgtaatatagttcccttttccagcaacttccatttggtttaacctgttctttattttttctttgcacttttcacctcctagcctaatatatattgtacttatttactatgtttacagtttgtttattggctgcttcaagaacataagctcctctcaccatctactcactgtattctaagtgtgaggcatatggtgggtatttggtaagtatgtgtaaggcttcttggggaaatgacccttcagtgcctttattcaatactcaagagtgtttctcagcccctaacctggcattgtaggagacacaatgtgcgcgagtgcgcgcgagtctcatacacgggagtctcagcgtgtgtctcatacatgctgctggatgtgtggcatgcctggcccctgcccaccaattgccagtagtgaccttatcatcaatgtaacaattaaaaacaccccaggacatttccaaattcctcatatggctccagtaaggctttgcttgataattactgcaagtcttagaataaaaccatttttttacactgtgtttccacttggcaaataattagtccaccttatggcatcctaagggcactctcagagataatacactttcttttttatatgcctccctcaacagatttcaaaatcctctcacacaattaaagacagtgatatttaatggtaaaactcagctgtcaatgatgccttctatgtcagtcattaacaagccagtaaaccaatatttactaagagcttttgagcctgacttcatgccatgcagtgtccattttatagcacaaatggtaccccacccactaaggctgtgcctgtgttacctgcggtcagcatctcatctaatccttcctcacattttagcaaaaaccaggccctgcagtcaaagaacaagtttgactgatttcttttcactggactggtcagttattcaaccatgatggacaaactgctgagttaaattggaataacacaggccaagagaatcacatttaaagtcagagatggcaaaaataacagacatttctatgacagaacatcaacaaataattactgattgtctactggatacaaagtactgtggtatagggcaccagaaggtgtggttaacatgacatcaattgtcattctgctgggtgacaatgaaatatgtataggaatgtatactaatattcagataaatgcagatactgcgagcagctatgctaagtgctttacaggcacatatcacttaatcattaacatgaataccataggtatccctattttatagaagaggaagctgaagcacagggcagtaaagggacaaggtcactcagtcgggaattagtggggcaacagtttaaattcaggtttctctcatgccaaagggtcttaaccactgtgtgataaatcaaatagttttcagttgtctgaaattttcagttttcatttactttggttgtgtaggcacaaacacaagaagatctacagataatgtatattttttaacttcctttaaattaatgcatgttggattgctctctaccatttgccccatctaagtctttgtagttggaatccatcgttctctgcaaatttgacatttgatcataaattgctcatctcgagatgaattacaacacctcacattaaagaggcacttagggagacatttctattccatttcaagagacttatataagaaccctttttgatctttcctaaaattaaaatgaaaagccacattttggcaacattatggaataatacaaatgttcaattctgtggaaaaaggtagagacatgactgatcatttgatatttaaggcaaagaaatagtggttttatttgatttttcattttgaactctgtcagactgtgatccttttttctatcttcatagtttttaaaaaataatcatcagaaacaagaaacaaagagaaagcagtaaaacacattttctttgcctccaggattgaagacattttccccttggcatgtacctactaagtaggaaaacctagaatgaaagttactgtgttgcttcagtaacttctaagaaatcaatataattttggttttctgctataactctcaaagcatatttgatgtatctcttagtcattgacaactttctttatactctgaagcaaagttatcccagccaagtgtatgtggctgcggatgataaagtatggctatttgaagtttgcttcttcttaaagagaaatgcaaagttcccagaaagacgctagatacaacggttcacatacacttcacaaggcacttgcctaacttcttggaccaaattacattaaatctttgagccaagaaaattaactcaccactcattgaaaaacagtatttcagccatgtcatatctttggttaaggcagacttaacgggaaaatctctttccaatatgatatgtgattcctttacaagtacacagtttgttaagttttatacttttttaagaagtagaggttttttgtttttgtttttttaaccaatggtactctctctgtgtgtgtgtgtgtgtgtgtgtgtgtatcctaccaaattccttagttaataagcaagacaaatttattcacagaactcattttgtattatgtaaattttccaagaaaaaaaagaaaatcttaatttgtgtttcaaagcctctctagtttaagcacaatgactttgaagaaacaaccaaaaaaaagataaaatgtggatgcagaatgatgtttattttacatgtatatggtacacattgggtaccaaaagaaagtcatggttaattacaataatcactctagtttggccaaataacatggaactaacgacatgaatttcaactatggatagtaatattaagtgggttgaagtaatctctacacaattaattttttctagtgccttggcctctgaaaacttatctttggtctatatggatctatgtgcatctaattaaaggttcatatttgcaatgcagggttttagttaagggaggttaaacatgagatttccttagagcgcctcagtgttcatgggcctctatattctcatatctctgcaccagcagtaggaggatgtgagagcccagggagccctcgaacttcaaaattagatctgtgggagaaaacatgtaaatctcagccagaagaatctatgcctcctttttctcccatgctgccttactcatagcactgatagcatgcatgatctgttagccttcactatccttgcagaggaactggattcggtggtatggaaaagacatatactattccatgaatatccatgtgctctgctccatttcctgttcccttgcagataagtgagcatactctgaccagttctggccaagggactctgaatgaaaatgctaccttaaaggccaaagtatttaagagccagcacatgactctccagctctctcttattctgtctcagtgatacagaggctgcaggcccaggtgtcagaattatacaatacagaaaatagatctcttataagggagtttgtaagaaaattggccctagagagccaccagtcccttaaaagagtttatatgacagcctgggcaacatagggagaccccatatctacaaaaataaaaaaaaaattagctcgtgcctatagtcccagttacttgggaggctgaggttggagggtggcttgagctcaggaggttgaggctgtagtgagccatgatcacaccactgcactccagcctgggtgacagagaccctgtctcaaaaacaaagcaaaacaaaacaacccccccctcaaaagtttacattagtggcaaataaactttgttatgctgggaagatattaccaagaatagcttagtttactgtgacaatttaaatcaactgctaagataaccaaagtaatcagaagctataacaggacataaatgctgagtacaaatatttatttttgtacctcctctattggagaaaatctagaaaataaattcaatatatattccaaaggaaaaaggaggaaagtctaggaagtttttcatttgggataaaagccaggaataaatatatgactttcattggaacattttcaggcactcagagattcagagatatccttaatgctaagtagatgtataattagctccctgtttagggactccaaaatgtgccatgtcaaaactgtctcctgaaaatgttgctttgcgattccaaaagcaatcagaggttgttgaaaaatctttgggattttgcagtgtgcagttttccccaacaggcctaacattaatcattataggaaaaacattcaaactcccccattctttcatagtctagtctaaacattcaatgcaatatcataattctgcagacataaattccctcattatctgtgggccaggtcaaccacagcacagccagccacctagcagacccatgagcagggccttttgcaaaggtgtagcactggccctcaaaaagacttacagttaagcactccaggaggctgcaattgtgcacagcagccaacctgtctaattgggtcattttttcactgggtgatttatatagaatgtggactcaaggctgactgctcttcgaacagtatgactgcttttgtctgactgtaccaatgaagcaggatggggttgctggtatttaagaccaggcattctggtcccaaagaaacattgctttgggctgtagttctgtgttattgcaagaagcatagtatccgatgttaccagtgtgggctcagttacttcatctgtaaaatgggaggctataaccccacctacctcttagggttctcgtgaagatgtgcttgagaagagctgaaacagtgtgcctgacacagagaaagcattcaatgaatgtgaaccatttatgctatacagcattattactgatatgaagtattagtgatacattattgatataattatcatcaacattatctgtgatgctggtgatatgatgatgatgatgatgatgatgacagtaataatcattttctgagtgcttgccatgtgcttgccagtctactaagtgcctaatgtggattacttagtgaatcctcagggcaactattgagactattatctccttttgatgaatgaagacactgagtcttagaaaggttaagaagcttgatcaaagaagtaataaagctgaaatagaagccaagcagtttgacttccgagcctgtgcccttagttactaccctctaccccagcattgacacaaacacaaccacagcttttattagttgtccttataatgacttagcctcatgcgataagactgtctgtcccagatagagccacaagttacttaacatatctcagtgtcagcagccacaacctgctaggtaactacaactccaaagtgccctgcctcctgaatgagatggaaaatcagtggaatagggaatgggggttctgcttggaaataacctgtaaccagaccagttaaggtggaaaggggtggctgtgaaaaatgaaaacaataaaacaaaacaaaatgccaaaaagcagggtgatatagagagggtttaaagggtattgctcccctttcactcctagcctgggattcaatttgtggccaaaagctgatggtaagtgtgtgtgtattgcagccatagtcagcagagcaaatggggactctcaactactggtcctacttcccctaaggagctgggtagttaacatgttatccctgcacctgagtaaattaacccattactccttacccagtgatccacttgcccccccatgatgtgcactgtagggagttcatgctgtttagctcagaaattctaagttcacatggagtccagttttcctggattgtaccttaagtggttgattgttggagccacttcatatctatatttaagttagactattgagtactgtccctcagtttcaggagccatgggagcaaatcgaggggcaaaagttacttctggatcttcccaatcatttctcaaccattgagtcacagcctgtgacaccagacgtctttaacttaactccaacctcattgtgctaggttctgttttctcctcaattatttttttttcttgctctaagaaaaggataatacacccctaccttatctgtaacatccagccacattgtctggcttggttatgtgactttctttgcccaaaggactataagcagataagaaatatccatgtctacatagaatctttaaatgaggttgcaaggcttaactttctgcatttttgtcctctgcattgtgaatagcatggccccgatgagggcttctctgcttcagcctaggtcttggaataagagatgcacagaatagagccaagaagaagtgctgccaaccacagactcataaatgagaaataaatatttgtttatttgggggttgtttgttactgcagccgaggctaatacacaaatttttcaataagaactcagcctcagcttacatcatgtgcgcaagtgaatctggggatgctaggggctatcttccctatcattgagtgaaagactatttatgtattaagccaacaggcaaggacagaatcaagaaatgttgtaaaagtaagagctccgagtcctttgagcccctgaatccagctgtgcctgaagacttaatgctacatgttatgattatgtgagccaagacatttcttttactttagctagtttggattaggtttctaatctggtttaaatgaatactgacttatatcaggtctcctcactcttttgcaatgatatctgagcacaagcatatatgacatattaagtaatagtaatcacatgggggtaagttacactggggtataaatcattgtaattgaataagcctgtcatgggttgaactgggttccttctccacccccagcttcaaatggatatgttgaagtcctaatcactactacctcaatatgtgacattatttggaaatggcattgaggatgcaattagttcagatgaggccatactgaaatagggtgggctcctaaacttatataattgatgtgcttataagaagacagccacatgaagtttgagatacacataatgtcttgtgaccatgaagacagagattggagtgatgcagctacaagccaaggaacatcaaagatcgctggcaaactaccagaagctataaaccaaaggcaaggaaggattcctctacaggctacagagagagcatgaccctaccaacaccacaacttcagacttctagtctccagaactatgaaacaataaatttctaattttttaagacacctagtttgtaatattttgttatggtggccctaggaaactaatacaaagcccatcaggtgaatttttaccaacagatcccatggaaaacttctgatggaaatcactattatactcatgaaggtcattgacagggtttggctctgtgtccccacccaatctcatctcgaattgtaatctccacatgttgagggagagacctggtgggaggtgattggatcagggggacagtttcctccatgctgttcttgtgatagtgagttctcaagagatctgatggcttaagtgtatggcacttcccactttgtgctctctctcctgccaccttgtgaagaaggtgcctgcatctcctttgccttccaccatgactataagtttcctgaggcctccccagccatgaggaatggtgagtccactaaacctctttacttataaactattccagtctcacataattctttatagcagtgtgaaaatgaactaatacagctatattgccatatctatgtccacacaatatccagagacacagaaaggaaaaaggaggcagcacaatgcaatggtcatgcacattggctgaaagatcaggaagacctgaattcaagtcctagtttgttcatttactttaggtgatttctgactccagtgttctcctgtacatcacagaaaaatccattgtttcattcatgatgttttatgagagttaaacgaggtagtggatgggaggtgctttacactgtgcctggcagagtatatttgttaaacaatagatagatagattagctaaatagacagacagacagataggtaacttagacatatagatagatgatagagagagagagacagagagacagacagacactttgggcgactatcaaaatattataaactggttggcttataaaaaacaaacatttacttctcacacttctggaggctagaaatccaagatcagagtgctagtatggtcagttcctggtgagaaccctcttccaggttgtagattgtcaactttttactgtatcctcacgtggtggaaaaagaggaagttagctctctgacatcttcttataagggcactaatcccattcctgaggggccctatcctcatggcttaatcacttatcaaaggtcccaccttcaaacaccatcacaatggagattatatttcaacatatgaattttgaaggacacaaacattcagtctataacagatagacagatatacacacataaaaatatatcaatgcataagtctatagatatgaaggtctgtatctttcctgcctatataaaatttaatcaaatcattagcagttaaatagtgaattttcaacacattcccaaatagttttaacttacttaatatgttgtgttggtggtaattttcttgttgttgttttttaaactgaacttgattgacctgattttatgtagatatgcaaagataccacttactcatgcagaccttgttgtgtaaataacccaatcttctgtctttgcaaagacaatctttccctaagagttataatctcctctcaacacatcgattatatggatcaaaggccctctgacttatatcagcctgggccaaaatagtcattaccaaagattttccactttccctctttaatagactaagctttagaatttgggtaatggtttggatgtcaaacaaaacctgagaacttgtttaggttcagaagaaagtgagagtgataatattcctttcttcatcaatggagctttctaccctttcccgcctattatgtctaatgttattgtgcaccaaaaatgaagctctcctaatcttcatttaccttcataataaagagagtctttgtgcgaaccatttctactatactgcaaagacacaaagaagaaggcctttatgctgaagctacaatttgttgacatttttatggatatgaacctgaattgtcatgagtgagcttgttctaggagtagatgtgtccgagttttcacacatgaaagactgggtcctgacctaccaagaggcagtaaatggaatactctgaggattaaagacattactctcaatatgtcttccccataagcctaagattccaatttagtgctacgagaatcacccctctgtattacaatatgcattgagaagactctctttgaggtgtgttagaaagaaataccaacacacttgaagaccactagctcattaagttgattagttccttgccagcctataatgaaattctaagatctggagggaattgaatactggatgattaagttttggccaagcggtacattactaaagaaatagggaggagaaaagggggagccctagtcgcttaagagtaaatcaaggggacacaaataatctaggaggggatggttcccaaatggccccaggaagtcctgttgggatgggcacccagatttttaaccattttccctcactccccatagtaccttaaatcaagaatatccatgaatgttactaaatgcagcatgcccaagatggagtcctccccatgagtttacaaagaagactcaagtcaagaagacttgatggactaggaggtactacttaaatgggaaggaaaaagtttcttgctagatgctgcaggagactagaagatgagtagatattctgtgatcctctcaaaatttcacaggttgagctcctttgcacgattccatactgttaggctgggcattcttatcctttgtgactgctgcacaaggaagaaaatgagccacactatcccttcaaacgctgagagctggtttgacacatttgtgctggtttggataactaagtaggagacccaggacataagtggcagctggctggcaaggatgtcagatgcagaagtacccagaaaacctactcagggtgttttcttcctttcctggtcccctcctgttacaggaaggctgacctctgcacatgccatatgagcttggccctgcggtttgccttctgccaaagaagtccctgatataaaatggaacttcagaaccttgcctttttaggagtgtcattagaaatcaaatcagtatgggctgaacaggctcaaggactgctgctttagtgtggcagctgaagtccaaatttttgagagtaattgggcccaggctgttaacaggtgcagccacttcctactagggagaaagaatgcctgccatgtgtgttacacatggcctcagaaggaagccacctgtcaagagaaatgcagacactgggctggaggggcccgaacagtgatgcaagtctgagtgatgactaaatgaggcccctgcaaaggcagaatggcccaggattgtaattaagacactttcttaccttcgcatggtaagatttgacttgttatagtgctatttctagtcctaaactcactatacgtctatgctatcatttctaaattatattccattcaacactagtatttggagaaacacagttaattttctgtgagaaaaaaaagagttcagttttttggatttgcttaggagacacttctttgtacaggctccatctggcaattctcagaacacattattctattatctaaaaatggctgagtagtcctggagtatagaagcctgattaattttaagtcacctttccctgaaccaatacagtcatcccttggtatctatgggaaattggttccaggacctccctcagatgccaaaatgcacggatgttcaggtcgctgatataaaatgtcatagtatttgcatataacctatgcacatcttcacatatcgttcaaatcatttctagattatgtataatacctaatacaatataaatgctacgtaaatagttatactttattgtttagggaataatgacaaggaaagaaaagcctgcacttgttcagtacaaacacaattccccccaccccccaaatatttccaatcctccattgattgaacccatggatatggagggccaactgtaaacattttcattagatcttttataaaaatgtcccatggaatcctatttgagaaattcaggattacacaagtaaacaaaagttgagagaactggttttctctatcaaattgggcaaaggtcttctctgcccttgtcattatgtggatacgtttttctatgaggagcactatagcacagtggtgaagggaatgggtttggacttggactgcttgggttggaatactgcctccagcatccattacctataggactctgggcaagttacaaaacctctctgcactgttttctgcaatgtaaaatggtggtggtgtgggggggtggtgtgggaataatagtaatatctgccccagaaggttgtggacagatgaagtcagacagcctttgtaaagagcctagaacagtgcctagtaccctgtaagcctggggcaaatgttagctgcagtcattgccaccatcaccatcatcttgccatcatctcccatcctctctctcagaatcagattccagaagtcattttgtctccattttcctcactgctctccacagtcattcactctcgctgtcccactcctgcttttgaaaagcctccacccctctagccttcataactagcacaggccttcctcgctccaggctgaaatattacagctttcccctagctaggttccctgaccccagtcccactctctacccaaacaacctgccctcaatgcccagacaaacctgcctgaaaccctgctgtgttcttggccccattctgctacaatgtttctgccttcattgtctagatggcagagttcaaggttaccttgggttgcaaccctctcacaaactaattcaaacctgttttccaaaccacatttattccctcacccccagctactgttcctgctgttcttcccacttggaatgtcgttcctagcctctgcatagactcaaattccaagtagattccagaacccatctcagcttgtgtcttcttcccaaggccttcctgatccctccatctcttactctggcatgggacactagcatctgctctactgtggagtggcaggtttagagggcttaggtttagagacctgggctcatatgccagctccaaaatgagcaagcggtgagagttttgatccagttgtgtaacccctctgtgtctcaggttccttatctgagactggagattgataatgctctctctccaaagggatagcatgaaactcaagcaaaagtacttgtacacattcagatttttttccagtcttcctgtgtgttttttgaggagccctagatttggcaaaggtgcctttgaaggcggaagtaggaaactgaagcgggctaggttgtcagacctccagcccctgcctctacacttcaaccagagctgcgctaccttgatcaattatatttatatatttgggatctgggtgacctttacttaggaaaaaaaagagatctattccacaaaagaaagaataagaaaaccatctcatctcccagctgggcgcggtagctcatgtccccaatcccagcattttgggaggccgaggcaggtggatcacttgaggtcaggaatttgagaccagcctggccaacatggtgaaaccccatctctactaaaaatgcaaaaaaatagcagggcgtggtggtacatgcctgtaatcccacctactcaggaggctgagacaggaaaatcgcttgaacccgggatgcagaggttgcagtgagctgagatcatgccattgcactccaacatgggcaacagagcgagacttcattttcaaaaaaaaaaaaacaaaaagaaaagaaaaaagaaaaccacctcttatcattagtaccatacaggctttccataattatttcactatttcacaacagtacagctggtctccccagatacattgtaacctccttgggagaaaggactgagtcatctttaagtatgtattttccctagttaaatatgttgtacccggtaagtacttaaatacttgttgatgaagcagctctgccttactgcccaccggttcctccagagatcacacttttataaggttaagcccatcaagaagttccttttccacttccctgagcaggcagccatggcttctttatctcctttcactctcttctgggaagatctacttcaatcccagtgccattatctctctctaccaaacactgctcagagaatagcctctgagacctgtttccttaccaggattcagaggatcacagatactagagatgaaggagaaaaaaaataaatctatcagggcatcatgtcctctccttgtgcaaaacggttaagtcctgaacattttctaaatatttgtcaggcctggtattaaaggcttgaagtgacaaggtccctcaagggagaagttggcattaaacctcactcttaaagatgacttcttttactgacttttcagtttcatgtttcaccactgaatctcacttctcacttttagttaaatcccttctaagtagccaggctacagtgagtgggggctacagaaaagccacaggaggagtcagaagagggtagagctgtcactctgtgggctatgtttccctctgactacaggtaatcaaaaaggatgggcaaggtgaaatcttgacatctcacttgaacagaagtactcccccattcttgcagattccccatcattcccattcagagagccaaaatgcaactgtgtaattataagataatgtcttatttttgtggccccactgaggttaccaactcagacacctataggggccctttgataaggatggcaaacccacttccttcagcatattgccagctcacaggaaggtgcatcatgtcaccagattatccccctttaaaaaaaaaaaaaaaagaaagaaaccatctatcaaaatttcaatgaggaatctcttcatttttgaatgttggcaatgaattcaaattatctttaacccattgtaaaggcacagctgacaccagtcccttctgtaggagatttcttctccttctgaaatccatcgccaattcataagcaagcacgcaggaatggacaatgctgtatgtttattacatttataattttgtgtgtagaagccttgcctcaatcctcaaaatgcagacacctatgctgcagtcttttgcgtggttacatcactcaacgtccccagtacatatgttcagaaaaatggtcaggtcctcagggaatagttaaaactgtgcaggactagactacttaggtttatatccctgcctcagtgcttgacagctctgggaccttgggcacctcagttttctcatctatataatggtgatgataataacagccctgggctcatagggttgttgtgaggtttaaatgacatagcagggtgtacatcatttagcaaatacactaggagcttaataaatgtcatttggaagctgcttcacatttccacattctattaaaacacccaggaaccaatggtgccctcacttcatctctagattttgctaaagagttggtttaattttcgccatgtcttcgggtttcatttttacctctgaaggtcaagttggcttgctacattcttggcagagtccatagcccctttgatggtagaaaatgatataaatgaaaaggtcagatgatcttgcctgggttacctgtcattctggaagatcacagctgtatgctaaactagatctaggtatgtgtgtggggtggggctgaagtctacacccatattgtggtaggcacagatatgtaccacccaggttgcccttcaaggagggacttggcctcccaactgtaaggtggatagtgattagcaagcactgttcagccattagctacttgagaatgggcctcagctccagtgagctgcttccctaaagaccatacatttcttgggcagctttcatttcctacagagtgaggcaggtgtgacaagatgctgctgtttccattcatcacggaacaatccagataggcaataatgaacccagggctccccactggcttgggtgaagctttggagggcctacctcaaagtccagcttctaccttgcccactcctgtttctgccccttcctttcacaggtgttgatgcctaataaacatcttgtactccagagtccatctcagcactgcagcccaagaacccaacccatgacacacgggtgtactgatgcacacacacactcctgaaacccagacaatcctttaaaactatctttttaataaacagaaaccagccaagtttgattataaagaaaaccaatcgtgcattgagacctatgggattagcagggtcaggggtatctatagagttgggaaggattaccactgatattttcttccaatttcttttattgtggtagaatacacataatctaaaatttactatcttggctatttttaggtgtacagtccagtgacaataagtacatttacattgtgggctacaattgccaccaaccatgtgcagaactctttttcgtcttgtaaaactgaaattctatacccattaaataacaactccccattctccctccccccagcttctggcaactaccattctactttctgtccatgagggttgacaaatctagataactcatgtaagtggaatcatacagtatttgtcttttagtgactggcttattgcacttagcacaatgtcctccagattcatccatatcatagcacttatcaggatttcccctttttcaaggttgaataatattttattgcatgtatataacacatttgatttattcaatcatgtttcaatggatactgagttgcttctacttcttggctattatgaataatggtgctatgaatgtgggtgaacatgggcgtacaaacatctgttccagttcctgctttcaattatttcaggtgtatgcccagaagtgggattgctggatcatatggtaatcctgtttttaattttgtgagaaactgccacactgttttccacagcagctgtaccattttacactcccaccaacagtgcacatgagttccaatttctccatatctttgccaacacttcactcttttttgatagcagccaacttaatgggtatgcagtgatatctcattgtaatttcatttgcatttctctagtgattagtgatgctgagcatcttttcaactgtttattggacacttgtacatcttctctggagaagtgtctattctagtcctttgcgcatttttgaatcagtgatttttgttgttgttgctgagttttaggaattatctatatattatgaatattaatctattatcagatatatgatttgcaaatattttttctcactctgtgggttgcctttttactatactgatggtgtcttttgatgtacaaaaatgtttttcatttaagtccaattcatctatttttccttttgatgcccgtgtctctggtgtcatatccgataaataattgccaaataaaatatcatgaggcttttgctctaaattttattctaagagttttatagttttagttcttaaagttaggtcggagactcattttaaatttttatatggtgtaaggtaaggaatgtacctaacattaattgtattcttttgcacttggatacagagttttcctagcggcatttattggaaagactgtcttttcctccatttaatcatcttggcactcttgtcaaaaatcatttgaccacatatgtgaaggtttacttttggactcctctatcctctattctattccattgatgtataaatctatctttatgccaataccacattgctttgactcctacagtttacagtaagttttgtaatcataaagtatgagtcctccaggtttgttcttttccaggatttctttggccatctagggtcctttcaattacatatgaatttcaggatggctttttgtatgtcagcaaaaaaagcatcgttggaattgtcacagggattgtgttaagtctatagatcgctttgtatagtattgaaaacaatattaaatcttctaatccataaacataagatgtgttttcattgattgataccttctttcagaaatgttttacagttttcactgtacaagtttttcacttctttggttaagctaattcctaagtattttattctttttaattctcaattttcttttcagattgttgttagtggataaaaatgcaatgtatttttgtttgttgactttgtgtcttattgctttgttgaattcatttattactccttacagatttttttttttggtggaatctttagggttttctacatgtaagttcatatcatctgtaatacagtttgtatgttgtccccttcaaatctgatgttgaaatgcaatccccaatgttggagatgagtcctagtgggaggtgactgggtcatggaagcagaactctaatggcttggtgctgtcctcatgataatgagtgtgttctcatgagatctgtttgtttaaaagtgtgtggaacctcccacaccctccttctcttttgcttccgctctggccatgtgacatgcctgctcatgcttcactgtctgccatgagtaaaagctctctgacacctccccagaagccaaacagatattggcaccatgcttgtgtgactttcagaactgtgaaccaattaaacctcatttctttataaattactctgtctcaggtattcttttatagcaatggaagaatagcctaatacaatctgcaaacagatataatttaatttcttcattttcaatttggatgcctttatttttctggttgaatttttctggctaggactttaagtactatgttgaatacaagtggtgaaaatgggcatactttccttgttcttgatcatagaggcaaatctttcagtctttcgtcactgaacatgatgttcaatgtgggttttttatatgtggctcttatcatgttggggtagtttcttacttttcctagtttgttgagtgtgtgtgtctgtgtgtgtctgtgtgtgtgtgtttaaaccacaaagggcttgaaatgtggcagatgctctttctgcatcaactgagatgataatgtgtttcttcctcttcttgctctgctgtgatgtattgtattggttgatttttgtgtatagaaccatccatacactccaagaataaatctcgcttggtcatgatgtataattcttttaatataccggtgagtttggtttgctagtatttcgttgaagatttttgtagcaatgtttataagggatattggtctgtagtttttttgcaatgtctttgtatcaaggtaatgctggcttcatagaatgaggaagtgttcccttttatttaatttttttgaaaagtttgaaaaagatcggtttagttgtttaaatttttggtactattcaccagcaaagtcataaggtctggggcttccctttgctaggagattactgatcactgatttaatctccttactagttttaggtctattcagtgttcatgacttagtctcataggttttgtgtttctaggaatttgtccatttcacctgaactatccaatgtgctggcatgcaattgtttatattacttgcttataatccattttatttctgtagacttgatagcaatgtcctcactttcatttctgattttattaattttagacttctggttttttttcttagtctagctaaaattttgtcaattttgttgataatttcaaaaatcactttttcccctgattttctagtttttccttgatttctattatttttctgttctccatctcatttatctttgctctaatctttattctttccttctgttagctttggggttagtgcgttatttttctagtttctaagttgtaagcttagacatttgtcttatttttaaatataagtatttgtagctataaaatttccccttagtactgttttcattacttccatatgtttggatatgttgtgtttttgttttcatttgtcttttaagtattatctaattccccttgtgttttcttatttaatccagttgttgcttaagattgtgttattcaattttcacaaatttttgaatttttcagttttccttctgttactgatttctaatgccatcctattgtgatcagagaagacactctgtacaatgtctgtcttttaaaatttactgagacttcatttgtggccttgcatatggtctatcctggaaaatgtctcacgtgtacttgagaagaatgtgtatgctgttgttaggtagagtgtttggcatgtatctgttagatccagctggtttactgttttgttcaagtcctctgttttcttacttaacttctgtcttttgtctctttgctagcattttttatttaaagtctattttttctgatattagtatagccaactctgctctgttttggtttactatttacatggaatatccttttctgtccttttacttttaacctatttgcatcactggttctaaagtaagtctgtgaagacagtatatagttggattatgattttttaaaaccattttgtcaacctctgtctattgactaggctgtttaatccatttacatttaaagtaattactgttaaggagaggtttgattctgtcattttgtgacttgttttctatatgccttataggtttattttgtccctcatttcctgtattcctgtcttcttttgtgtttggttgatttcttgttttgataatgaaatgattaaattccttttcgattttttctgtatattctttagctgttgtctttgtggttaccatggaaattatatttaacatcctgaagttattacactgtaatttgaatttatgccagcttaacttctataacatataaaaactgtgctactttaacaacattataccctcccctttctgttgttgatgtcataaaattacatctatatatcttgacttcctcaaaacatcaactaataatttttatccattagtctcttaaattatatagaaaacaaaacatggagttataaaccaaagttataataatattgatttttagaccaatatattttaaaaatccgttattctcttaattcatatagaaacaaaaagtggaattacataccatgttaaaataacactagcttttctacttacaaatatatttaccaatacaaagacctttatttctttatatagcttcaagttactgtctagcatcacctcattttaaccttctggactccctttagcatttcttgaagggcagatctagttctaataaattttctcaggttttatctgggaatgccttaatttcttcttcactcctttacttcttttgcagtacagttttgttggatacgtgattattggctgacagttttttttcttttaccactttgaatatctgagccttctggcctgtaaagcttctaatgaaaaaatctgctgataatcttagtgaggatccctagtgcatgacaaatctcttctcttctgctgctttcaaaattctctctttgtctctgactttcaatagtagtatttataatgtgttttggtgtgagtctttcaggctcaccctatttgtattttggtgagctttttgatgttcatattcatgtcattcaacaaatttgggaagtttttattcattatttcttcaaataatctctctgcccctttctgtctccctcttttccttctggggctctcacaatgcatacgttggttcacttgatggtgtaccacaggtcccttaggctctgttcatctttcttcaactttttttttctctctgttcctcagacttaattttcattgacctatctttaaattcattaattctttcttctgcctgtcaaaatctgcctttgagttctagtgaatttctcatgtcagtcattatatttttcagctttacaatttatttttggtttctttgcatcactctctctttattgatgttgcccttttgatcagacattattttcttgactttccccaattattcctttagtttttttgatcatctctatgataggtagtttaagtatctggctaatggatccatcattaggtcttttcagctcagtgtccattggtttatttatttattttccctttaatgcttaatacgttcctgttgctctatatgccttgtaattttatttttgttgaaaactggacatatgaatcgaataatatgataattcttgaaatcagattctccccctttgctagggttgctggtatttgttttcatgtttttgattgttgtaggccaactctatagcaaggatcactctgaggtataaacttaaagtcttttctgagccagtgccttgcctggaacatgcacagtagctatctaaagtctcccacatatgtagttgcttttgaatgtcctagttttcaatatctgggtcccaaaaagggaaagaagaaaaattaagggaagcgaaaaaaggcatcagccctttaaattccctaggagtcacttcagctagagaggaaggtacaacaataatggctaccacctcttttttgtacctctgtgattgaaaacggcaatcagtaatcagaatacagatcccaatatttgcaggatagagtcctttttgcccaccgtggctcccacaagccatgtgcaaaccaggagtacatgcacagctgcctgccatggggctgaaagatggggaatgggtagttattactgtgctaagaactgaaattgattgaaattaatcacaatttgtgcccctttccctggaatattcaggccttcagtggactccagagttccaaaatagctacaacagacagattctgccaatgcaattgttatctatgtggaaatacagatttctcaagcttcatactctataatcttcccatcaattatattttaatatacctatgtttatagggaaagaatgccaaaaagatttaaaaaaatcacagacctttaatagctctttggggatttttgagcaatttcagtaatcttctaaaataatatttagaatatcttctaaaataatagagatcttagaaattataaagacaaaaaagattatttgtgttgacattcaatactttttcttctgaaattcccaaagtacttacatttaggatatattagataaattaggtaacgcaatgggaaggtaagctattctaagttttccagccttgttattatccagtaataatgccattcaacttgctggcacttagattgtctgaggaacctttccaaatatggtgtcatataaatgccattgtaaagctctaccagaatagcattatcagattcttccttcaatgcccagtaacaataaaacacttggggaaaaagatctcatttcagagtccctgtctctcatccttcactcttgagtattcagctgcatctgtcattctttgtttttatatttctgtttattcaaatatcacatgatcctaaaacagaataaatcctgtcatcatgcaaattccatttaggacagtactctcatatatgaggtcaggttcatatccctttataggcaatcaagctaatgtatatagttgtttgttaagaaataagattctcggccaggctcagtggctcatgcctgtaatctcagcactttgggaggccaaggcaggcagatcacttgaggccaggagtttgagaccagcctggccaacatggtgaaagcccatggctccattaaaaatacaaaaattagacaggtgttgtggtgcacgtctgtaatcccagctactcaggaggctgaggcatgagaatcacttgagcctggcaggtggaggttgcagtgagctgagatcatgctactgcgctccagcctgggtgacagaatgagactctgtcacagaaaaaaaaaagatgagattctcccattattaaatgcatatgaaaaagatcaaataatgcatgcgatatgagttgtgtccaaaccacaatctcatggaggcaaaattatcaagacttcaatccgattggtggcttgcaaactaccctaggcctccaacccacaaatatatacagcctccaacccacaaatataaacagacacagatgaaatctggatgctaggaattcgtttcctaaactttccaacagcacgtacctgagggactgtatggaagagatgaaacaagagacatgtttaggaggaaggagctagttgtttaccaattaatgacgaactatctaaaacttctttgctctctaaaagtaagacttgtaatgttttcagaaataaatatgggttattcttaatcaggtatattataagagtagcttatagaaggagatatgcattgtttctgcagtgaaggaaaaagcataatttaatttttgacaaaatcagaaatattataaggtatatgttcagctgcagaagctataatacctttgactttagttctttaaaataaattatagatacacaactatatgcactaacagcctaaaagtaagtcatgctgggtttttttccatacaattttaattaggtatattttttccaatgtgttttgaaatgatctgctaggaccaaatgctaacatgaaattccctgcatgctggtagttaatttaataaaaattagaaaggtgaagccctgttccctagagggagaaggtcttaacacaaaacattcattatttccacataaattgcaaaaagtaaagatgctggatttaaaatctaagcaggaagaaactgtcaactttcattatcagtggacaaatgttttaatttgcaatattccctagcaactttttgaacagacaactttacctctttaccaacatctactttaattcctaatttgcagctgcataagtactatgttgggcccaaagctttgggtatatctcttagaggtaatggaatccttgttgttttctggcactgcctcattaaaatgaaactcagactcagggtaaccctgaaaaacctaagccctccaataaaaaatgtggtatatccctgcacttaaattacgcaggagaagtgaaggctggtacatcacacacagaagagaagctaaaggtcaagctattagagttaatgagccgatacaagctcaggctctctaaccagagaggttagggacagaatacatggccaccccaaggaactttatttaagatatcaattaaaaatgagtcacctctcttctcagctcctgcactcaacactgacactgggaacaatgactgaaggactcacacatgtctgagaaaaggcaccttgtgggtgtgacttgccacaaaagcaagagtctttctgcatttgtaaatgtgttggtaaggcaacaaaaagaatactactgtgcaaggggaggtagaggtggtgatcctggcaacctaaaagcctgattgtatgttctaatccattctgatgtcaccaaagctccccttcgagggaataacctggattatggccaatactttctacttctaatagtcttccagtttcattgttcacaaggggttggtaaacaaaaatcaatgaaaagagcagggtcttctctattttggatttggacactgatgatgaagctgtgatattctgatccaggactcaatggctcctcctggatcttctaacaaggtcaatctggctgagttccagacagtcagctgatggtctcatatgaggaatctaaagttgatgaagatggtggtagtagagtggtgtaatcctcatagctcaaaaacgatcagagctcattaattattaactaactagaacttttatggctcattagctactggttaaatgtcaggtaaaatgtaatatttaatagaaaatgttaagattagaaatatgcagagcatttcttatgtgccagacctatgctaagtatttcatatccattattgtacttgatccttacaactcccatgcaagggacctatgtttatctcaatttaacagagaagaaggcaaagtgtgaaaaactaagtaacttgtcttaagttaaacagctaatggagtggtagacttgagcttcaaacccaggtttagccaactccaagcccattcaattatcacttgatacacacccaacctatgtaatacttagctttgttcttagtcattgttgcaaagctcatttcacccctcagtcaggcttattacattcattcgtgttctcaagagacaagagggtcttgcccaaaactacagaatatcactatcacaagttgccattcccactagaatttaccttgatccccagtgatgctacatgcattattatgttagtttcttcttggaggtgttatttttaaactgcaagattaaagctcctacaagcttctgacaacatgaaaatcagacacgactttgcagtctttttaaaacaaactagtaagaaggtcccaattaagagaaaaagagtagtcacacatacctgtagaactgattgtaatttaccctttcatcttgctctaaaacacattccttgagtctcagtttagtagagataagattcacccagtcgggggatattagttcttcctggatattttaattaaactgttacattgagtagttctgaaaatcacatataatcattcaaggtatggtggagttctgttctccagcatatggctctccacccagccacattccatctccttaggtaaactagctggaggccttcagtgtaagctctttaatttttaaactcttgggtggtgctttgttcttcgggtagagagtagagcaagagaacgaattaccaaacagtaatattacccccatcgacaagcgggtggtgtttatatcacacatactatataccaagaaatgcgccacaccttttacatgaatactcattttaaaacagtaaagactttatatttagagaagttttaggtttacagcaaaactgatagtaaggtacggagatagcccacatatcccctgccccacatatgttgcctcccatattaacttccccccaccagactggtacatttgttacaatttgtgaacctacaaggacatatcacccaaagtccatagtttacaagaggattcagtcttggtgttgtacattctatgggtttgggtaaatgtataatggcatgtatccaccattacagtatcatatagagtagtttcattgtcctaaaagatcctctgtgatccgcctattcatccctccctccctcctaatccttggcaaccactgatctttttattatctccataattttgccttttccagaattccatatagtcagaatcatggagcatgcagcctctttaggtaggcttctttcacttagtaatatacatttaagtttccgccatgtctcttcatggattgatagctaatttgtttttggcactgaatcagaaacccttgttgggatgtaccacagtgtatttatccattcacccactgaagaatttcttggtggcttccatgttttggcaattaaggataagactgctatgaacattcatgtgtagatttttgtgtggctatgttttcaactcctttgagtaaatatcaaggaatacaactgctggatcatgttgtaagagcatgtagttttgtaagaaatcgccaaactgtattccaaagaggctgtaatatgttgcattcccaacagaaatgaatgagagttcctgttgcttcacatcctctctagcatttggcattgtcagtgttctgatttgggctcttctaataagtgtgtggtggtatctcactgtttgaacactcatttttgaaatatccacataggctattatgatcttcattttacagttcaagaagctgaaactcaaagaatgtagatatttcaaactggccattgtaagctagagccaagattcaaactcaagtttggtgaatttcatagcctatactttctatcattgaggtacatcttgttttctcagttgtattatgtgatttgcaagtcctatgaataatatatttaaattataccaacatgaaaactaagtgtaatcttcagtcaataaaatatccactaaatacttcaaaatatgaaactggaagcttatctaaatgaactaattctttaatatcaccatgaaaggatgatgttttaaattaagaagtgaagaatttatagtttccagattgagaataatttccacaaatttttattttcatcatattctattgtgggtgtgcatgtgtgtgtgtgacagacacatatgcagacacagagatatggggacacacacatagacactttccatctcatgccatgttggaacttcccagagacagttaaaattagctagctaatttccataaactatcaaaataaaattatacttattgagagtctagagttcctgtcatgaagacttagcagttaaaaagcatggaagtcatggaatctcagtgctccttcgttgcaatccacactcctgctacaattagaatcccaccaatagataaagtcatcaggagctaattagtccacgtgtaaaaaataaaaataagacaaagaacagacttctaaaaaaaacaaaaacaaacaaaaaacaacaacaaatcatttgaaccattgggtacttcgagtacatgaaaattgtgaagtaaattaattagctttgcattgattggtatcaaaagtcgttagccctgcactgcaaggaaatccccagaagcctaaggtgcatgaaagaaaaaggctgggaaggaaatcaatctctgctcttcaacgctgatgctttaaagggtccctgctgtataactcgcccggaagcattccagggggaagaacccacagatttatatctgccacacgtgtcactgaacacaaatacgtctgataaataattgaagctcggtattgtgcttacgtcgcatgtgcaaaaaaacagggacaggaaggcaaagaggtcaagtttcccatctgactttccaatgagcatcccaatcatcacttaggtcattattctacctcgtgaagtgtcagaactcattgtcttagggaatccaggtgctggcatcacatatttagcaaatctcatttccctctctctcacaccgcagagcactctctagtccaagcacagtgcagggcagaatccagagcttattttatttaatcctcacaattttgtgatttttacagatgaaaaaactgaggtctggggaatagaattgtttttcacaggcacaaagctggtaattggtagatctgggatttgaaccgaggtccaggaaactctagagcccatattattgccatactaggctccctctctaaataactttctcattaagtgagcagagagagaggagccagactgccctgaggcctttggtattaataggaggctaagaagctcatgcagctaagtctctttatccaacggcacatccctggaaggagaaaatgggctctgttggaatccttccactgacaggaagctctctacctcacataactacagacctgattactaaaaagactttggtttgcctttccaaaactcatatccagtgatcacaattgtggcctctgaagcagtttgattcaatactaattgcactcagtacttggatctatcataactgtaacattaaacaatgttttcccctcgcagggttcttttgaggatacagtgagtattaaaatgggctggtacatagtaagaatttgcccaatgttaattataaaaattttcctgatattacttggtaagttattctgttaaatggaataaacacccatgaatgccacatataaaccaacagctttgaccctcataatgacccccatctatccatgttgtcctcccccatttatcttcttgtctccaaggtcattatgttcctgagtgccaggttcatctttcttcttacagggttttattgcatgtataattggtcctaacatgctttataatctaagctgttttaaattttataaaaaggattccatccttatttaatcttatgctatcctcacaaacttattttcccccacttgatattttactatgaagaaattaaaagttacctacaactgaataataatgaaatgctacatattaaaatctgtacttataatagaagatagcctcaatgttaataaggtgtcaatcttaagtatacaaaaactgaacaaaataagttcatatttagcaaaagaaaaaccacaataaatatgagcacaaattgatgaaatagaaaaatattttctagaaaagatcaaaaaagtcaaaagtagattctttgataaaataattaatagataaacctttttttgttttttttttttgagacggagtcttgccctgtcgctcagtctggagtgcagtggcactaacttggctcactgcaagctctgcctcccgggttcatgccattttcctgcctcagcctcccaagtagctgggactacaggcgcccgccaccacgcccggctaatttttttgtatttttagtagagacgtggtttcactgtgttagccaagatggtcttgatctcctgacttcgtgatccacccgcctcggcctcccaaagtgctgggattacaggtgtgagccaccacgcccagccaatagataaacctttgacaatatcgattaaaagaggaagatgttttgaatgaaaaagtgaatatttattacaactaaaataataaatggctattgtcaacaactatctgtcaaaatttttaaaaatttagatgaaatgtataaatgcctaaaaatttataactaaccataatggacccaagaaataacaaaaagtttatatagccctatggctattaaataaattaaggtaattgttaaaattttttttgcaaagaaaacatcacaccaggtgattttacacgcaaatttttcccaatgttcaaggaagacatcattccaattttatgcaaactcttccatatgatagaaaaaaagagattattccccatagattctgtaaatcagtataaccctgttactaggaccaggcataaaaatcacaagggaggaaaattacagccttctctcacaaaggaatatagatgcagaccattcttcttagtagtatactcaattgtaaggcataacaaattttatttccaatatacaagtagcagtgtaacattacagaaagatttcattagctttggaatgtaccatttttctagctgtataatgtagcaatgttatctaatttctctaagactcagtttccttctttgcaaaatggctttttataatatctatctaattctgtgggaattaaggaagtaaacaatataaagcccttagctcagagtctggaagtaacagtaagcaataataagttacagcttctatttatcaagtacttagctccccggctgagtattttttttttttttaactctcctttaatccccacaaccaccctgaatggtggagattatgctcaattagtgaataaagaaactgagtcaagtggaatttcaacaactcacccaaagtcacataagttgcaaaaagtcacgctaatgtaacaatcgcagtctctgaatactgatgcctggggtcctttcaaatgtggagctgatattaccagctgctatcggggacacagcacttcctctgaggggcactggagttccttccacaaggcatggaatgtgttcaccttttcaggggaagcagttttcaagttggggtttgatttgtgacatgtgagattaaattgcagcatttctaatggaaaggcttcagagggcaggaatgagcgatacactgtcatttctccatctctgcgtgaggaaccttaagcactaatgagatcagatatgtcaccgcaactctctccactctgccacagattccaggtcagaatatttttttttttaaacattctggccacttcactgcctacctgcaactctctaccacgttcctgacatataagatttatgataatttaccttaggcagggcttggagttttattccaccaggttatcaaaaatgttgccaataatctctttcatattttcataggacaagattatacaaataatattccaccctattctttccctagagaaacttacatatcgattagacagggaggcctaacaaagattcaagagtcagtttgtcctatgagcgtggaaaacaccactcctgttaaagattacagagtgacgtcacttatgactatgctgtgcaaagtgctgggtttttttttttttttttgtatcctaaggggctttatgcttgtctttgtactattggtgccttgggaaggaaaacaagaatgcatttctcaacatttatgtctgcagcgatactgggaactgtgaatgctaacatatttttaaagagctctgatagagagaaaccaggtggtgaaagaaggtagtgaacaagcctggatacagaaaggtttagagtagaacttacgggcgccacctgctggtcccctgacaccactgcccagagcttccagttcccctaattggagtctcagctttatggccagttggctcagctgaatattattaaatgatttctgtcttcaactatgcttagacacagccttggagacaagtaagtaatgcagagagagtaaaagggagtgagtagatgtcaaagaatggtttgcccattcaacatatgtgtgactgctgtgaaaggtgtatgggagtttcccacatcatctatcagcaaaaagacataaatggtgatcttccttccttttcccaccttctttttttttttttttttttttttttgagatggagtgctggagtgcagtggagcgatctcggctcactccaacctccacctcctgggttccagtgattctcttgcctcagcctcccaagtagctgggattacaggcgcccgccactacgcctggctaattttttgtatttttagtatagacggggtttcaccatgttggccacgatggtctcaaactcctgaccttgtgattcacctgcctcggcctcccaaagtgctgggattacaggtgtgagccatcgtgcccagccttttccctttctttcttggagagaaatgatagcatctgaggaggcaggagcgaggggtgtcttgtggaggtgggtagtgatggcagcctgctctgtaactgaacatgcagggcaacgtggggagaggggtgctgcatggatgggggcagtggtgtttctagtgtgtgaggaagcagagcagaggatgagatgtacgcaggtggtgggcagtgaaggctaatattgaacaaatgagtatatatattaaggataatgggaaccaagtttctgtcagagaaggtatttataaatgtggaagggggaaaagacttagatttgaattgaagatactgatatgaattcatgtggcttatgtgtaaacatatacacatacccagatatggaaataataataagtgtgtgtttgtgtggacttatatgtacatatttcctagctctgtgttgactgggtctcaaagcattgacatcacaggaacaataagcatgctaagcacccagatcttgatttctaaaatcattctacacggacaggaaccagagctgcttggagaagtggctgattccaaggctggacagggacagtataagatgatcctggagcatcttttttgtaccagaatataaagaaatgctcaaagaatgatggggagatctggcaagtaccaactggaccaggtgatcaagtggggatacggtcagtgtggttgccttctgatgtgatatgctgagaagagctcagcagcgtttttgtggaattcctgccaagatggcatggaagaatacatgacttgagtctaataatgaagaaacagtggaagctccagagaaagagtcatcctacaggaaaaaaagacctatactctttaaggcaggaaaacacgagacagggaaagaataaaaatccattccaggctgggtgctgtggctcacgcctgtaatcccagcactttgggaggctgaggcgggtggatcacctgaggttaggagttcaagcccagcctggccaacatggtgaaactccgtctctactaaaaatacaaaaaattagccaggcatggaggtgtgtgcctgtaatcccagctactccagaggctgaggcaggagaattgcttagaagctgggaggcggaggttgcagtgagctgaagatcgcgtcactgcactccagcctgggcgacagagggagactctgactctcaacaaacaaacaaacaaacaaaaccattccagattggaggaaactgatgaaaaataataattaaatgcagtgtatgtttctgtatagcatcctggaccaaaaaagaaaatgtcatcactgagacagttggcaaaatgtgaatggggcctgtggactgaatggtagtgctgtatcagtgttgattcctgattggaagtgtttttataatagtaatgagaagagtgctcttgttttgggaaggtaatcaaacacctgaagagtgatggagcatcatatctgaaagggaatatctatatattgatctctctgaatgaaagagaattaaaatgttgcaaggtggataatcagggtgaaaggataccgcagttcttgctacccttctgtcggtttgaaacagcttcagaattaaaaaaaatactaaaagtgctgagctctgagaagaagaaaatagcataagtttaatgggaaaattatgttatacatgattagaatccttctttgttttctgagaagaccctttgttgggaagaattgatgatcaggaatgcaaatgagaatggccaaaggacagctagctgacttacaaaaagaaaaagaagattcggtataaagaaggagagaagggtgaccaggtatgcaaggagaaaaactgattgctagatattgagagagagtacttgcaaacaagcaaacagttgccatagggaatggaacttgtagggaaaagaaggatgttggagaaaagttgaataaattttgaagtgttaggtgtaatataattcttctgttattccaaatcaccacccataacatccacacccttcatcaacacccttaagacacaggtatttatttgtttaccttgtttgtttgatttaatgaaaagtatgagactgactggagaacaggtgcttggtgagcacagggcagtcagtgtgtatcagtatgtttgtgtttattatgaaaagtgagataaaacatctacataaatagttctaatacagggtagaacagaataaaaaggagccaccagagagtgtcagataaggtgtgaggaaacttcagaaaatagaaggaaaaagaatatttacattccccaagctccttctctgaaccagaaggtgggaattatacattgaaatagcacggtatgaaaatccagtaatgatccatgatcccccagctagtaaatggcagagcccaggtccatagaacccgaaagatctctttttttcctactatagtgggctgccttgtgcctgggtctgaagagaagaggaagaaagaggggagtctgatggacaaagctctgtggaggacgtggcactgagcagaaacttgaaacagagcttgactggctggcaggatgagaagaatggactcttggctgaaggggaagcaagcacaagcacatagagatgaggaagcatgggtggtggtatatagggtaagtgcaatctatttcaaagacagctaaaacacaagatgacccattccatggcaaacatggacaccaacaccatgtacaaagatgatgagggtgaggaagattgagacgtcagttatactgattgggaggctgtggaataggcagcactggcaatacttctgtgccctaatgtcattctctgaagctcaaggccaaacccactggggccaaactcacacagaaacatttattttcagacatcatttaaggaaggcaacacctgaaagatggaagggctcagtgcaaacttccagggtgctatttttgaaaatgcagaaactcccagtttggaaatattttcttaaaaatttccccatcattattagcacttctgccaaataatcactaactaaaaatattccctccttgataatgcacagataaggtctctgcactgaggaggaacaataaaggaaggtgatgaattgcaaatcaatcataatttatgcagatactctactgaaaatcacattcatcaccttttccaaatagcgccacatgaatttcctgaagtacaagaagtctattttcataaattagaccttaatttctttctctcatcaatatatttttatgccaaaaagttaaatagtaaacaatacagctgaggaagaaattatgaactagaagaacatgaaacatggtattcagaaggaaaaaaaaatagtcaaatatattttctatggcctttgctttgtgttaaagtgtgtgttttttccccaaaggattatgtgatgtaattggtactagttggatgatgaatataaacaaaaaatgccaaattatcacaagatgcctttgggaaaaaaaaaaacctgtaactgatgctacagtgtaccctgccagtatttttgaaagcaaaactgtactagttcatttttacactgctatgaagaaatacccatagctgggtaatttataaagaaaaagaggtttaatggactcacagccccacatggtgggggagacctcacaatcatggtgaaaggcaaaggagaagcaaaggcacatcttacatggtggcaggcaagaggccatgcgcaggggagctgccctttataaaaccatcagatcttgtgagacttactcactatcacaagaacagcacgggaaaaacccgctcccatgattcccaccaggtccctcccacgacacatggggattatgggagctacaatttgagatgagatttgggtgggaacacagccaaaccatatcaacaatcataacagcaatcagccagctaagaccaatgaccatccagcaagactcacttgctatttctctgtgttatctatgtcaaatggcaccttttttcttagcatcccgtttgtagaagagcagacacagagaatgtttcacaggtccccattctggggattattggctgggtatttaaatatacttttcttaggctgggttcctctaaagcaaaccctgaagacaagactttgaaggcaagtagttgatttagaaggtaattgcagaaatcaccactagtggagtgaggaagtaagatcgggagggaagaaaatgtgtgttattaaacatgtgattgctgtgggcaagagggactccgtttcactgggaaacactatagatacgtttcccagttattcctccacaagagcaaaggagcctgggtacttactcaccaacttccatgagtcattctgataactgctaccaaggggtgacggggtaggatgtgggctgggagattaaattcctagcactttcaggctagtttgcactgcacaaacacgaagtagacaccagtgactagaaaaagacaacagccagaatgtaatagtatttaaagatggaagccaggggacaatgtgtagaggaatagtcctatccgaggaatagtcctatccaaggaatacgggcagtacactgcaacagggcccttttaaggtgagatatttagaaacctgggtcaatgcttgtctccatgccaatgcagttacccactccctctcagccccagccactctacgataaagtcttaatgaacatcagagggacgtttcagggcctgctttgtgacgcacatcaccccttagactactccagtgctcactgatgtcccaaataacaagtcctctaaattattggtggtttggtctaattatctgctgaaagcattcaaaaccattgggtatccctgaaggagaaagtcacaatgctgcataagaagaaacaacgcctgcaacggataacttatttgctgtcatatgatcctatagcatcctacagatctccttccattagcatccatcacatctgtaattatttccttttcattatctgtcttccctgagtgaccataaacccaatgaagccagagaccatgcatgattattcattcacagctctactccctgtgtctagctcatagtagggagtcactcaatacttctgaatatgaaaacaagtgaatgaattaagattattaccgtcatccagcaggcaaaatggattacatagctaagggtctgttcttctgaagtaccttcttataaaggataaaaaaaggtgctccttcttccaggcagatgaagctctgagccagagctcattgcttaaccaaagcattgcagctcaaattcagctcctgctcacccattggcaaggtgcctgcggtagttttaagagccatcaacaaatatttctagcttgtcttcttcctgctgaatgaaaagtttgcccttccctgctcccttgaaattagatgtggccatgtggcttgccatggccaatgaaggaaaacagatatgatcccattctaggtggaagcctttatgagttcgtgcacaatttaccatatttgtttctttctgccatgacaaccagcaagatcgcagatggcagacagtgatcggcctatattcttaaaaggaagagacatatacacagtacctagctaacccacaaaaggcatatgatatgttttggctgtgtccccacccaaatctcaacttgaattgtatctaccagaattcccacatgctgtgggagagacccagtgggaggtaattgaatcatgggggctggtctggcccacgctattctttcgatagtgaagaagtctcacaaaatctcatgggtttatcaggggcttctgcttttggttcttcctgattttctcttgctgccaccatgtaagaagtgccttttgccttccaccatgattctgaggactccccagccatgtggaactgtaagtccaattaaacctctttttcttcccagtcttgggtatgtttttatcagcagcatgaaaacagattaatatagcatgttagaaatatacttgtattgtttaaatattggcgctcttcattcctgcagcatatctagcccactctggctgatctagtatacaacccgcagccctatatcctgtggccctgggcaggttaacacgacttgcagtttctttgttctcatgaactggtgttcatgtcataccctcatgcatgcattaccctctctctgcacacaacgtgggcctctaagaagcaatgcttttctgtggaagaaggaagagggggcattcagacttaaccctttctgcctaaaaggcccttctgaaattatatgaaagagagagagaaaaaaaaaaaaacattttgcatgctgttcatttagaagggaggcctaattctttcaccttcctataatctccagagcagttcctataccatcaaggctgcctctcctgagggggccagagcttcaggctcataattagttgtattactactactgtcactgctaattaatgatccacattcagcctaaattgaaactgcccatttctgactcctccactctaggtcaaatagatggttccttattttcaaattatgtacttcatcttaattgtataatttcaatttcatttaaaaaaagaaaaaaattaaaccaaggaagaaatgacattttctaaactggtgagttgggttatcaaacttaaaagcataaaaaattaatactgtgggattagcattattatagaaatacattaaatcttatatttaaataccagtcttttaaaccatggctgtcacagtgaaaatgttaatagtatttaaacataaatccttctccccatgaagaatcattcatcgtgcaagcacgttagctattctattcactttagagatgctgcctagcagagcattttaacgtaagccttgtcagtgttaatcctaatgtctgatgctgagatgtgtgttatattactttatgtagctgaaaaatgggaagcctttatgtcagattacaggctgaaataacgacctccccttggagccagggcctgggatataacgaggtgccaaatgggattctaggtcagagcctctgcaggacataaaagggaacagatcttttgttaagacccattcactcactaacagaatgcttttaccctttgcaatctactttatggctcctctgcaaagaagagtaaccaagagagaaagtcttgattcacagtggggcttaccagccaagctttggattcaggcaggcgatggtggaaatgtacccagccactccttcacctccacaaccaacagtctagggctacggtgttcaaattgcattcatcaaattcagagtggggagtgagagcctgaggttcggcagaggcaggaacggggagagagagcatcaaagtggatccagtgccttctccatcctcactgcatccagagcagttccctctacatctgttttatataccacagttttatgaaagatggcacatgaaatatggttctcctgttaaagtaactcattaattcaacaaatatttaccagccacagacaataaacccctgaataaatgagcacatttcagagagtgatagacgatacagagaccagcaagcatgatgatgagatagagagtacctggagtaagggccacttgcagagaggacagggaaagcctggctggggtttggtggggaatctgagctgagtcatgaataagcagaaacagcaagccatgtgagatccaggaagaaccattccacgcagaggaagtggccagtacagacagcctaaggcagaaacaagcttaacgtgtccaagaatagaaaaagggcaatgtaactgctattgggtgaataaagagaggcatggaaaagatgaggaaggcagatcattcggggcattccagactcaaacaaggagtttgggtgtcattgtgtagtggttggaagccaatggaaggttgacaacgggggcatgacaaaatctgttttgcggagttcttccacacagagagtagattccaggcacaagaacataggctggaggatcaacaagaagactgttaccttccaggacctggaagagagttgcagtgaagatggtgcaaattatctggatctgggatatgtctaaaagtaaatctgatgggactaaaggattacttgaaatcactaaccagaatttgagaaggggagggtggaacacgtggtatgtggggagggaggagatagtgcttagaaagaatagaataattgccacttctgtagatagcttctggccaactgacttagcaaagagcagcacaatatccttgggctgagaccagcgggtttgccactgtctctcaccggcaatcgcattcttgcttccaaatccggctgataatttaggaaggttttatgtcaccgctgctcggcttctttttgtgctttgattacctattctcatacaacacttaaaggtggtcacagaataatctctaatgttttgctttctatgataaataaggggttcgtgaagttcattaacagggattgcatcaccctccaccctcttttacaaccacaccataaaagtagcctctaattagttaaaagactacaaattataccatcaacgtgaggtatggcaaaatctgatggctctaattatcttaataatcagcagaaccactctcaacctaataagagaatgagtcattagtggtagtttatgaagatcaccgacattctctttgttatggagtttgtccttcctgtgttaaaatttggacacactttctacttgaatctaaaaaggatgatttctaagaagttactgaagcaatgcaagatcaaaacataataaccacattcattcttaatcagcattacagtgaaagtaatttaccaaagaacacataattaagtcataaatgaaatctcaagacagaaattgctccccttttaagatttctcattgtccatacactcagaaatgagaagagggattttctcattctgatcctaaatctatcactgaaatgatgacttcacttgcatttatgcattttgctttattttgtgattactttatctcactatcctcccctttttctgcttgtgtgattgccttaatccttttatctagaaccagggggagttccattagcttcagctttttggtatgccttagccacagaaaactattttgtgattcaaaactgctctaaaattcaggaccaaatatcacatattatgtactccctagacttttgagagtttcactctagattatagaggacaaaatcatctccccacctccaccttagggtatgtactccccatctcaagtcataagataaacctattgtggtcagaaggcagagtactctaataaccttgttatagttgaagagactgagtccatgaaaaagttacggaccaaggttatacacagagctggtgacagtcttgaggctaaaacccaacgttttactcttagctaatgttcttttgggcttaatgaatgaactactgctgtggaaatgtttttttttttttaaaaaaaaaaaaaaaaaaacctttcattgtgttttgccagaataaagactgaacatggccctagcggaagagctaaattcattatctttaaaaaatgaaattttctcaaatcataaatgcagtcaccaagtgtaccttctttctctgcattgcagtacaccaaaatgccagtcctctctacaaacacattttatggatcccaaagcagagagattgacgttgttccatttcctgttcacagtataatcaggacaaaggaataagattagtattgtgccatttccacgcggaaaaaaaaaattgttttctccatgtgactgtcagtgtatgtcaaaatgataatggggaatgtgtaatacaagatattgctacttatcaatggactctgaaaagaaaattagctcaagcatcccttgatataaaaagcaaatatgaggtcttgaatcacaccatcctgctatcaacatgttttgttacaagtcagtttatgttccttgagtaccacgtggtttacagtgcatttctctgacagcaatacagaacctcaaacaaatattacccttgcctccaataccaaccaacattaaatacaagttctattcctgaactcagtggcattcagaaattcaaaatgcttagatgccctctccatcgatttgcttctctgggtattgggctgacttcctgttcatcagggggtggtggtggtggctggaggaggaagtagatggttttaaccatttgtaggtctaattactcaagctcagtgagcccacattgaagaaggagaaggagaagaagaaaaattctctttcctattgttcatatataaaatcccagggaaagattctaatcaactctgtttggatcacatgcttactccttgggccaatcgctgtggccaagggacagtgtagcttaattaggcaagcctggttacattcccatcctgttggcttggaaagggggatactatgaccagtaaaccaccccaaatcatatgaaatgtaggagaacggttatttagtgaaaatgaagcactattatcagaaagagttggaagttatactagcagacagaaacaacaacactccactgcctttcaaataagtttattatgaaatgaaactacggctcctcttttctaacagaccgattttgtgattagaagtaataggtttttctcaaccaacaagctcaactagtttagctctttctaccagatgagccaagaataaaggacacataagggtctcaaagattatgctttctatcctgcccaaattctgtaaccattaccttttcagtaggtgatacatttcccaatttagacttcacattatagaaaaaaaccatccttcactgagttgtatttgataccgaatgcctgcattttcatgtactagtcattattccatctttccttaaagaacatccttttttttttttttttagacagagtctcgctctgtcgcccaggctggagtgcagtggagcgatctcggcatactgtaagctctgcctcccgggttcacgccattctcctgcctcagcctccctagtagctgggactacaggtgcccgccaccacgcccagctaattttttttttttttgtatttttagtagagacagggtttcatcatgttagccaggatgggctcctcctgacctcatgatctgcccacctcggcctcccaaagtgctgggattacaggtgtgagccaccacaaccggcgaaggatacccatttttaaaataccatttaatttaaagttaccagatgaaagctgcccactgtaattccagggaaattttactcttagttttcttctttatggtcacccaaatctagattatttgaattcttcttctgcagtaaaattaattataatcatagcttccaatttttagctgctacttattgagtgctgactattcttggcatcagctatattatcattaatcctcataccagcaattattatcatctccattgtatagctggggaaactgagatagagttcaaagaatttactcaaggtcatacagctgagaagtgacacatcttggaatcaaacccacctctatttcactaccaaatgccttctcctaactatatactctacccctgcatcgcgagcatcaggcaccgagtctctccaaggctctgtgataaatactactcttgtgtgacctcatgtcaccctcacttttcactcggaatataaggattcccattcccatgtcacaggtgaggaaactgaagcttaaagaaattcatcaacagacctagtttgccctgtatatagaaaagctcaggtagtctcatattttaatctctttttagcctccttttgttttgtttcactcagttcagtcttaacgagtcttaatagtcaagaaaataaaatcatagtaaagaaaacaacaaaggtatctcataaggacaagaactaatccatcccactcctactgggctggctccttttggcagtggtgattgctttctcagatgtcttaatagaagagagaatttgtgaaagcagagagccccattaataaggaaggaagaacctgcaaggtgcaaataactaatctcttgttgctttcctgttaaggtaccatgcatgtgtcaaaaatcaaaaccagggagcccagcctctaatatgagaagattccagatttcaaaagcactaggtactatttgataaaccaaacattttccctgttattgctagaagcagacacacataggcacatttgcatcctctatattgatacttctcaaatcatccatagtaaagggcgtgtgtgtgtgtgtgtgcgtgtgtgtgtgtgtgtgtatttaacctctatttacggcagtctgattcatgaccctactgtaaatgactactacatagttcataccacatgtgacttgccacacaagtctgatcacattggaactggtcttctccttgttcaataggataaggccaccaattatatacttggatgtcatggtgacttcaaattgctataaagtttcttatccaagactgacaacttgcatttcttcaggactggcactgatcctccagcgacattttgaatggcctactccataattttttgatacagggtagcaaatactatgcctatagtggcaaggaagtgtgtactctgctgaggaagtcacctctgcagccaccagaatgacatttctgaagccagtgagagcaatatcagagagcatcaatattgtaaatacgttttgatcttatagataacctgaattttgctgtgtgcgctattaataactaatatttgtaagaatctcaacaattttcaaaatgctctcttatatgttaacaaatgtagccctactacaatcctgtaacatagtatccttacccacccccccacacacgcacacatacaaagaccaccacctccaccccatttttcagatgaggataatggggcttagagtatttgggtgacaaggctaagctcacataataagttttacaggctagcaggaataacaccaaagtttcattttatttgcccactccaaagaactgataatgacagccagccaggaagctacttggaggctgtgtctgggttcagtgggtaaagagtctttgagagattagcaatgtctgccgggtaagaccagatacactggatacccttggatagattccaatccaggtagcctaatttccttttccacatcctttagcactccacatagagttgtttctcacaagtatccacatttaaaagaggtaacctcccagaacagaaactagctgacattttggaggcaaagtctgtttctcttgcgcactgaagacaagaagagtcaatttgtgatacgtgttacagagataatacacatctaaacagcggtgataaatgcatgggaattacaggcaaaaccaaggtgatacaaagtttccaaagattagatgtatctcagattaaactctccagattatactaatcaattacagaaatggggctgagtgggagtagtcactgaagccaccgttgatgtactttccctaaccattttatgcaggcattccttcatgggggtctcctcaagtcactggagtcctcagcaggggaaaggaaaacagcaatagagaaggaggttaggatcttgggcttcattttgggagtcacagtactaaaacatcacctcatgattagcagataaaaggtgctgccctgggctcaggcaattacaggaagaaacaaccctaaagcagaattcacaacatactgagttcatgaggagggcgatgaggctgatgtggggactggcttttcttcttggtgactcaaagacaaagccagcagtacttatttaaaacatgccacgtgctcatgtttatgtgaggagtagaagacaacggctttggtaaaggagaaaattcactgcataattgaatctttgaaattccagagggaatggccttttctgagaacaatgtctgttattaacagaagaatttcgaggccaaatgcagagttttccaccaggttgcatagtgagagtcatattttgaatggatatatagttttttaaaaaaagaactctgaagagttatggatgtttctcaatatctttctcaagaaggcaacagattttggactcagcagataaccctttatcctatagctgtagtgatgatgacatgataagctgtgtagcctgagcttagatgcagaagtgaattctgggcaagggtcccactaacctgtcttccctgggctccagacccacatccctagctccttgttgggggctccaacttgtacagccagcacatcaggctcagtaggtacaaagttgacatatcaattttcccatgaaaagagatcttgttttgacaacactagtctttcagttacctagactcaaaatctagaagcagccctgctcaccttcatctccttcacagcctgaactgagtcaagggtcaaatcacatagctgggttagagatatttttgacacaattccttccttcctttccacccactttgagttggcacttgcttaaacactccctgttttacctctggatagttacagtgcccctcacttgtttcctcatctccagtaattatccattccaacccatcctttaaacccatgccaaaatcactttcataaagcttacctccacattcaaatctcagtactctaccaggcacatggtggctattcaggtaatattttctggatggatggatgggtagatggacaatgtatttactcatcatttactatatgcctgacattgtgctgggtattaaagacagcaggaaacaaaccaacttctaacaaaacacttccctgctcatgagccttgaatggccaattaacataaatggttcattccagcattcaagcccttctgcagcacagccccattctaattgtttcactggtcacctactctcccatctgtcctctagccaagggtttctgaccttagcactattgacattttgagccagacaattctttattgcagctgctgtcttctgtattacagcatgttgagcagcatccctggcctctacctacttgatgctagtggcacacagccccactcaagttgggacaagcacacatgcctccagacaatgccaaatgtgccccgggggagaagagtcgaaaagaacccaactgagaaccactggtctagggtggcgcccaatttacacccactgtcctagggaaattattaatagtactcccctttcactttcacatgtgttccagtttagaagacaaactagattggttccctgcttaaatctcccgagacagcaaccttgctctgttctcatgcagattgaagaggaaagcaacaaattagtatgaagccttcagcttccaagcaacacttttttttttctggtgaaccggtctcctctttaaagattcaacttctctcttcttctttcagcacatgcagtactgggaagtaaaactggcccaaatgctctgcagggaaatgtgaggatcataagctatcctcgcctctcaaaaaagaatcacaaaaatatttacagcttttctcaaaaagtttcatgttccaaagatccccttctacgtcattctaaccccaaatgcctcaaaaagaagttcaaagctctcaagtccatcgatccaacttcttctctggccaaaaaacaatttcgtgccatgtgttaatgcaaagggctcatgctgtattcacgaaatgccaagacacctggttaaaaagttcaaaaaagttaaaaattgatccataatttcgactagcatggtagttctcaagctttactgtttcagaattccctggagtgcttgctgaattggaggttactgagccccagtcagcagagttgcagatttagtaggtctagggtgaggcacaataatttgcatttccaagttcccaggtgatgctgatgctgctggtccagggatctagaagatgcccgctgctccctgcttattccctcacagactgaaacgtacgatattacggggttaggacagtgggcttgggaaagaagggagggaggtcaggagacttcatccggctgcttgcttaggttttgtgtttttcattttttttttttgccagttagtcagaagaaaacgattttaccctggcctgtgctgggcaccatgctaggcactagggatgcagcaagaaccagacagaccttgcctcctgctgttttcccctttagagccacaagctcttctatgggctccaattccattccttctagcactccctttcagttcatcagctgctaatcagcaccttcaatcactctccaaatccccacaagacagcttccatttttcaaaagcaaagccaaagggaaaatcaagagtttttagaagcatctcctatttcggcaagtgcttccctttttgactctgatccatttcatcaaaaacccttattagagtggtccttcccaggtgtatctttttagttacctctggagataggaggtgcatccagtttattctttctgctttgtttcctgtccagaggagaagagtgctttgatccaacactgacaaccacgtctgcaggggcctcagacttgcttccagggaacaatcactcagcctatgattttgaatgcttcttttgtcactgtcaccaaagcctgagggaaagcaatctacacgctggttgacctctgaggcgactgccagaggtgccagctgtttcccctaaactactactcactgttgaatgtctaggtttccatctcccagggaagacattgccccagcttacctcttcatcatcatttgggaaggccagagaagtgtgggcgaagccatcctgcctggcgtcctcaagactcttgtctgataccagggctctctctgggtctataatctttgttcagggaatagggaaaatgtcctgtgatttgttaatccctcctgtgcagtgagggggaagttttagagtaactatttatatttttgtgatatcaggagcatctagatatctttgcttacaagtttttttttataattttagcaaaggaaaattttatagtttttagcaaaggaaattttacctttcatcataataaaaaatgtattctagaggccattattcatgggttaatattatcagggagctaacgatggcttaacaagagatgggaagccattttggaagtgttctattatggaaagagggagggcctgtgacatggattcatatatcatattcatatggattcatatgccagccatgcgtcagccatgagtaacatcatttcttaagatgtcagagtttttcccaagcacatatgccctcaggatgagaaacaactcgtctgtttgataaaaaaagaaaaaaaaaagaaaaaaaaaagattttagttcaagaattttatagattacaaatttcagagattctttattccagtatagagacacagaaatcaaaaagaatcatcactcaaatatacataggtctattaggtggggacacctggtagatgtaattatagtttcatatgcctgtatttaatgccactgaactgtactcttgaaaatggttaaaatagtaaattttatgttatgtgtatcttaccacaaatatatatatgtatatatgcagaaaaaacatatataaatatatattcattaattaggtatctgaatagggagctatgatcttaaaaaagattattttttcctaaatggcaatgtgaatttcatgtggcttaaaatcttctagtatggatttttggtgtttgataagctacattatttaaactagaataatctggaattatagagaagtatttggcttctggggccactgggacaggggcagggagggagtgtgggagcagcacccctccccagcccctgctgctgtgggagttgggatggggatggcacttccctcaaaggagaccaatgttccattgtcagtcaacttagggcacaaaacagtcttcaagagagaagaggtggaggggactcatacctttggtgggagataagcccctgctacagggtaacacaggtgaaggtcaaaatgactagtagagaacacctcctgccactaaggggtaagagtagtaacatgtaaaatccagctttaagctttactttcctgtgttagtatcagacactgctggttgtctacctactttctgttcccccttcttacctcactaacgtaactccaattttgagaggaagctaccctttttcatttgttcaacttcttcttgggaagctaatcttacccttgacccaactggcctaagccactgataggaataggaagatgatacaattccggtcattcacatgctcagctagctgaggagacatctgtgaaacagttccttgtccatcaaaagagacacataagaagaaatgagaatcattcttttccaactgttaatgggtctagataggatggctatactactgtagttattgtgtgaccatgaagtgtgctaaccttgagccagaagccaatgcagggaaattgaagagtagaaagaagggaagatgttatattcttgagtatgacatttatgcaactgatgtaaccattcattatctcaaaggtggaactatcctacccttaaactccttactattggaactttttgaatcatgatttctataatgtgctgccaaaatcattctacttaactggttcagaattgtaattctttcaggtttttcctaaagccattgaaaaatggtttgtcataaatgactgtgtagagttgacagggcctttggaaaactgagtgggtgctgatgaccatacagggataaagtggtcatggaacaacctctgcgacatgaagatatggctgcaagcagcaagagataacaagcaggaaggcccagagcagtgatccatagcataaagtgacaagtgacaggagggacaggcttgtgggacatgtaaacaagccctatggttcttcagaaatacgagtggagaggaggtcatttaagacattgaccatgttcagacatgcagagtagaggcttgggctatgatcatcagataccaaaagaaaaagtaaaaagatgaagattttagagggattcagataatactggctataaggaatatcacaggatctcctgccaagaaaatgagattcctatatgatttcttatatctctccatatgtttcctataagaatactagccatcaaaatgacaaattcaaattggtatattcagacaaatagaaagaaagtatttccctatccctcaaatgagttggataaccatgaatggtgagtcagatgagaaagaaaatgcaacagctctcactcagacctggacaaaatgttaaaagatttagtaggatggtcaaaaacatagttttcaccttaactgcttactttcaactcttcattggaataaatgcatataggccaaattaataaggaataagtagttatattttaggttaatagttgtaccattattagaaaaaatctgcctcatataaatgcagccatgagcacttcctcccctttaaaaactagtataataaaaggaatgactgattgtacttggcatatttcccctctctgtggttgcatttcactgcagttatgaaaacataatataatttttcccaaggccatggttacctgacagaagcatttaaaaaccaactacactttggacttccaggcacgtgtgtgtgtgagtcataagacagttcagaagagaaattcatatttgacatccagagctccatcttcccgcctcaagtgtctgtgtggatgtacttactccagtcttacctgagtttcaataatatgggtttgtcacaggttgttatgggctctaactaacagctgtccactgcactgagaactattattttcagaggcaggtcagaagcccatttctgactctcacgcattgtaaagaaatgctgaccccaaagtgggattctttctcaaatacactcaccctgtaagcaccaggtagagccaggagctttcaaaagtgctctgagtttaaacatttcacagcatgaggaacacagccgaagagaaagtgcaagaaaaacaatataaagacattattaactgtgtgatcacacaagagtgaggcctccagatgggccacctcatagttattgacgagcgtttagagaagaacattcattactcgatattgacgctaacgagaaagggtttgagagcaagtttaaaatgtagaaggaggaaacacccaaaccccatccccatggcagctaattcactgttcccaacaattctgcatgctattttttttactccccttgttcatatcttatactgtgattaaacccaagcattctgactgtaaaccctttttttctgtctatttcgcataggcttggtgtgttaatcaaactgtcagcaaaggaaaaaaaaaagaagaagaagaaagggcacattctatccaaatgaagaaaaatctgagctttctacaacaaacacattttccagtggatgagcttctcacacagtaattatttcacttctcccagagattactgattacatcacacagaaaaactaaatgagggctgttttatctttctcatctctctgtggttcttgtgcaaacttatacttgttatcatgaaaaatgacaaatttgccatctgatcaaaatgttaacaaggtaactgtcagtgagatggatctctgactgtcactgcaagccagaacatgaggatacattgatatttctcaatacagcccctgcttccccaacgttcactaactacatttccacagtaaggtaataaatcactcagaaataacgagctatataggatctctggggtatgatagatgtgtcctaacagcactatctgcaagatagaaaacaattgataatgatctaaagaaaaccctaatcaactgccattttccataatggggtagatgaagcaaagatatgaaatcttaactatgtgatgcatgttatgacaaaaccggactgctccaaaaaaaacccacacagccccaaacaaaacacaaatgacctaacattacgtagggtcgaataaatgaaaaataaagttaataacacagtctggatacaaacattatattggacactggcaatgatgggataatcacagcaattgctgggtccacaaacagctaaatagtggagggttcctcatataacatgaatgaagactctggctcagttattggtttaatgaactctcctccaatacttttatgttctttaagactctttgggccacattatttctgagcctttaattcaatggtttaaccaatcatttcccccacccccccccccccgccccttagcaacgtggccaagtgccacatccaaaggaaccaagagagaagaggagaagtccatatggaaataggaggtaatcaaagacagaacacaagatagaaaacttctgcaagaagatcatggcttcagatcacagggacaaagaagcatggcatcaaactgccaagaagctgcctcataacgacatccctttaggttttaaggttaagaagtctcacatagccacagttggtctcctgcctgtcccctctgctcgtttgtctttggccattcctgcttctgctgtttgtagaatactccaagcgccttccctccccaagaccttgtgcctgctcttctctctctctcagggatctctctcctccctggctccttcccttcatccagcttaaatcttccccaaggaacctgccttgcccttcggtttcaaagtagcctctactaccacccctttggtctctatcagcttcatcgatagcagaaagaaccatgtctgtctggaccactgtaatttccaggcttctagcactttctcttctctagtagggattaagcacagtcccaatcctgggctctgggatacaggactgactagccttgaatctagtgccacaactaagtacctgtgtcccactgtgcaagcactcaatttctatgtgcctcaggtccctcatttgtaaaacagagagaatagcaatgcctataaatgacagcgttttgaagactaaatcactttatcaatgtaaagagcctgagatagtatcaggcatacaggaatccatcaatcagctgctgtttttataagagcaagaacagaggtaattcagacataaagtgaattaattcatgattatagacgttagatcaatgagtcaccttcatcattccaggtttttattttaccattagccaaaacagtattgtgctccttctaattccatattctcagactacatggaatgaatgggtattggtctttaagcctctttgagcaatgccaataaatacagtcacttccaatttgagggcacttggaatagcagtgctattgttcctttgacatctcaacagcacttgaaagtgaaagaaaaaaaaatagattaatggatgtattccctaaagcaacaaacatgtttgatgtataaacatatgttatgggcaatgacgctgtacctttggtgccacgtctcaacaattctcttttcatctatcccctaatcatgcaactgaatgcttccagtaggccacacagtagggacaaaatgatagtaagaccacctggctatagatacctgcttctagagaggccaggttccaacccattacaagctgataaccatatgtatgatttttgctacactggccaagtatttggatcttttttaaacatatttgattatttaccctttgattagaatttgtgaataaaaatgtcttttaagagacacaaaggaagggggtacgggcaatagctcattactaaaaatcattttagtgtggaaagtgggcttcactattcctataaggcagtcattttcaaacttcagagcatcacaagccccctgttagattctaatagaaccctgaggaaaatgcacatacacataaatgttcacatataatttctacaggttgaaggacctcccaaaacaaaacaaatctatcaaccacaaactccagtgtaaaaaactggctctatgaagacttcaaatcaccctcacttcctttgcatataaccatttttttcttcagacaaataaaaaatacaattaagtttaatacaagaagaggctaaaaacattaggatagaatattagagtttaaagatctttgcctggttatggtctaaagatatttgctttgattaatatatggtgtaactcattaattaaatgcaaattgaaataagataaacctgtccccatatcatttctggtagacaataatgtgccagttttctctccaataaattagatgaggcaagctttctgttactaaataatagcaatatgggacaggagaaaaaaatttaccatgaggtgctttggaattattcacatgaagaactttttatttcttactttctttttcactaaaatagtactttttctcattttcaaccaatttttaaatatgaggtgtttacattgcttactgttcaaattagcattgcatactttcaggcacagacatgctcaaaataggagtcttttgaaatgcctgcattcagtataaaacacactgctggtaggaaatgcaaaatgtaaaagtcttaaaatacatttagatatggaaaacaaaacatttaaaacatattcacactttaacatgtttggaagtataaagttaatatcgtttatgaaacaaatttcaggaatcatactattgaaacaccctcacatcttcaattagctggattaaggaaaaaaaatattaacaatatttaaatgcagaaaacagattatcaggaagagagatcgttatagcaccttgttttcactaacaagcagagcagactgtaattgagttttagaaatccctgaggtggtaactcggtagagaaatccagacttggcaaggaaatcaagtttccctttaattacattatctcaatcaaagagataactttcacatccctacaaagcaaatgttttaaggagaagtctggcaaggaaagtaggtggaggtacagaggggttaagagtttcaaataacttcatattggtaggaggaacatgtagaaaactgaagtacactgtgaggaagaagacagatgccctggcaaatggtgctgctcccaaaaacatatgacacctaacaccttggtccattggtcctgctttcctatatcagccttggttttgcctttgtcactgaagaaacatggcatgttccttagtgttgaacacataagcctaaagctgatctacagtttcttaagctgataaaaggcaaagctaaaatgactttggccatgactatgctgttcggaggaggaaaatgagaatgttcagtggaaattattttcttggcagtgtccttactaggtcagcaaacctccattctttccaaattttccgggtctcctgcttatttcaggacccatataaggaggatataagcagtgatgtgtgagagctggtttgtaccagatcacaagagctgtttgtataattttcagaaattttgtaagctggtagcttaaaaagccattaaaaattaaattgtgtaatttgaaagtaataaatattaaaaacaaagggaagaaaatattaaaaactctgtaattcctcataatgtcactacattttactattgtctatgctcttaggttatatacatctgtattagtctgttttcatgctgctgataaagacacacctgagactgggtactttaaaaagaaaaagagatttaatggacttacagttccatgtggctgtggaggcctcacaatcatggtagaaggtgaaaggcatgttttatgtggtggcaggcaagagagaatgagaacgaagtgcaagggttttccccttataaaaccatcagatttcaggagacttattcactacgacgagaatggtatgggggaaactgcccccatgattcaattatctcttacagggtccgtctcacaacacatgagaatcatgggagctactattcaacatgagatttgggtggggacacagccaaaccatatcaacgtctattgtatcttgtggtggaaatactctcagtagtgtgctaccgcacgtctctttccaagtctgtgcagtgacatcaggtttgtagcttcaattcagccatatgaactggaaactggaaacactacagattaactgttttcttggctatctagatttaagaaagtgatgggggaaaataatgattatggagacaaagcttaaaagcatattgtgtcaatagctgttacatggtgaatagtacaaaaaattaagaaaataccctttagtgttctatatctattatctgatttggcaaaaatgtcactcatatgattgacaaatgagtaaagttttgacatatattcttaggcttcacttttgtcttgtttatgtaaacaaaaatgtcaaccaatattcatgtctgaagcacacctgttttgtcagtgacatgagcaactttgcttaattgggtagtaaccaagcatttattccttatctgaattttcaaatcatggctgaatcacaatcataagttgactgtgattacaggaattcaacaaacattaacaaaagcattctgtgagaatcaaattggctatatagaatctatgataaagattggtgtatattttatgattactcacaaattgtgtggtgcacattttatatcagtaaaatttataataagcagtcagatgtatgagggtatgtggatatatgtttttatatatacacacatacatacacacacatgcatacacaaaaaccagttgttaatatttaccagcacaccactggatatcaacacaataaagatatactttattgtgtatctcagcaaaaactgaccactcaacttttctagggacaactttattatggttggaaactagaggctaagacatttattgtgtcattgttgaagttccgtaaaaccatttcctatctctaaagttatttatttggctataatgccaagctacaccagctacttccccaaaagcaaggctaccagatggtgacagatttgaaagctctttctcatattttgagggtaggtaggggagtcacgctatgggacagtaggaaaatccacttttagcaggcaggatagaatgggagaagtcaacaccttgtcagttgccaatgagctgctgagaagtagttacagggtatatagcaggatagtattaaactgaaaggtcattaatgtgagatccttgggacaatatgcactctgtatgtctcaataatgttaaaagattctgtacaatatttgattgtatccaaatagtttataactgtaacatttaatttcaaggacaaaaatgaacttaagtcaactattcctgtggttttacatttcagagagcagtaagaaaaattcaccaaaacaaaataaagcaaaacaaaaatggagtgccaaaacagatttgctaatttttaaaaatgtgttcaaataaagatattttcaaatccttccttttattatcacccttatggcgcaaaagaaagctcatcagtttgctattaggatcatttggtagcacacaaagtccattttctatatatgttcagaagaggaaacaggatgagcattgggctcagccactggagatcacagcttcatcatggttcaacctcatcttcagacactgaaaatattgctgaagaaacaggaagcagcattgagcacggggggctgccatgtgtcctctccactgaagatagtctgaaggatacagtgaccgcaggaacaaaaatgccctcagaaacagccctaaagggcttctagaaagtacatgctacctgatgctttttttttttttttttaacgattgatgtctctgatttgatttggtccaagctattctgagaattcatgatggaatgagaacatcagcaactgcagcctattggatttcggtttagtagagtacagtgctctgtttgatcatccacttttcaagagccagcttcacatcctaactgcatcatccttgcaaagctctgctactttgaatgctgctttttttcagtccctgaaatacatgtgcctggggtgtcaccaacaggtgggttttttcctctgacttctttccatgtaagcctcaaggcatgtataaaggacatgagcgctgctttcattttccaaaagaaatcagctttatactgggaattgcaagcacgtgccaggtttcccatagtgacttatatgaactcgcacatactcagggtgagtaaaactagcaggcaggcaggcctcaaccaagagcacatttgctagtttttcttgaaatgttcagaactctggccctaagagaagctaatgccaggcaatcccttgcaaggataggagggttatgggatcaaggcaaaagacacatttggggaacaccattccattgggcaagctctgatatgcagaatctaaggcagctttctggacctctgaatatcatagcatcgcagtggcttcctgtggctctgtggttacagaacaatttctaccaaatgaagagaatgacagaagcaaggacctccacattcctatcatatgtgacagtctggaaaaaggcagtgttcattcttacctctcctaacttcactcgctcattcccaggtgagcctgaggccacatttcacctgagcatcccagctcctacagtcagaggaaagaacaaacttcactcccactgaattaggaccaactatttactagacactgtgcaggtattatgttactgtctcagtctgtttagttgtcaccataaagaaatacctgaggctgggtaattcaagaagagaagaaggtttatctggcttatagttctgcaggctgtacgagaagcctggtattggccttggcttctggtgagggcctctggctgcttccactcatggcaagggtgaaggggggctgtgtgtgcagagatcacatggggagcgaggaagcaagagagaagggaagaggcaccacactctttttaacaaccagctttcatgggaactaacagagtagggagtaactcaccaacagagaggtcattaatctattcatgatggatctaccctcatcacccaaacacttcccatgaggccccacttccaatattggggatgaaatttcaacatgaggttaggagggcacaaacatccaaaccacagcaattactagtcaattatttccgcagtccagtgagacagttttctgatacttgtttacaggacaagaaattaagtcttttttgtctattagacattcatttattgagaaccaactatttgtcagaaatggtgctgcagggctaccagagaaccagacaaatgtggcccctgacctcatggaatttgcattcctgtggcactcaaagaagtgagtacctaagcagtcagtaaataactttggctggctggttggctaagtgtgtatggagcagggaggcttggaagggggaaagtaacaacatggaaagaaaagcaattgtgcagggattcctagataataagccaaagacccagaatttgaacttcagcctaattcacttttgactttatcaagtgacatagcctcgcagatcccccatctcttcctatctcatattaaaaacgaaccagagcaagaacagtagcagtggaatctttcccatggcccatctctgttcgctggagtctgagcaccatctttgggccaaaagcctggggaagaacaggatctaaattccacatttgtggtgaggactagaaagtttcagaacattgcccttttaaactcatctttattaatattctttaagcgcacaggtaatgagaaagtgcaaatacagccccctctggctgcagcagtcagagagccaagaaaaaactgcatgtcatgccatcctattataataacagattaaaagggcacaaacagggtactaattagcagtcataaaaacttgaagctccagattgctcatcttcatatctgggcagtaaaagtaccacgtgtgcagataacatagaagtaaaataccagggtgcaattgcccagagctcagccagcatcagctgagagaagcagttgcatccagcagcacatcctacactttctcaagaatccaaaggcattcaggtgactgcccaagaattaaaaatcagccagcccagagagaggcaagtgcctcctaactcagcaagggacagcgggagaccttgccaacttctgattgatcgtcttcaattccctttctccaagatgtattcctgtccatggtctctccctggattttatgcagaaagctacttctgagaaatgagagggttttattagcatgcaggggccaaagtttagcctgaaggagagataccttcatcaataaaatcttttttgattaaattcagtcttttttcttgggtctgctcagagcttggaaaataagacgggtgtactttctaacttttatccccaatttgttccctgaggatttcaaggattctgttgccatcggggcactctgaaagaagaaaggaaggagtatgctttctttaacaagttgtctcttaacaaattcatacccaataattcaggcttggacattcactgtactcacctagcttggccaagtggctctgtattctatgttaactgtgatctataattttaaaagtagtcatgcatagcttatatagagaaccatcttttaaaaaatactctaaattttgttctaataaggagaaaagtgtatctacattgcatgtgatactgaaactagacaaattccttgtagccttttatctgacaacagctaaaaggcccaaattgaaggcaaagcaatgatgcaagtgaactatacaataagcacaattgtattcattttatttccaacattataataaggaccatatattattcactggtatatattctcttcactgtacagtgaaatatatgggaaaaaatcaagacccttctcttttaaacattagctctatatcagaaaggaaatggtctatatttattgattttctttgagggatctaggtaaatatcacagggctatgactgggtcctagtctccataccaccagtgatatggcttgtccaacatgacctttagaaagactcagagtttggctttgtgtttctcatctgtcttagtctgcttttgctgctttaacagaatacctgagactggaagatttataataaacagaaatttatttggctcatggttctggaggctgggaagtcccagatcaaggggcaagctgcatccagtgagggccttcttgctatgtcataacatggtgaaaggcatcacatagccagaagagagggtgagaagggctgagctagtgtttacaagaaacctactcccatgataacaacatcaattcattcatgacagcagggccctcataacctaatcacctcttcaagttcccatctgtcaatactgttgttctggggattacgtttctaacacataaactttggaaacacattcaaaccagagcaccatcctattctcagtaataccctttgtcttaatttttccctactaacctgggatgatattcaaagatattcaacaatgcttgggcactgaccaataaaaatgggactagacaccaggcatcaagaggcagtccagcctttctaattcatactgtctgacatccatccagtcccaattgtttcaaaggttctggtgataataggggccacctctcccaaatttgccttcttaactggattcctaaaaggacaagtcatgaatctctaatcataattctagcacacgtaccacaggccattaggaaaactatcctcagataaatgaagcctccccataccctcaaattacatcatgaaggtgagacccttagcatggtctctgactcactaggcaaccatggccaagtgatttgcattcttgagaaaaacttaccctccttataacagagaggaggatccctcaaagagatcctgaaagctcaagtaggagaagacactacaacgtggttggaatgcttcaaaagataatactttctaatcctaagacataattgctaataaatggtttcttttttacgtaaggtcaaagaatttttaataaatacagtctttggtgctcattaagaagacactaattcttcatgggttcataagcacacacataagaaaaatctgcagcaacagtacagtaataaatgtaaaatcctaatgagagaacatacattggctggaaaagggtattgttcttttcttccttcttttcttttgcgaatgatattgtaatgaattttcttcagaggacttattagtgtctgtttaatattatctctctctttcatgtgaaaactttccttagaatcttaggcaaagctttaggccttcaatgaagacgtcattaaaaaataatatctaagcagtgctcaaaatatcacattacaacaagttaacagcactgtcataggatatagagatgggatgatattaactatcagagattccagcctgatctatcagtaatttcattatttccaagtacgaaattaacttctttgagaggataaagcctgcagggctctggaggcctcttttgatctaagcagattattgccctgtggggactccatggtgggaattagatctgcgttcttggtggtgtccatagctggttctccattttctacattcctcatgttagaatggccataaatacggactgagcatcaatctgggactctttttcagattgcctagagggccaaacactggaaaagaaaagggctgcccgtgaaacttctggttcctgccttactgagggcttcaaggaaaggctgggtttagggttcctgaacactctgtgctgcctcggttcatttcctgttggggaagttctgaagttcatctgttacattcccaatgcttatgttaattcatatgcaaaatgggaacccgcttaactattgccttttattactctgaaatcagccaaaccagcttatgcatcttagcagtcttaaatcagcgtttcccaagtatgatctttgaaacactattaccaaaaagctgctcaaaagagagagagaaattataataaaaatatcatagttcaaagtactttggaaatgctgcttattatctctcttccgttagtttcacgtacaatgctaaggtcaaagaagttcttcaataaagaacagtatttaattttgcttagctgagcatttttcaatgttacttgccatagaatttccttcatttctcccccccaacactggctctcataatctgttatcattctgaagaacaaagagcacacactttgagaagagatggccctaagttaatcagcacactgcattaggtggctgctatcaattttgatttaattacacaagcatgcactcagcatttatgcaacgtaaggtcagaataagggttatgtactcctcaagggtaggttcccaaattggtgggatatgttccagcccctccaaggacttacacactttcctaagacctgaaaagctatggtttaaaaatagttgatcaatccttccagttgtccagctggggtcagttgccaactctggcgggcaaaatatcaggaaccaaggacacaaaatatgaggaaggcgtggcctcttccctcaaggaggctaccatggacaactaaccacaaaccaggaaaagcatgatatggaaaagggagtggtttattctgcatgaagggaaaaggaagattggtaaagacacaggctgctaagcggggctccagtgagaagaattcccattgctgggtagaagaggacagatgggtaagcaacctgagaaggactgaggctgcaaatgtgcagggcatggccgttctaagccagtcatccccccgacatcacagatgaaccaacaggacaaaaatttaagagttccatgatagaggaggcaaaccttagccaatttcttcacaccaggaagccactgtgcctatattctgaaccttgctgacggtaggtctggagtgggcctttgtgtctcccagcagcaggcatacataggagtcatctcttcgatgggcattcacatagggctaggtgtgcccttgctttataaaacatatgggttcttaaaaattggatattcctggatgtcttgtaagtaaaatcattttacatgaccatgaggagtgatccatttaaaggatccttgcagggaagactctggggaacaaggaatccacatgcactctgagatttctgtttagatttttcctgaagagctgcctcttaggggacttctgaatttaaagagacgttagaaagcagacatgatgaaactgcgttgtctccaaactaaaaacaaaaagatgaaagtaaacttaaaagctacagatgccattcgacaatgatttgatgtaaaataatagtccatctataactcaatttagccaagtccataccttctgagatccttgacttacctaaaggctctgtctaaatagtgaccctatatcatacaagttgaacaacaacaaaaggagaaactagcagatttttacatcatcgggagggacatagctggtcaaacaggcagtaaagtttgagcacaacaaagcgagctttgaacctcctaagcaaactgacaaattgcgctcaggagtccagttcccagcatcagcaccactttgccacaatggcttgtctcctatctctcctgcctaatggctttccatgccaaggagggcagtcagtgtgatgaaaataaccatcaacaaagcatttggtgattagtcgtctgcttttttaaatataatgcctgccagccaagattgataaattattttggtcattaacaatctatttaacaactgtaaatttaaagtgatcactttcctgaggcttagtgttatagaggttagggggtagaatctatttagccagagttaagagctggaaaattaagccagaacacgagaaacaagattacaaagtagtattcctcagtgagtgctgtgaagctatatggaatcaggctattaccaatggtgggggatatgtttaatcacctcttaaaggaaaaacaatcttaattaatgttgtatgtcataaaaatataatttagatggggatgggaaattgctaaagacgaaacccagagcaaagtgaagacttggttcaaaatgaaccacccacccatcaattataaaaatattgcccaacagcaaatcaaagaacatgctctttggtcatatttgggcagcctgaaaacactgatccttgaaaagcgttttcatactttatacaaaaaagataggaaatatttaaacttactttaaattagaattttaagtgccatatttaaaaagctgaattactcatagacacagtcaaagttaacacactatattttaaaactatatctaaaaaactcataaatatgtagtcagttgtgttggtcagtgaacaatattattatctttatgctgcaacatttggaccgaacatttcacctgactaaagtttggcattggtccacttgttttatttgatgcttataggacatccaaagggaaacatagcaaattgtttctgtagcctattcattagtagcacagagaaccaatcccagcttcaaggtgtcaactggtgttgcatcccaggccccatctaccagtagttcaataaggagcaagatggcaggaataagagggaaatgcatctcccttcagctttcaggttttagactactgtacatggctctttccaaacaagaagaaaagaatataacatgaactgattggtgcagtaaactaaactggatttatatgctctaatatggaaaaaagatccctagaactgatcctcaaaagcatctcccattaatggagaaataggagaatgtccccaagggtgaaagtctgggaccagcaatatggcaacattataagtgcgctgaacagcatttttgtaggaagtgtgttctaactgcctttgtaaaaggaaaaaggaaaataaaacaaagcagctggacaataccatttccactgattaaagttcaggggagcctgaaaagttacttatgagatatagttcaaccattttcccccttgctttcagatttacgtgatattaactcctatgcgtccacagcagccccatgatccgcctcagaggaattcagtgcctaatacttgactaggaagaaacattaggtattgatgggcaaagagttttcatctcaaatgcctctctgatcaactagcagtagctcttgttgaggagtccgaggccatatttaaactcagtggaaaacagcagcatgggaaattagcagtttggcatagagattaagaacatggattccagcagggagcagtggctcatgcctgtaaaataccagcactttgggcggccaaggcaggcagatcactttagaccagcctgggcaacatggcgaaaccctgcctctacaaaaaatagcctggtgtggtggtgcacgcctgtagtcctaattatttgggaggctgtggtaagaggatcacctcagcccagtaacgtcaaggctgcagtgagccatgatcataccactgtactccagcctgggcaacaaagtgagaccctttctcaaaaaacaaacaaacaaaatgatcatagattctaaatacatatggatgtttgaatcctggccctattccttaccagcataacaacataaccttatgaggttattatgaacattaaataaattaaggcaactttcacaatgtctagcacataatttacacttcataaacattagcatcataaccaggaggactaattgccattgttgctaattggcattgcagagtagagttgtggcttgtcttttgcccatcaggctatctgtgtttcagaatctgctcctcaactcaagtgtaaaacttacaagcagtggtggagtgggacaagtcaaatctacacagttctttatatgattgaatcagtgaactggatagactctaccaccaagatgtgatgtgttgcgatggtggttctgtagtatgtttggaccgtgaaagatcaaaaagtctttcaatgattcatattttcagggcattgcaaagtgatcaatttggtacattcttgacttaaaacaatcacttggacttctccaaacttcccagactgctaataacatgcaatcctacttctaaccaaagtgaataaagcatcaaaaggaaaccttggtttcatcccaagtgctaccagctgctttcacatattgaaagtttggctctaccactaacaggaaaggaaacactttcaaacctggcaggtgatgagaacagacttcagaacttggctacactgtcatcagacatcaggggctggaattagggcaggggttctcaactggtgacaattttgtcccacaggggacatttgacaatgtctggagacatttttggttgtcacaactgggtgggaggtgtttctggcatctagtgggtagaagcctgaatgctacaaaacatctcactatgcatactctcactccccaaactctgaatcttcgggtacaaaatgtcagtagtgccaagactgagaaatcctggattagcacggaacacagagcagtgtggactcattgctaaatgttttcctcactatactggaggctccaggtaagtaggaatcattgtatcttcagtgcctagcacagttcccagtacttagcaggggctatattaatttttgtggagtgaatgcactataatagcagatattaatgcaggtcagctaccatttttcttcacagcagagcaaatatttcttcaatattaaagtcagaaagcaaggtgaacagagaagacatatcagaacatgactttgcttatttgggcatctagcacatcagacacttccaataaatctgtcccacttccttcattccctatcttccctagagaagtaactgatgccacatccagaacctaacaataagttacgtcaacttgaccagcaccaacatatttctagaatccacttgcttctctccttccatgaagcctaagccaccatcatcaacatctctaatgagtcactttgcttttgctcttgacctctaacttccattctccacagagcaataaccatatgtcctgttaaaggcgttaatcagattacatccctcttgtgtttaaaacttgctaacatcctcacgggggcttaaaacatcttacaaagtctggcacctgctcaactctgcactacaatcatagcggtcatcttcctatttaaccaaattgtccaattcctttgcttctcagagcctctgcactggcctgggaatgctcttcatctagatccttacatggctggcactttcacataattcaggaagtggtttaaagtcaactcgtcagagaaattttttgactgcacagaatcttcacctgtgtagtcagacaagttttcttgtctttagattatgaggcacaatctgagagctttatttgctcatttacgcttgtacactggcatccctcccagactggagtgtcagcttcatgaaaacagagaacctgactgttttgttctctgctgtgtcccaagcaagcacagtgcctggcacaatgtaagaagtcaatacacatctgttgaatgaatagataactgaggaataaatcgatgaaataaacagttcatatacatgaactagtcagagaaaaaagaactcatctaaaagaaaatatgtgttaactgtcacttacaaaagagttgcctagaattttcaaattaaactccaaatagcatcctttatttaactgcgatcaattcaacataagactgaaaatcagaataatagagggtagttagtgttcatctagcaccaagagtaactcagaaattaaattaacagtttgttagtataaatctccctcgttctctttatgagtactaaattaaagttcatcctatatttttaaatctgttacaagcaaagagacaatgaaataatgaaagtataatgaaataattttactaattcttaatacataaccatagcaatgattttgtaagtttccaaatatggttcagcagtgtggaccagcatggcatgaaaataaatttaagtgtgttttccttttataatttttattactgtgaaagaaaataattaaggtatttaatattcacaagcagtatcagaggcaagaatacgagtatgacattactgacgaaatctggaacataacgcaagtgtaatgttgctttttttggaccacgtgatatatctgaatgcaacaaggaaagaagccagaaacatgttagcaacgattgggagggtgagttgatggtagcatgtagagtcaagcaaagtcagaggctgtgacaaaccatgctgaattagcacatgcagttcctcttggtctgcctcccacccacctttccaactgcagttcttatcactccaacaacatccccaaaacttgcagggttctaaagtttatatagtcttggggtatctgtgtccttatttacaccacagctgagtctaaaagaactttctgcaatgatggaaatgatctaattctgcactgtctattgcttctgtatcgagaaactgaattttgcaaagcatttaatgttaattaacttaaatttagccacaggctgccaaattgcacagcacagctctagacaccctccctatagtctgcaaactcctgctcgtccttcaagacccaattcaaatgtctcttcctccagaatccccttcctcttcctgttccctaaatagcaggtttcatggctttaatgataaccatttatcacattctattacaatcattttatggtatgttggtccttccaactacatcaagaatctctcaaggggacagactctgcctgactcatctctaaatactcagttccgtgcttggcacatgagaattatttgataaatacttgttggatgctcaagtgaaataatgaagccatctttagacatgaacaaatataagcacagcttaccagaaaagttcttcccaggggaaggtttactccatttatataagaagctgcaaaccagatatagcttgagcatccctaatctgaaaatctgaaatgctccaaatgctccaaaatctgaaactttttttttcttttttttttttgagagggaatctcaccctgttgcccaggctggagtgcagtggcgcgatctcggctcactgcaagctccgcctcccgggttcacgccattctcctgcctcagcctcccgagtagctgggactacaggcacccgccaccacgcctggctaattttttgtattttttagtagagacggggtttcgccgtgttagccaggatggtctcgatctcctgaacttgtgatctgcccgccttggcctcccaaagtgctgggattacaggcatcagccacggtgcccagcccaaaatctgaaactttttgagcaccgacatgatgccacaactggaaaattccacatgtagtgttatgatgggtcacagtaaaaatgcagttaaaactctgtttcatggacaaagttatttaaaatattacatacaattatcttcaggctatttgtacgaggtccatataagacataaacaaattttgtgtttagacttgggtcccattcccaagatatctcactatgtatacgcaaatatttcccaatccaaaaaaaatctgacaactgaaccacttctaggcccaagcatttcagataaggggcagtcaatatgtatgaccttcagatttgatagtatttcaccatatttgtatatatgtgtgcgtgtgtatgtttgtgtgtgtgtgtgtgtgtgtgtgtgtgtgtgtatttggtagacactgcttaccaatgttaaaaacagatttccaacatttcttgaaacaaatattagatctggcaattttagtcccatatttgggcttggcaacaatgaactagaatgtaacaagcagctgcatcatttagataataaatatcctctacagaatctttttttttcttctttttttggtacttttagtccactgttgtcatttatggtctctgtctttctcctgcagccatgtgaccttacaacaccagacaatgaatgaagagacagaaatttcaagttcagacattgatttctcaccgacattagtaaaataacaacagtgacaataatagctgcaaaaacaacaataataatggctggtagtatttattgaacatgacatgccaggtattatactaggcaattaatagacattgtcagatagaatcctcctccatgacctagaaaacagccttagcttcattttatcaatgaggatagtgagatgctaaggggcaagctgaaaacaaacagaaaggtcttcccctagtctgcccaccatcagagtcctcactgccatctcttcattacaaggcgacatccctcttcactcctccatgttcctcccagcctggatttagacccagagcacaagacaaagtgggaccttgggcaactgacataacctttctgcattttgctcctccactcacaatggacttcagaaataagagctgacattacctccagggtcacatgcgggcacatgagatgatgtaggtcaaacactgaacttctcagacacttttcacaaatggaaaatgatctcatctgagcaggcagagaatggctggacaaaggctgacacatctggagtagggaggcatggaaaggactgaactctcttaaggtaaataatggccttgtggcttttgctagcacccaccctcaaggagccctcatctagggagagcatgtctttgtggaactaatacaaatttggctccatgaggcttgcctagcttcgtgccagttaggtgatattgaaaggatgcaagtcaatggaaggtttaagaatcagctattgtaggccaggcgcagtggctcacacctataatcctagcagtttgggaggccgaggcggacggattgcctgagctcaggagttcgagaccagcctgggcaatatggcgaaaccccgtctgtactaaaatacaaaaaaacaaaaaaaaaattagctgggtatggcagcatacgcctgtagtcccagctactcaggaggctgaggcaggagaactgcttgaacccgggaggcggaggttgcagtgagccatgatggtgccactgcactccagcctgggtgagaaagcaagtctccttctcaaaaaacaaaaacaaaaaaaagaatcagctattgcaggcctagcactctgccaggccaggagttggcaaacgttttctataaaggtccagatactaaatattttaggctttgccggccataggtaaacaaatgagtatggccatgttccagtaaaactttacttacaaaactaggccagggcccacaggtatcgtttgcccacaacccctgtgctaggcaccatggaggcagagcagaggctcttcacagtcatccggcacaatcaccaggggcaaagcatgaagcagcctgttggattccccactctggtagccacagtcctctgaggtaaaggcctggacagcaagaatgacttaagcaacagactttcttggtggctccagccccagactcaccccacagggcatgaggagagtgagcctctctttcccatgaatggttcctcccagcagttgtgcaggcctgtccgcagaacaggtgaggctacatggccttcaaccacgtgatgtattggctcctctgactaaatcaaagtccacagatgataggcctacaatatccaagaagttgccaaacaaagatgcttaaattgatacagacaaaactaaatacctctccttcccttgtgcctgctttgactcccctagatgccatccctggtgccacttcacactgagctatctccttgcacttgaatcccccatgtctcattaccatgtgtatatcccaagacggggtggctcctgttgtaggccacatatgtttggttgttgtttgttttttttgagatggagtttcactctgttgcccaggctggagtgcagtggtgcgatctcagctcactgcaagctccgcctcccaggttgaagcaattctcctacgtcagcctcctgagtaactgtgattacaggcacccaccaccatgcttggctactttttgtatttttggtatagacggggtttcaccatgttggccaagctggtctcgaactcctgacctcaaaggacccacctgcctcagcctcccaaagttctgggattacagacgtgagccactgcgcccggccaggccacactgtttaaaatctatgcagtccttctttgatatgataaccttggggttgtttatatttcttccaagtgtatgaccaacaggatgcagagaagcaaaagttttcttactgttttgtctgttaacgtaacctcccattgtctttatgcttttgtttctgttctcatttaatcctgttttccttcacaggattaagtctgctcatttctaaactattgtctgaactttaatattctaacatgtcttagtgtcatgtttactcttcactgtttgactttctgagtgaaatagtgaagaatatgagagtggaaaaggtatttggaaagattctaggttttaaaatttcagctttagttgatccttcctacctgtgggaccttgggtaaatgagtgaataatctgaacttgaattgcttcacctgcaagacaaaggtaagtatgccaatctcgggagaggtatcatgaggattacgagttaaacatggaaaattcctcttccaactcaataataaaaacacaaaaaatccaacttatatgggcacagaatctgaatagacattcctccaaagaagctatacaaatgaccaaggggcatgtgggaagatgctcaatattagctatcagggatgcctcacccaaacaaaaggacaatgagataccacttcatgcttattgcttattcggatgactataataaaaagttacaaaataacaagtactagtgaaggtatgaagaaactagaatcttcttacactattggtaagaatgtaaaatggcaacgctgctttgaaaatggtctggaagtaccttcaaaaattaaacatagggttaccttatgacccagaaattctattcctagttatataccctagagaaatgaaaacatatatccacacaaacacttgtaatattaacagcagcattcacagaacgattattcataagaagcaaaaagtagaaacaactcaactgtctatcaaatgatgaacagataagtaaaatatggcctagccatacaatggaatattatttagcaataaaaagaagtttgtgaagagcaaagaaaacaagcaacatagtgaagagacaatttacaaaatgggagagcatatttggaaaccatatatcagacaggggattaaattccaaaatacataagaaacccattcaactcaatagtaccctcccctgtaaaataacccaattaaaaaatgagcaacggacccgcatggatatttttccgaaggggacatacaaatagccaacaggtttataaaaaatgtgaaatatcactaatcttcagggaaatggaaataaaaaccacagtgaggtatcatctcacacgtgttaggatggccattatcaaaaagtcaaaagataacaagtattgctgagggtgtgtagaaaagggaacccttcttggtagaaatgtaaacttgtacagccattatggaaaagagtacagagtttcctcaaaaattaaaaatagaataccatatgatctagtaatcccactcctggatatagaaccaaaggaactgaaatcccccatccaaaagagatatctccactcacatgttcatcgtagcattattcaaaaccaccaagacatggcatcaacctaagtatccactgacagataaatacagacatgcgatgtatatatcaataatggaatacgatttactctttaaaaagaaggaaagaaaatcctgccattcgcaaaaacatgataaaactagaagacattatgccaagtggaataagccagacacagaaagaaaactactgcatgatcttacttagatgtgtaacctaaaatattcaaactgttagaaacagagcatggaatagtagttaccaagggccaggcatgggggaaatgggaataatctggtcaagggtacaaactttcagttataagataagtaagtgctggcactctaatgtctggcatggtgactaaggctaatgataatatattgtatacttgaaatttgctgagagagtagatctttactgctctcaccatgcacacacacaaaaggtaactacgtgaggtaaaggatatgttaattagcttggttgtggtaaccatatcacaatgtatacgtatgttaaatcatcacacagtatatcttaaatatatataatttttgtgaatcataccttaatcaagctgtaaaaaaagaaatgaagtgcggatacatgccaaaagatgggtgacccttgaaaactttatggtaaatggaaaagacagtggcacacaccaccacataatgtatgatgccatttatatgaaatgtccataacaggcaaatagagacagaaagtagattagtagtttccagggttatggaaggggaggaatggggagtgacagctaataggcacagggtttcttttgggggtgatgaaattattctggaattagattgtagtgacagttacacaactctgaatatacctgaaatcactgaattgtacattttaaatgggtgaactgtatggtattttaattgtatctaaataaagctgttactatatggaaagttcttagcttcatgtctgagacaaaggaagaaataaaaatggtcactacggttatcattcattcacctgcattttaaaaatgcagtcggtttttctagagacttttcacccctgttattctgagaattaaaatactcaaacatatgtgtggtgaggtctagaagaggaggattattgtagcctggagtagttagaaaagccctcgagaagtttaaacagaataaaggaggaggcaaaggagaaatcaccaaaggcagcaatctgaaagtgaaaaggtgggaataatttggttccctgtgagagccataaggaggcaattcgattaagcaaatggctcatgaatgcaagggataagttgaagagaaggcaaagttagatttccaagggtcttggaagcataggccaagatgtttgggcttcctccagctttggaatgtcaggaactgaatttaaggaaagccatcctgccagtttatgtggtacaaaagggactggctgaaatcagaacccaggaagtatgagttagttagggcctgaagaaagataataagaatggaaataggaaagaaatagcacaaaatagtggctacttctttttttttctcccccacacccccccgcccccggacagccagttgttctaaaggggctatttctttatgataaaggtgacagaatacagaagaaaaaaaatctcccttcctccttcatcaacacctaacaaaaggaacaataataaccataaaatcatggttaaaaaaaaaaaagggaaatttaccagtaagctctaaataaggaattaagcacaaacttgtgccataaaattcaaaagaggaaactaattaaaaaaaaaaaaaggaaggcaggaaggagcgagggaaggtgaaaaagcaaataggagatgattttcatgcaatttgaagttgcatcaaaatcttccacctcaactgtcagaaacagattggagaaagtatttgagttgacaaaattatgggatttcccttcaatattccccacaatcaggagacaagtagactgaagtcatgattttgatgtaggatttttcttctcagtcactttgcaagctgggaacccctggccagtgatgcccgtaccaggccttgcttggccatgctggtgtgctccagcttcttgtgttatagcttgtacccgtgtttggtggttccctgagctcttgtaccatgcccaagaagaatgaggatacactggacattgaagggtgaggagggcagggaagaattttactgagtgacgaaaacagtttttagcgaagaggggatatggatttggtctccctacctgaaggtgagaaagttcccctgtgtggctgggcctggggccttttccagacttagaatgggaagtgcctgctgatttgtttgtgagtctgcaaataagtctaaagcaaagacaccactcaaaggtgggcacaacagtgtagaaaaccaattaggaaagcgcaggtatatgtaaaacaggtgaagggtggggaccaatcagaggagagcttaccaaacagaaagggaaattctcaatccagtctgaggatttaacttgtagcttggctttcaggctttaaactctcttccacttgaggtggggtttcactggggacccacccctatctgcctaggcatttgcctgcctcctgttgctatcaatttggaaaccttggtgaagccccagaaaaccctggggagtacaatcccagaacttcagcccagccaagaatagcaataattatgacaggggcttggcaggaaaaaagaattgatagaactagagaatgacagcatacagaggacgaacttcaagaataaactggagatgacccaaagtttctagcctggatttttcagaatgggggtgataccagtaagaccaggggtcagaataggggaacattttatggtagaagggcatgcactctgttatcagataaattaagtttgagcaactcatcccttgaattcgtatgtctgtataaacctaacctagtgcctctcacgtagtaagccttttataggtgtgtgcaggagggatgaggcatataaaatttaattaaatatgaacaaatgatggtaacaataaactcagattttaaaaaatggttttgtttcaaccactgtggagtcaatagactctatgagacttaaaaattttttaattttaagctgtctcttagatattataaagccacagtgagtcatcttgcacttaaaatccagaaaagcctataaaagaatagaaaacccgaatacgtaacttcctcctgtgacagaagaacaaaaacgtcaacgttcacagcttaaagacatttagcacctcaaaaagatgtatcataggtaagtttctatacttgaatgatattatataatcataatgcattggaaattaagtcaatttacaaaaaaaacccctcagaaatgcaaataacagtgctttgtaaaactgtatggcctgttttctggaaggtactgtgtgattctgggactggacttttcattaaaaagataagagattcaggcatcagacatgttcaattattggctccctaatgaagttcactatcctgtctaatggatctttccttttcaaaagaccccttcctccttgtgtattctggcattgcgtgtctctggcatttgctctatgagaataactggacagtacaatgctcttgaatacagagagctggagcttgaatggacaccatagccccaaggacatgaaaactattttttgattgtgtgtgtgtttataaaacttcttgcataaaatcagtctttgtaatttcctagacttcaagggcattcttttcaagttggggcttcttaatgtggcccttaaaaatcctaaaattaaatgcatttttaagctatctgtgtaaatatattaaaaatttccctcattaggaagttgccagtttatggcaaagctttcagaggagtctgtaacacaaagtggatccagaaccacagcatgtagacccctaaaaattaaaaacattgaaacctatttagcaaatctgcatgaaatgagccaaattcatactgcttctgtggagttggttcctggaaatctaggcatttagtggtggagttacagatggatctcaatggcctgcgtgattttcccagcctattgttttcgtatctgattaattattctcttaaaatttccatccataaaaaatttccaaagatattaggatctctcttcacatagtctttccttcttttgaatgatgctattgttgtcactttgaaaactgtaaatagcattcaagatgatatttaagtttgtgccaacatttagtggaaatgtctaagttttgaaatagtagggagctcacattccatctggtgtgttttcattttatctcctattctcagtgaattttaaaagtcagctgcagtgtcaataccctttctgctatgctaatgtgacctccacgtggaaatcaaaggaaaggagttctcagggcaagtgattctttctcaattgaactatttagtgtcatagaatcacaaagtatcagagctgaaagcaggcttacaggtgaccatgatgaatacctctcagtttgaagggaaactgagcctcaggcagagggaactgcccatagtctcattagccacagggacaggagttgaacctcgataggaagcctttctgatggccccatatcaggtggtcacttccttccccacacttccatggccctttatcagagaccaccatcccatgttacttagcggtttcaactttgtagcacagttactgtcactaatttcttacccatgtgtagcaggctaatatttcaaagtaatcactggtgtgccatttccttcctgaccatctcttggctaaagggaagtgcatctattgcttagcagtagtctccttcactcaccagcttagcctttaattcaaaaggcgctgccccagtgtgagagagaaatgattcatgcagggataaggacacagaagagttctaactgcccacccccagagtttaaaatagagtttcaagctggataatggacagagtcaagagagataaagcaagaaagagtgcatgtgtacatgagtgggcacgtgcatgcatgtgtgtgcatgtgtgcactggggcagggtgtgctctacccttgccttttccccaacccccaggctgaatcctgaggttgggtaatatatgagttttctatttgctactataacaaatttccacaaactcagtggcttaaaacaacacaaatgtattatcttacagcactggaggtcagatgtccaaaatgggtgtaatgggttaaaattcaggtgttggccagtctgcattcctttttggaggctctttgccttttccagcttctagaggctgcctgaattccctggcttatggctcaattccatctttaaggccattgatggccagttgaatctttctcatattgcatcactctgacactacttattttgcctctctcttccacctctgtgattatattgagtccacttggataatccaaggtcatctccttatcttaaagttggctgactagcctctaattgaatcttctactttaattctcttttaccatctaacatatttacaggttctgaaagattggtacataggcaccatttgggaggctattatttggtcttccacagctgactcactgcaagccatccctttgaatttgagactctaagagtagattgaatgtgcattcagctttttccatccagaattctggtagtacacagctttgcaaagagaataatgaaggactatagcagcaacatgaatgtctgctggaggcacctaatttcctgcaggtcttagcaaagtatgtaagaacagacaagttttttttgagcccatgagaagaactctgacaagctggcaaaggccaaagagtaagtgtccttcatgtgcttgtgacaagagactatgtcaggaccatggacacctctaggaatgtaggaggccaaaggtcaccatcctgcaaagaatgatggcattccttacgggtatcagaatggaccaaagatgcacacaaggaccaggcaaagtggattacttggacaccagaggccaaggaaacaacagccaaggacaacagaatccctgcctaccccacacgacatgttgctcattaaggccccagaatacagaatctgaattgagagattataagccagaatatgactgaatgaattacaggcctgaactgacagaaacggcactgaacttgctgagcaaaacctggcccagggctgatgagatggtttgctttcacagccagaaattcaactgaactttgggagtcaagaacatttcattttttaatagtccaactggtgactgtgaaagtaatcattgttatacttggcactcaaatgaacctcagacacagcaagagttgacttggtgattgagaagaaactggagacaagacaaaacaaatgggaatataaaactgtagactatcacatcagcacaactggctagtttatttttatttatttatattcctttttatttttttgagacagagtctcgctctgtcacccaggatggaatgcagtggcacagtctcggctcagtgcaaactccacctgccgtgttcaaacaattctcctgcctcagcctcctgagtagctggcactataggcacgcaccatcgacccagctaattttttgtatttttagtagagatgaggcttcaccatgctggccaggctgatctggaactcctgatctcatgatccgcctgccttggcctcccaaagggctgggattactcgcatgagccactgcgcccggccctactttttatttttttaggtggagtctggctctgtcacccaggctagaatgcagtggcatgatctcagctcactgcaacctcctcctctggggttcaagtgattctcctgcctcagcctcctgtgtacatgcgattatgggcacgcaccaccacacctggctaatttttgtatttttagtagagacggggtttcaccacgttggccaggctggtctcaaactcctgacctcaagtgatccgtccgcctctatcccagggagtatctttatttttttttctaacaagtcaaagagtagaaataccaaaaaagtcacctctttgggtgtttcagctacttagctagctcacacacacatgtatttcccatgaggttttgatcaaaactaaagtcaatttttttcactaggttcaccaaacaactgccagtaaatattggcttctgccaatgaatgaaaaagaacacaggatgtctgctcttaaaaagtgacccctgatgtttccttcacattatcaaattattgcatactcattatattatgtttgggaaatgcaagagaatatgaagaaaggaacaggagtgtaacattctatttgaagctacaatctctcttaatttcaaggtacatgtgcttccattccattctccatttatatgccactctttccattcaatattatatcccaatgtattttttcccagtgaatttagaaagcttattttgccaaggctgaggaggtgcacctgtgacacagcctcaggaggttctgaggacatgtgcccaaggtgatcagagcacagtttggttttatacattttagggagacatgaggcatcaatcaacatacataagatgagcaatggttcattctggaaagatgggacaacttgaagcaaaggcaagaagactctaagtggggagggagcttccagggcataggtagataggagacacatggttgcattcttctgagtttctgactagcctctccaaaggaggcaatcagatatgcatttatctcagtgagcagaggggtgacttttaatagaatgggaggcaggttgcccctaagcagctcccagcttgacttttccctgtagcttagtgatttgggggccccaagatttcctttcacatttcccccccttctctttgaaaaaatcttttggaggaagcattttagaagaaaatgagtctctggtctcaggttttgtctcatctctcatggctaggatggcttattcctagatgggtaggtcttgagttattaggtatgttcatttttagcaggttgtaagtctcatgttctataaagaaaaaatagggggaggaaggaaaaaacaacaacaacaaacaaaagaacaagcctgtaaaatccatataggccatattactctgaagtccatacatcagtaggcaggtatgaaagtggcttatgtatgtaaataggttgctgttatctttttctgaagtttccgttgtctagcttcagttcacttggctttacgaaagcacagcttagtttttggtgactccaaattaggaaagatgggaaaaaaaagaaggaaaaaaaattgaaaacattgttttgcagacttgtagcccagaaaaattagaattcattccaaaccacagaaaataataaaaacaggcaagactagaatctaacaacaggtatactacagtttttgaaatataacttttctctctccagtttcccatttttactaatgataaatcatggtaggactaatttgctttattattcttggtctgattatttgtgtacagtgttatatcattaatattattcataaaaactcatttgatggctacatagatgaatatatagtattaaatatattcctctattatttggcatttaaattgtttcccaggtttagatttttcaaattaattagatcagttgtccaagttttatagacacacactcacacacactctgatgtaaactggaaccataatgcaggtaagagcattttgaacgtagaggggatgacacagaaatgcctggtattctctgggttgggtgtagacacagttccatacatgaaggtgtgtgttgaccagcctattttggattgtctatcttggagagtactggtgggccttttaggggagcaatttatcaagctaattttcagggagattccagaaacgggtacaggggacagagctggccttggtgatttgattctggagttacccacaaagttccactgtgcctctagactaagcctcatattccagctttaaaatcccattcttttctcagcaggctttgttggtttgaaaaaataccttggcatctcaggaaggacaacaatttgaactactattgtaataactgaggtaaaagttctttctcagggggaggttttgacaggaggcaggcagtgcccaagaagtggggagacttgcagctgataaaggaaagccacggacctgaggattcggagaaccaggctttgaatgcagggggctggggaagtgccaggttcagctcaacagtcatttcttgacaacctactctattatgaagtggtattttttgggtgccgggaggcagagacgatgaagatgagtaagatgcctctggtagttcataaaggcagcagagagaaaagaacccagactctggagccagacagcctaagtatgaatctcaggtctgtttcttactctctctgtgtcctcagaaaagttttcaagtctgcctatgcctccgtttctacacatgatggagataaatgtaccttaatgcccaaatgagcacttcattgtatctactaactcatcagtatgctaatgtcattatcatatcacagtctccctccacatttgaggtatctccaactaatgaaaattttgtttccagcctctttcaaggagtccaattcagccttatcccagatcaccaatagatgaaactagcccaatgccccagggaaagaaggtaaatggtagacaccgcatgtggatggaaaataatttaggaaaacaagtgcagttgtttattccaggtcacgaaaaggaaattcagcctcagtcttcaatatcaactgatagggtcaagattaccagagaagccagctgaaatttcatatatagatttgacctaaatgtgcaatgtcctttcaataactctgaagagcttactaagagaaacaattttttagagtcgctaaaaggaaattcagcctcagtcttcatatcaactgatagggccaagattaacagagaagccagtgaaatttcatatatagatttgacctaactgtgcaatgttctttcaataactctgaagagcttactagaagaaacaattttttagagggaaaatatatgttggagcaaggttacatttccgtgcaaagggaatattctatgagttccttagttaccactaatgtaagaaggatttccagcaggtactggtgcaactggcctacaagatatttatggtccattaagagttgtaagcaagactgtttctttttcagaaaaaaagcaattttctcttaaatattttagtgtgttatgacatgaatacactatagggcaagcaaaagtatttaagtggttcagcacacaaaaccagctccaaaaggatgaccttgggaattttagaagcttggctagagcatgttgatgacttccttgtgtttaacaaaaactataaaaaggagttataataaagtacctagatggggactactgggccatatcctaaaagcagagaaaattcctgactttgtaaaatgtcatttctttcactgtaagtctaaattactggtagtgtgtctaggacttataaatttattggaaatccagtgtgtgtgttgtgtgtcgtgtgtgggtgtgtgtgtaaatgtctctaaggttgaacagggatatgaaaaccatttgggatttagtactggaagtcccagtgtctaagaaaatcgcttttctccctatacatgggttttccataaaattgaaggataatattttccttaggctaaagcaaagggtgatagaaacagggacggctttgtagtcaaacagactttgatataaacaagctttgccatgagctggttatgaggttttgacatagatatttactctctgcaaatttagtttcaattcaatggtatgaatgatatgcttggcacctagcagacagtccagcccaatgtgtattctcattgacagtaataatttgattattattctcaaatattacatttatttaaaatagatgtattactagtctcagtgtattctcaatgacaataataattgtattatattattatttttcattagtgctctccctaggagcaaagactgcgaactatagttgtttatgaccactaaccttacactagaagcccagtatgattgggtatttttcccccattttaaatatgggaaacataagatactgagatttaaatagcaagttaaacattaaacagtttgcaataaaccactatgttgactcaaggtggagagaatttagagctacacaggtataccagctatttcttgatttccttgattagaaagaaaatctggcatcattcaaattcctattctaaatctggggaaggtcataacagtctccacaaacagctgcttgccagtaagctgaagcagtttgaaagcattctagagcaaaaccatccagaagaaatctaatgcatgatacatatgttattaaaagtgtttggtagcaacaccaaaacaagtacaaagaaacaggtgaaattaattttagtgatataatttttaactcaacattaccaaaatattatttcaacatgtaactattataaaacattattaatgagatatttactttttttttggtagaaggctttgaaatccaaactggattttacatttacaacgcatctcaattcagactggtcacaggtggctagctgctaccaaattgaacattaatggtagacgtcaccccgcagtgacaaaaatataaccacatttgaacactcaagccgggattctaaacatcaggctatgtttccaggactctatgtctccaaaagcaggcaacttggaggccttaggattccttcctgctggcatgtggcacatgaatgaaccttgctccaagctaagaggttacgggatttatttatacaggttgtttgaattacgtgtatcattcttttgtctaaagaatgacaggtgataatttaaaaataaaaacatttacaaatgctttgggactttaaaattgtattaatttttatcttctgtttccccctaattcttgcttattttgattttcttcattaaaagagagataaagttaaatgtttgggggcttttcactttggggccattataatttatattgagggaatcgtgtcaatgcttaattcatatctgttttatctttacctagtttatccatttctgatcataatttatttttccaatagtctttttttttttctatccttaatccctatactctcatttctctaagtaaaatagatttggaaaaactactgaggtcttggtagtttgctttagcaggttaactccaaacttatcaaaactttttggacaattttaagtgactgtttattaatagctatgtcaagaaccttgaatgtaaacctaagatttttttaaacactgaaacagcccattattcaagcactgtagttaaacttaggtttcattgcagcagccactgtgagactgagagcagaactgtgagaagcaggtaggaagacagatggactccagcaacaaggacacctcggaggaggcattttcctccttcaccggcaagcaccttagagctttctgatggaatgtatctggttggagcgagaattcactgtggagggcagataggactctgcacaagaaagcctgattcgtgaaataatgagagaggaccacatggagtggtttgatagagtggatttactatggatgctatggatagagtgacacgtgattaaatttttcttatttctcactaacatgcgattgaacgtattcaaacaacataggagagcaattttgggaaactaatctagggtggcttacctcaaagcaaactctaggaaaaagccatggcatcctttgccttgaagctcaacctgtagatacctgcatcctcctcatcaagcactcttcagccttctttcattacttttcctctttagtgtccaatgacttcatgatcttccttggaggctccagctcaccatcactaccattatagccctccatgcttctcaacattcctcatttgctcagctctagcctgggctgggcacagtggctcatgcctataatcccagtactttgggaggccaagccaggaggattgcttgaggctaggagtttgagaccagcctggacaacattgcgagacctgtctctacaaaagcattagccaggtgtggtggtatgtgcctgtagtcctagccactcaggaggctgaggcaggaggatcacttgagacccggggtttgaggctgtagtgagctatgattgggccactgctggccagcctgggcaacaaagtgagaccctgtctcttagggaaaaaaaaaaaaaagagttaataaaatgactaacctgaatcatatattgtgacagttaatattgagtgtcaacttgattggactgaaggatgcaaagtattgttactgggtgtgtctatgaggatattgccaaaggagattaacatttgagtcagtggactgggagaggcagacccaccctcaatcttggtgggcaccatctaatcagccgtcagcatggctagaataaagcaggcagaaagtggaaagagctgacttgctgagttttccggccttcatctttcccctgtgctggattcttcctgccctcgaacatcggactccaagtttttcagcttatggtctcttggacttataccagtggtttgccaggggctctcgggccttcagcaacagactgaaggctgcaccgtcagcttccctacttttgagattttgggactcggactggcttccttgctcctccgcttgcagatggcctattgtggggcttcaccttgtgatcatgtaagtcaatactccttaataaactctccttcatatatacatctatcctactagttctgtcctgctagagaacactaatacatatattatctgaatatttgtttctgtgagaaaaatgggcacaaataacttttaaccagataaatgcttttctgctaattttgtgtctctcttttgaggaacatagagatttagctcagtaataatctgacataggatagggtaaaccagatgcttacccagctttctcattactaaaataggtagtcaaagagcattcatagatacagagggagcatttgaggtcataggtcattaaattagcattactatatgcttatttgttagttttatcacatctggttctttgaataaaaagtctccattaatttagaagaacatatcaagttgttatcttattctgagtgagagacaccaaagttttcattccaaaattctgaaatacccagaaacttaccactcagtgggaggacatcagtaaacccagaagacaaaaagctaattaactgtctcactgaaacattccttcctttttgaaaagtcaactagggacccatggactctgagcccattgtcaaatgccgtgtgaaagagatccaagttcaacaacaaatatcatcagcaatataatggttctctccagccctcagggccaaatggcctgcattttagcaagttgattttgctcatgaattgtgttaagccaagcaattgtttcccatgacatgcttgaacccacagttgctttgtctatgaaattcatggttgaatttgtccaattgctgattgctattcccacttgctttagtaatagtcacttccttcatcagtaatgggttttatatacagtgcacagtcacaaccattcaatgtcacccataagcatttgatgaattgtccaatacagttatgagagttggttatttgggatacagctagggtaagtcttactgagttaatgaaatgatatgacattaggccatgggtgtttcctcccccacattggctatacacactcttttatctaaggacgcatttgggtcattaccataatcttcatcaacttgtcaagataatgaagggcccattgagttcagggaaggcttggcataattcatgaaaatttaaagaacatagatgtagaaagagtttgggagctacagataaataagatctgcatagacaaccacaaaggaagagcttcagcagacaatctgctttggaagggggagagtttgagctcagttttgagacagaagagaggctcatactctgaaatgtctaagacatactgctggaggaacagaaggtgaaaacaaacttagagatgataatcaagattggaaagaaaggaagagtagctctcgagcctgctttcagcaaatcctacatctgtatttgttatagccaccacacaaatctaggtttggtgggagggggcaagttagttatcaacttcgacatgtgcctatcagacttgcttagcaatcagacaaggtttataattgcttccgctaacctttccagagtaccacaatttgtagccttctgcacactgatttctgaccaaaggattctgttccatcaatgccccattaaattcacctcagatggctgatggcaccatgtcgaagtctcacccagtgtggctatgagttagtgaattgaccgtctgaagagcaatatatagtctccttttaaattatgttagaactagcagagaatttcaggttcttctagttcaacaccttgtttttttttaaatgtgttcattcattttcaaatattcactgaaggtccaccctaggccagattagatccctgccctaaagactgtaacacataattgggggatgcaggtattgaataataaagtaataaattatgtcaagtgtgggaggtgttaagaaggaaataggtatggcgatatagtagagttactctagaggggacagaggattaactattacagatgaaatcagagaacagtgaaaaggaccctttgaggaggttctgcacatgtatcccagaacttgaagttaaaaaacaaaaaaaactcacctggggccagagcactgtaaatgaataggcagggagattaaacagatgtttcagttaaacagcatgcccagtataccagacagaagatcctggggaatagtaatctttgagtagcagagagaagaggagcagcccatgaaataggcaaggatcttaaactccaatgccttcaggagctatgcatgcaccattagccagtgaagcaagcctaggtagaaggcagtcgtggcaactgtataggcctagagaatgagcaatatgcctaacagcattcaaactcattaaaaaatactttacagtcacaataaagcaaatcaccaaaaatactttgcaggcaaaaataaaacacatgtgaagaggcaagcaaagcccaaggaccatcaatatgcaatgctgagctgcaggaaaagcaggaagtaggctgggaatgagaaaaaaataaatacagtgtggtttcctctaagttaaaaagaaaaggttttaccttttatttccatgaacttaacaatgaaaacaatatgtttcactaggcagtcacccaaacattgcaatactgatcacaaaaaaccccccactatttgttacagaacttgtaaaacctgaaaatggcggtaatgatcaaatgggtcaaatgtgtaaagagaggcaccacaaatccaagtggcccatgcactgaccaaatgtagatatcctcttgaagaattgtggccatgtgctctgtgcttgagtgaatccagggatgggaagctcacccccttggaaggcactctttaagtgttcattttttttcactttgacccgttattatggagagctaatgatatctgccactttgtagtccgatactcacagatctgccctctggagccacatagaatgtatttaatatctttccacctgccagcccttcagatatttggaaacagtgactctgttactatcttccctctacaagtcttcctttttccaggcaaaacattcccaccatcaattagtctccaaatctgttttcagacccaaccacctttcttatgaaccttcttatttgtcactaaccatcttaaaacagtgcctagaaagaacacaatgttcctagccaatttatactctggggcttctttaggcataattttctatgtctgcagcagtagaaatacaattacattttatggagctcagtctcctgctgttcctgtttcctacctcccaccctccaaggcagtctgtttgttgaatgtcctgaacagatgcataatctagagcaagtgctcccatcaatataaagaatgccatccctcatcactccatcgcttctgattaagatcatttggtctaatgtacattaagttctattccaataatgcctgtgcggtactgcatgcttttcatgcctctttctggacactgtgttattagatactcagcctggagaaacatttccatacaaagaggaagataaaactgagaatgaatggttaaaggcaaagagaaaattgggaatctcacccttggaaagaatggtagatgggaacatccaatgacctggctttgaatctggttctctatttactaaccattgctacttaaagaaaaatagtaataataacagtaagaacagaaactactatctattaacaaattcttggtaagtaccaagccctgaaataagcctttcaggctacaatatcatatggttagtagatgccactgggatttgaacttacttctgcctgtttctagacttcaatctctacatagtcttgtaccacaatttcccttagtggatactgtctatactacatatgacttataccactgatttttaaaaaaagaaaaactctcacagtaattacttctcctgagatgatcctccaaaatgtgggaagtagaaacatgtgttttcttttctgtggggccatcagagcatgcagacaagggcaaaggaataagacaggagagagaggccatacaccaaccacagcactgtacattgtgtcttgaactgggctgaaaagtaaccatgcagcttcattttaagcacagttggaacatcgacaagatttcaaggtgactgttcagcctaaggaaacagtgttttcaagcacttttatgctactttagcagtatttactagtatataattcacgtgctaatttattcattaaaacagtcgtatttggcaacattaaccttagtttacattagtgagattggtatttgtattttaattacatctctttataattactctataattctgattttcttccaatgtgaactaagcccttatcaatccccaaactgcattccacatccaacgaaaatgagttcaaattatagttttacagaaaatggctttgtaaaacccagagagcctattcccaaaggtagtcatgcatcagagtctcctggggatttccttatacaatgactgattcctgagtgctgtgcaatctacttgatcagaatctccagcgacgggacctcctgggaattgagacctgcagcaactggtccacaaatcagcacttagggactggtgactagactatttccactctacacacatccagtacagctcttggaaaacatacaaagcaaaagatagtaagggttatcctaaaggcagaataaccagccacctcacggaatccaatgtgttccagaaacattaattatacgtttcattattaactgctgacctattgttctttattttcagggtttgagttgctgttttaatttcatcactgcaaagaagccctatagacacacacacacaaaaagatgcatagattttaactggtccctggaaacaaggtagagataatcatgtggtttatttgatagagccacatgataaacaatcgagataaacaatgtgttttaaaaagcattctcaaagagttagaacaggaatgtcaaaaagacggcaaatatgatacctacctcctatccaatgcccttggcaggcgttgctaatcaatcacagcatttttccttgcatccacaaacagcctcaaagtccatttaaccaatcactccagggcactagtgctatctaatctgctctaccgtgtgggggacatactttctcctctttggctacaataaacaggtaaattgaaatcaccttataacagcctgatccatgacaggctgtatgctccacaaggtggaaatgggcatctgaaagttctcatgtagacagggctttaggcgcagatcacctggctcttgctggttcatgtttgtagtggtttcacacttgtatctttgaatgggagtacttagaaataaattaactgctttaatatttatgatatgtgagttacacttactcaaaccaacctagtttttgctcatgataatttacagtttcactttgaataaatgctgttgggaaagacaagctgagttccaaagtgttttaaaaattaagtgtagcatttgactaaaagaatcatatatcaatctgcttgatttccagtggtagcactgtaggttttcttctatggagattctgggccatatctccatgcaaatatttactgtcctggtaaatgacaggatagaaatcacaaggacacttggtttctgctggttttcatttgaaaaagaaaatcattataattaattagtcatgggttcccacgatggccattcttgactccttggcctctattgccactttccaagtctggctaaatagaattccatttcagaccatatctagggtaatacttgattcattaggttgatgtcatcccaccgacagtccccgtgatcaaacaataagatcagagagaacagacccacctcctcatagatgctgtcattcctgtgaaagtctccagccttcctgggaagaacatggacgtgaacgtgctgaaaatgtacaagaaagaaaaaaaatgtgattatctccccatgtatttttagacttgacagtgatgctctcatgaagcccaattactccacgatggttcctgctgggttatttttcagaggaagttgatatccaccttcggtaactatacctgaaatctgccgagaagagagtgcactaagcaagagagaacaacttggggtatatatgagagttggtgcgaaatgctagagtgtttcagagtctctgtggaattattcatggttgtcagtcttggttgtagttagccagtgctttgaaatgacagtgcatcttcaaaggtgaccatcatgactctgaaactgacaagaaataagaattggctaacagagaactgcataagtaaagagcgagtgaatgaggtagcaagtagtatgggcagaattacagacttggggcttcgaaaaataatcatataatagtaatacaaacagttctcatttagtaagcatttatttcctatgataaggaaagctctgtgtttggcattcttcatttagtactcttaaaaatcctatgaggtggccgggcacggtggctcatgcctgtaatcccagcactttgggaggccgaggtgggcggatcacgaggtcaggagatcgagatcatcctggccaacacggtgaaactccgtctctactaaaactacaaaaacaaaaacttaggaggctgaggtgggagaatggcctgaaaccaggaggcggagcttgcagtgagctgagatcgcgccactgcactccagcctgggcgacagagcgagactcctcaaaaaaaaaaaaaaaaaaaaaaaaaaaaaaatcccgtgaggcaaggtctactatgatctccactttacagaagaagatatcaatgttcggtgaggacagggcgccacaggaagtaaaagtcagcaccggaaatgaggttgcctggctttggctcctgtgtttcattagcacatgcactgattctgcgaacttaatcttttaaatagcccatttctctagtctactaaagcacccaggtaatatacatagcaatgctattatgcaatgatggtgaatcagggctcagagcatatctaattcaatatattcttcaaagctaaactgctatttgaaagttttactttccaaatagcctctattgtacctcggctgaagttaaacctcatttctgcccttgagctatgttccacttttattacaaaccgtggggaggaatgcgaaaatgaagagcttaaatagagagaggcagacagagggtcaaacctcatccctgatcacccaccccttcctgattactgcgatcgggttccgaggctccaaaaggcctcaagagaacgtaagatttaagtgtccctgtggcttcgctgtacaaggagggggaaagtgacacgctattaaagccgaggcagggtgcaacgtggtccaaggtgaatgaagcagagaggagcttcaaagcagcccctgagcacagttcccaaagagtgacacgcttttgccagaatattcgccagtcaatgataaagccagtcacggatctctcagcaattgggccaagtgtgcacttcagtcacaaagattacgtgagcatggagagagaaagtgaaagaacaaacaaggaaaaaataaatcacaaactacccatgaaaccaaattcttaggagaaagccaggcaggtgggcctgggctgaaatctactgaaatctccagatgggctgacttaaaagcaaaaccaggaaaataacgtagaacaaggatacagacaacccttagaaggagccttcactcactctttaattccagaatctcctgccatcctttcttcttctcctctttttgtcctttcttctttctgtccccctcctcctttcttcccctcttcctccctcccatccatccatctttcatcatctcccttatacattctaggaagttccagaccagtgtcttccagtcaaacttcctaacacaaatcctggacctaccacaaactaactgtgtgaccttgtctcacaaagtctatgtgtcagtatcttatctatatggggattataatggttgctacctcacagggttgttaagaggattaagtctgctaaccatgtgctgagcattcagctttgcatgtagttagtactcattacctagaactgtacaagaattagttttattatttaaaaaaacaaatttaaacctgaagatcaagtagacatcacattcagggattgatttctgcaccagcaaaaaaataaaataaagatattaagaagctccttgaatgagggcattgttcaagcatctcttttgtgaaagctgatttctgttgctttgactagccattctcaatcttccacctgtacttggggcttattaaaatgcagactgcagggccctaaaagtctgcatttctaacaagctcccagctgatgctggtctaatgccacactttgagaaccactggcttacaatatccacctggtttcttaccttgcttctgccagtgtgggcacggaggtcacttgctgttttgcctgccctactgcattatgtgtagactctttgtctcttttcttgttttttcctcttttttttccttctttccttctatcttttctcttttttcttttccttcttctttccctccttcctatttttttcccttcctttccttcttttctctctccccacagaatctcactctgtcacccaggttggagtacagtgatacaatcatagctcactgcagccttcaactcccaggctcaagagatcctcctgcctcagcctcccaaatggctgggactacaggtgcatgctaccacatcaagctaactttttttcatatttttagcaatggagttctcactatgttgcccagtctggtctcaaactcctggcctcaagcaatcccctctcctcagcctcccaagtagctgagattataggtgtgagctactatgtccagtatgtggagacatctttctgaatgcttctctggctttctgcactctgaccactctccttgcgtggtcctcaggaatatgcctgttagtatccactactaacatatggggggttgcgaacctgcacttgggaacctccagggtccaggtctatcccctgcctactattctttaccctcgtcttctcgatttagttcagggctatctctataggctgtgttaccactaagttctagaaaagccactcttgatcactggtaaccacttgaaattcgccgtgacacactgaaaccgtaaatagctcactgtacaggtggttttttcccgagggcatagatctcaacccaccctgatatcgtgacataaattcttaagtgacaggctgatcacacgatgctgacaacccactcagcttctcagaacagggaaatcacgatagagccagctcaaagcctcattgctgtgaaaaaataccatcactatggacttctaatagaatgacattctgataaaaacgctatgaatagcagagatgaggataatttgatataatctgttcttactgctttcatattaagctgtggtgatcacaacttacttttctaagtgccaacaaaacatctatttaataaaagccttccacaaatttgctaggggttgcagttgagctgcttgagctagaagagtatctttttaaagtcccatgacacattccacaccaaaaatgttttcatggtcaaataacatttcacaatgctcattagcacattaaagtatgagaatttccacacaaaagatgcttgtttaacttcatctaatccagcattccagaaacttatttgattgtggagtcctgattttcctgtttcattcatgtaacacttctgtacacttttctaaagtatacattgattcactcaaaaatatctatttctaggtgctattctaggagccagggatacggtaatggacaagacaaagcctctgtccccatagagcttatattccaatgggtgatgcagaagataagtaaggaaatgactatacattctaattttggatagaaataagtgtcctgaagaaaaacataacggtataaggtaaatactgagcactgggccactctaacgtttgaagtttgggaagagaagcaggactcaatttaaggctgtagtaaggaaaggggcaaaatcaagagagggtaagttccaacagcccagagaacaaatttcaaagagtgtatcactaacggtgtgaaatgtttttgaaagcttgaattgtttcagtaaggctaggagaacaaaatttaaaaccccatgaaaagatgctccacattattagtcattagggaaatgcaaatcaaaaccacactgagctactacttcatacccactagaaaggcaataatcaaaagacacacaataacaagcgttggccagagtgtggagagctggaaccctcctacactactggggatgtaaaatcacacagttactttggaaaacagtttggcagttcctcaaaaagttgaacatggagttaccttgtgactcagaattctgatcctaatacatacccaagacaactgaagacatatgtccacacaaaaacttgtacgcaaatgtttacagcaacattattcacaatcaccaaaaagtataaaaaactcaaatgactatcaactgatcaatggtaaacaaagtgcagtatatgaagacaataggatatgatttggccataaaaaggagtgatgtgcgctgagtgaaagcatcatgctcagggaaataagccagacaaaaacggccacatattgtaccatgccatttacatgaaaaagccaaatgaggctgattcatagagaaagaaagatttgcggttgtgaagagggatgcagggtaactgctaatgggcacagggtttcttttgggttaatggatatgttctggaattatatagcagtgatggttgcacaactttgtgacaatactaaaagaatgaactgtatattttaatagggtttcttttatattatgtgaattatatctcaataaagctattacttaaaaaaaaaaaaaaaaactgaaggccgggtgctgtggttcacgcctgtaatcccagcactttgggaggccgaggcgggcggatcacgaggtcaggagttcgagaccagtctgaccaacattgtgaaaccccgtctctactaaaaatacacaaaaagttagccaggcgtggtggcacatgcctgtaatcccaggtactcgggaggctgatgtaggagaatcgcttgaacccgggaggcggaggttgccgtgagccgagatcgtgccactgcactccagcctgggtgacagagcaagactctgtctcaaaacaacaacaacaacaacaaaaacccaaaacttaactgcagtgggtttcagagcaagcaggaggtgaaatagagacagcatgcaatgccatcatttttagaggctctgcctcttctgcgctgtctctgctccttccaccatctctttgaacacatctcttctgcccatactcacctgaggattgccagtgtggttgtatcgatatcctttttccttgtcagaatatattgtaattcaattctaagggatagaaacatggctcatggcgggggaaagagcaaggaaggctgaagagctaccctgctccacagctggtgtcctgcaacctccaccagttggccctgtgtgaatccttctccctcacatgtgccaatgagcaactgcagaaggcaggtctgattctaaagaacaacagacgatactgtggtaaaacgataatggccaccttcaaagttatccatgacctaatccctgacctgtgattatgttaagttacaaaagataaattatggctgcaaatgaattaaggttattaagcagctgaccttaagattggcagaggtatcatagattttccaggttgccccaatgtcatcaggagtccttaaaactggaagagggtgaacatcatcaaaattgtaaactttctacttcaaaggccacaagcaagaatgtgaaaagccaagccagagactggcagaaaggatttgcaaatcacctatctgataagggaagtatatctaaaatacataaagaactacttacaactaagtaataaaaagacaaaaatcctaagtaaaatgggcaaaggatatgaatagacatttctccaaagaggatggataaatgaatacatgaaaagatgctcaacatccttagcccaaaaccacaaagacaataccacttaacacatactagggcaactgtaataaaaaggacagataggccgggtgcggcggctcacgcctgtaatcccagcactttgggaggccaaggcgggtggatcacaaggtcaggagttcgagaccagcctggccaatatagtgaaaccccgtctctactaaaaatacaaaaattagccaggcatggtggcacacacctgtaatcccagctactcaggaggctgaggtaggagaatctcttaaacctgggaggtggaagttgcagtgagccgagattgcaccactgcactccagcctgggcgacagagtgagacttcatctcaaaaaaaaaaaaaaaaaaaaaaaaaaggacagataataacaaatgctggcaaggaagtggagaaattggaacccttgtacaagctggtgcagatgtaaaatggtacggctgctttagaaaagtttctgcagttccccaaaaggttaacaataatgttaccatatgacccatgcactgtttccagcaatttgttatagcaacaagtagagaatgaatacagatgccttgatatttttaatgcatagtttacacatttttcttatctctacaacacctgtatgaagtattattctaccaattttataggtaaggaagagacaaaattttccctcagcaagactcagaaatcttcacgtattgtttttttggtttttttttttttttttttttttttgagacagggtctcactctgtcacccaggctggagtgcagtggcacgatctcggctcactgcaacctctgcctcccaagttcaagcgattctcctgactcagcctcctgagtagctgggactacaggagcacgccactatgcccggctaatttttttttgcatttttagtacagacggggttccaccatgttggccaggctggtctcaaactcccaacctcaggtgatcatgcccagcatctattgttctatgtttgtataatcaccaacagctctcaacttggaataaccaaatgtaatgtaacaataagattgtttccatttgctgaatatcaacatcaaaaacttacagcatagaaaatctggaagagacagaaaaacacataggagaaaatttagatcaccagttaatctcactaccaagcaataacaatccttttcttcatgtagagtgatacaaatatgatacacgctttttttttttttttagtctcaattgccccagacaaaaaccctgaagcaaggatgagagtgcaagtagtttatttggtggatgatccctggaaacacgagtaagggaaggaaacaagaaaggaaaggaggccaatataggatgtgtgatcaagtgagttattatttcatgtgactggagcttataaaacctgctagagaactctgagaaccagtgaagaatatgcatcccagagttatcccagccaaggtgtgagggaactagcgtattcatacaccaacttttgtcctcactggttgagaactgctcctggggagacatcaatactccagcacttctgccttctcccacctggagagtgagaaaagccaggtttccagggccagtcagatgcaagtcaggctaggtaggatgcattgcagccatggtgggtgggggtaacacaatgtgggcagagcacagaccccacttgtagcaatgctttgcacagtgctgtctcatttctgacacctggagtctcataatttgctgctgaaccgaaagttcaagtatttagtctccttttcatgggtgagataccagacagataaagatctggttagaggttcttaaactgcaaatcccaaagccctagagcttccagaacaagcctggtatggccaaggagcagctcatgatggaagtaagaatggggcaccagaaagggcggcaggcttcagttccccctccgtgattcaaacagagcagctctgttttatctgtttctatgttgggatcccatgcacgatttcatttgcaaaaagaatttattactaaaacaaacaaacagaaaatctttgaaaactactaggattagaattaggaaacgttggggggtggtaagagtgattaatttcttcatttcacagaagaggagagtggcttttagaagaccaataacaaagcaatggcagggctgggactggaaccttgagaaccccgaaaccctgacttgtgttccagtgctttctacctcatcttgcccaacctacctttcccagatctcagaaaggtagaagcccctacaattaagcagtttggtgttcagtcactggagatgggtggccaaggttcagatcctacctattcttttgactgagtcaattccttaacttctttcatattccctcatttatcaagtgggcataaaaccagtatcccaacgcataagacttttataccgattatgtgaaatacataggtaaagtgcttaagctaatgctgcacattctgaatattcagtcaattccagcagtgactatattacaggacattagttttaaaaataattttgacaacctgcttctgttctaaaccagaaggcttaattctacggtgagccttgctgaatgtattctacttcatccagaccatcaccaaccccaaagctgtgtgttctacatggctggatttcgcctttcttgatttggggaggcctcatcttctgcaactaagtcgagtcaagggtcagcatgaaattactgacagccacttagttctaaaataaatgtcactggaagtaatgccacttacaggactttgaggatacctcagcatgatcaactcaagaatcaaattagtggcctgtcaaaatgcacaggcacactgatggtttctgatgctactgtcaatgagctccttcacttagaatattagcaatgctcaggcagttggtatgcctttcaggaaacagaggaaacatagtgcttttcatgtgttcaaagtgtcccaatcaagttgggaaacttcgaggaaaaaaataaaataaaaaaaaattcagtttaaacaaaaaaaataaacagaaaacacctcctagaatttgtggagactctgttgagtttcgtggcttaacaattgtgtttttaagccatacatcactggtggtgctccaattgtgagttataataatatatcataagagggatggtgatctcctgatatatgggtgccatacatcatctaagcaccatggctttgatgatgtattgctccaagccacaatgagagtttaaaggagcttttagcagccagacagctttaaatttcaaattttcaaaaattaagatcttttcaagtaaaaaaaaagcaagataatggaatgtgatgctatataaagtgtcactgaactctgagagcctgggtatatgccttttccttttggctttgagctcacaaggtggaaatcattggcaagttcttcttcaattcctcctccatgagcacagaggtgagcaagtgtcaatgcatccattttgccaatcaatttcccccatcttccacactgcaagcctgagtagctcatcatcatcccaaagactggatcacataaaatgctgtgataggcactggataaacccaggagaagttattttttattttttattttttggtttgttttaaagagctcttccactgagattcagaacaaaaagaacagataaaaagtagatagacttccttcctcattgctctcaaactcaaaacagggcatgtaggaagaaaacatgccttgtctagcatttgtctttgtaaagcaaaggaagcattgattgcagatgaggagaaagaggggaatggcatatgggcttctcatccagactaggaaagggagctgttgtcatagttctgtcacctttcctattttaacgatgggtttataagacggtaatgtggcttaagagaatgtacccacttcgtttaaaagccactcacttttgggggcaaagtaatcacaatcaattaagaaaacaggtgttgagagaactcctccctttttttttaaatcctactgcaataaacagaacaaaatgagaaatcttcctactgtttctgtaatagacctaaacaggaacagtgagagacgattacacttcaagtggcttcttccattttcctttactaagtgaattaaaggaaagaataagagtagttactgccatgtggagggaaacatctgggcataaggaattaacagtcttccctcccattctcctatctctaattttttgctccttgggcttcctccagtagattctaagtcccaaattactgtagatattttgcacccggctccctccttgaccacttccaaagggcaaaaacatcttatttccaccaaagaaaaccaatggctgtctcaaaaagaagtcccaggcttcttttctcctgtagtagtaagttaactatataatctgggtaacaaagacatggaaataaatgcatcacccactattctgaggctgtcagttgaaagatgtgaatgaggcaggctttgcatctagagaaatgtgggttctttcacgggctggtaaataaatcccccaaattcagtcctcttcttctctataaagagaatactgacacaacacttaattatttctttcacataagccaaaaagctttacttacgtatttatagtaatagcacaccattcatccacccaccatttttaagtcattatcagttataaaacttgctgccatttacataagaatattatatgttggaatggtacttagtactgtatattatcacatcctcaccaaaacactaaaaaatagaaactgttgtctccttttttttcagtaagcacactgatgcttactggaattaaataaattgtgcaagctcaccaagctggcaaaagtggccgagttaagattctaagtcaggttgataggatgtcaagcgtaatctgtattttgctatgctccttcctgagtaaataactaatgtctgggtgaccatatgccccagtctgtttggaaccatccagctttaggcctgcaggtatgaacaggccagtgtaataacaaacagcatcttctttcactctcctaagttctgctgtggacaataaattatatggtctccctaactagtagtatagttcatgccaggaaattttatttctgctcattctaactattctcatctgcagatagcaggggaaaaacaaagaagaaaggaaagaaagaaggctctgtgaaagtttttaaagaatgggctactaactcttatctatcaatacctttcatgaaacctccaacatgttcagagtagagctctgggagggaaaagaaatactttagactaaaacagggcccctcaagctctaaagaaaaaacctcaagcatgctagaaacctctccagttgagcattctttacttattatcatcacaagaggcaacggtaatagctgttgctatttattaagctcttactatatgccaggcaccatatgccaggaactgagctaagcactttctttgtaagatctcaattatttatcataaaactgcatgatagatataatccaaattattatcatcattaatttatagatgaagaaactaaggccgaggaacgtggaatgaggaggtctgcccgattccaacatccaagtgtgatactactatcaacactctggtacagttgaacacagcctagtaaaagttctaagcccactgcccctgcaccccctgctattcaaccttatgacagtaagctcttctgcaagaggggcccattagagagaatggacttctaacaaattgagatcaatcttgtacaaatattctgtattatcttttggcttctgattggttttcagtgacataacagctttaaattcttaaagctatttaatgagaagagagtagatgtattagtctgttctcacactgctaataaagacatacctgagactgggtgatttataaaggaaagaggtttaattgactcacagttccacctggctagggaggcctcaggaaacttacaatcatggcagaaggggaagcaaacatatccttcttcacatgggggcagcaaggagaagaatgagtgcccagtgaaggggaatccccttataaaactatcagatctcatgagaactaactcagtatcatgagaacacgatgggggaaactgcccccatgattcaattttctccacctggtcccacccatgacacatggggattatgggaactacaattcaagatgagatttgggtgcggatgcagccaaaccatgtcagtagaatttataatcactgcctctagagaagttgacaaacctaaccaacagctataaaaccaggataactccagatgtagggctctcagatgaggtcatctctactgccttgggttatggacaggtagaaccctgggaagaccattccaagatagagtcttcctgttcagttagacatgcaggagctcagaggttcttgtaaaattggttctgcttgctgctgggtgggaagggacagtgccttagtaatgtctccatctgaaaacgtatgaaagtttcaaaatgacttttaggagatacagaggatgtttcaagatttgtcacccttgtgcttctcagctgttgttgtagtcatggagtttatagtacatgtgcttggtagaaaaaattataagtgttcttccttccatgtggagttcctttctctttccttttcttcctctgagttttaaagagcatgctcaaatgccacctcctttgtgtactcttcagactctttcaggcttttctgattcattatacatatgtccatgacagctttttaccacaaagtataagtaattacaggttttctcttccactagtctggaactctgggctatttattacttatttttcccctgattatttcttttccctaaccctaggttcctaggttagaagacatattttctaaatgttgaatggatggatgaatggatggatgggtggggtggatgggtgatggatgggtgaatggatgggtggatggatgaatagatggatgagtgggtgggtggatgggtgggtagctaggtacatgagtgggaatgtggacagataggtgcatggatggatgaatggatggttaaaaaatagacaactacactgctcttaatttcttagcttgcttaaaagaagaaatatatgcactgattttcttcgccattcttgtcattttcttttgcttgaaagttcttgtgcatacaaagatatggtctatgaagagccattatgatcacattgtacacacctttcttccccactgaaaagtatctttttaccaaaatgtaagtttgaagttcttgtgtttctagcctcacataaatcccttttaaaaaactcctcagatatgctcaagtgtctggagaaatagcttatcctaaaaacagtcagcattgcaagggttgccaaggggatatatttgttcttcagtattaacttcattaagagctactgtggttctctctcaggagagaagaagaaacctaacctttctttggatatcttctgatctttacaaattatttccagggtgctgtctttgttagacaaaatatgaagaatatctatttttttatttatacatcatatcagaacattaatttgtagagtgattccctctgggtgcctttctgttgggtacacaaaaaaggatttggatgcaaatgaaacaatgatagcatttttccttgtcttactcattttgtgacaaatgcacattgctttactgtttgctatacacataattacagttctttaatttatgtttcaataaaatgtataataataaacatttactgctccatgaataaacattcgagtgaagcctctaatggaggttacatgtttcgaggcagctctgtggctttttcagaaatctgccttctacttaatgagcatcatttccataatctgtgcattattgcttaagcctccctttaaaacatttcaaaatgcaaaaatttgtgaaatatgatcagtccaaaggggaaaaaatgttaagggaattagcaacttgtcctgttaaagggacaggacaagctttcatgtccctccagagacagtaacatagtaattatggagacagcacttcctaattatctcactagctgagcgcaatactactgtggtttttgcctctaagatctggtttaaataaaagtgataagaaacctggagaggtcagccatgaaggacaagcttgtgctaattctctttccagtgctaacaaagaaaccagaaagtagaaccagaaatttggggaaggtcaagatacctgtggtatggacattcctggatgtagagacagacaaatggtttgattaaaacggtcaccccaaagtaactgaattcagacaaaagcctatgctgagctttatgtcgatggtgtcacacattattttcagtgtgttatttcttaggaaaattacttacataattttatgtcattatcactttaaaaggttaatctatttcagataatctttgcaaattgtgttctaaaaagcaggtgcttttaaaaataactaaaacatgatgacatatttcttttttctttgtccaacagccatggctgggttgtttaactagagagaaaaaaagatgccaggagaaatgaaggaacaaaggacccttcacagtgtgataagatacagatagtcagcctctgcagagcggtgatgaaatgtgttaaaagtgatggctgtcacttcatgacatgtcagcgtgctttattggtgggttggcacaatttatttaaacatcgtcaggagggactcattttggtgtagttagaagttgtgtttctttagtgtgaataaatatctctgggcccacgtgcaacattttaaaactgtgctgttgtttactgtgggaattggagcaaggagctaagagttccaaagtgaagctctccttctcccaccattttatgatttgctataagtaatttgctccttgctttgaccgttactacaaaatctttcaaaggaacattattctccttaacaggggctaaatttaagatttttcatcattcaatattgctattttcacatgtgacttcaacaaaataaaacattcggcataaatagaatttagtgtaatccaaatcctgcttttctcttggtacatatgctttgttgcttcttgacattcctgaattacaaagtattaagcagaatcatctttttaagggttacattttccttctaactcaagtgagcaggtatttacgtcaaagtcacacatttaaaaatgacatcctcttccagcatggggcaaatctcaacctacagggctgccaagtggagctgcaactttttgcaagggttctacccagatgtgctacaagtccatattacctttgaaatcaccatcttgtaaagatatctgcaccctcatgtccactgcagcattatctatagtagtgaagatatacaaacaatgtaaatgtccatcaaaggacaaacagattaaaaaatggtatataataaatacaatgaatattattcggccttaaaaattaagagattctgtcatttgcaccaacaaggatgaacctggaagacatacactaagtgaaataaaccagacacagaaagaaaaatatcacatgatcttacttaaatgtggaatcttaaagtaaaatatatagagatagagaataaaacagtggttatcagactgcggtggaggttgggagggcagaatggggagatacaggtcagagaatagtaagcagcagatttgtaggaagaaccagtctagagatctaacatacaacatgaagactgcaggtaaaactgtactgtatttgggattcctgccaaatgagtatactttagttgcccttgtcacaaaaacaaacacccaaaaaagtgagtaactatgtgagatgatgaatatgtgaatttgcttcattatagtaactattttactattttgtatatatgtcttaacaccatgttgtatacctcaaatacacacaataaaatttatttaaaaaccaacgaaaaagcacattcccttcataaatgagattcttttcaaaataagtttgaaaatatacattgtaaaatatactagaaaaaccaccccctaactaactccccacaacccaggagctctgatttgatagcttaagacaggataaatgactccgattaggacaatgagccccagttttatggggacctcctaaatcatatctcggtttgggtctagaatgatggtgctgggagcacccagagagctgcatatcatctcagcctggcttccacacagggagccagagagatttatggggccctgtctggtggctttgaggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaaggttcaggtccttaaccttaggtcacgggatgacaatatacagaatctgcagcttgacagcctgggcttaattcctagtcctgccactttccagctgtgggacctgagatagtcaacacctcagagcttcagatttcttgtttgtaaaatgaacccatctcagagggttgctgtgaggatcaaattggttagtactgcaaaatacccagactagtacttggaacttagtaagcatagatgtaaggtgtttgcagctatcattgctgctgccgctgccacgattattagtactacaactacttaaccacaaaatctgtgctacttgaccacaacatctttcagttaaaaaaaattcacaatttatttttttaatttaactttctcttaaggactttaccattgttttaaaaattactctactgaagtctaatttactaaatgggaacaggtagaagaaccattctcctaaaaactaatgtggagtcaatatacttatcctgggcatgaagaaaccctggagcttccaaagaacacagtgtgaaaaactttgcttggggagggagatggaaggcagagaacgagggtttctcccactggggtacaaatccttaggaagtggagcttggtgattaagagcatcgagctctaaagtcagatgagctgggatgaaatccccaccccaactttcatttcctgtgtgacctgtgaaggcagtcgaatatcttaattctttgggttctatatttataaaatgcagataataaagtctattcttcaaagggcttctgagaggattaaatgaaataatacatgaaaacctcttagcaccgcccctggcaccattagaaaatgccttataaatgtaagctgctcttctagttacttttacccagatctctgctcaagtgttacttccatagagaggacttccccaatttctatattacatataaacagttccggtcctatctcaaattaaaatctgcatttattcactttttcattttttgttcccatactcacggccatgatcccagcatctgtgactatgactagcacttagtaggcacccaataggtatgtgttaaatgaatgagttaaaaaggagagacaggaagtatctctaactcaatgttaagagactgcaaaaactctattaggctgaaaactaggaagtataattcttcaaagtaataacagaaataaaacttgaagacatgttcttttgtgtatgcaatagtgtatgctgattgttctcaagctgccaactacccttaacagtgctctgctgtgaagacacaaaaggggcaggagggtggatcagacagacttcatatgagccacaatgcaggtccagccaaagtagcaaggatacagttggaatataaatgcctttacccacctctcactgttttcttctcctgaaaattgctctacattatgatctctctctctttctctatctcttgtctcatacttggctttcctctgtccatgcaaagggcctccttgtgatatcccacattctcttttatcctgacacattgcatagactcctgttgtgggtactgtgtagttatataaccagagttgggatgttttactgccttgatgcttgcgttgtgggtctgtgtaatctttgcattcaaagtgtgataacagacactggacatagcgcataacactcagagctgcactccaggtactaagatgtcatgaggcccacgagagagatgcacatttctgcaagggcgtcaagggacccaggagaggaaggtaaaagccactacgaggtcctctgagggcaaacgctccctgctctctcctgacaatgatccccaatgcatgaagtaggatatagtgtgttaaggtgataagggctgaggatgaagtgggttggctcaactggcaaagcactgtgaactggaaatgtgttagtgtgtggaaaagcaatgttaccttggatgagagctcactcctctcgtgaactagacttttccctcaagtgccttcccccataatacagtcagtaaaatcttctaaagccctgagaactggaatcatctcacgatctatagtaacccaaagtggcctagcaactaggggtggaccctgttaactattcacatcgccaccctgacaaaagtcttcctgctcccatttcaaggctctctccacacttggtttctctgacctttctgaacctttcaccgtatcttgctctctggactgcagcccctggctgtgaatacatatttagtctctcagcctgcccttcctatagacatattatttgatgcttatgcaaagatcacccttagccttcatctttccatgcctttgccatacactaccttcctcctccccacactcctgtagtcagatgtgatgcttcaaactcagcttgagcgcaggtctcattttcaccctcctcatacgcctgtggacaagtttgtcagaccattggttaaatattcgaccaagagtgaggttggtaaaaggaaggcatatttacgagacagaacaaaggctttgcattaaacaaaacaaaatggcagttttccttcttgctgaaaccctcacttggatattcctccagaatcagagctttccaagactccacatgattcatcccctctcccatacttagctgtctggattacagcccttagttctttttttattttttagagacacggtcttgctctgttgcccaggctggagtgcagtggtgcaatcatagctctctgcagcctctacctcccaggctcaagtgatcctcccacctcaggctcccaaaaagcttggactacaggcatgcaccacattggctaatatttttttaaattatttgtacagacagagtctcactatgttgtccaggctgctctcaaactcctgggctcaagcaatcctcccacctcggcctcccaaagtgctgggattacaagcatgacccactgtgcctggcttcctagttctctataggagtctctaggttgttctgcctgagagattctgatagttcagctagtttcaaccagaatgctgaacccattattttgagcatgaatctgctctcctgttatattactaagaagaaaaacaaggtattccattaaatctgtgggcacatcctcaaaagcacatagttttgccgagatcttacacctgacaatggaagtgcttgcacgatgcaggtagtaaaacggaaaataggaatcaggaagctgatcaggaaccagctcagggctttgaaaaggagaaggccagtgagcgcccaccatttgcaggttgacagagtcaattttttttttaaacctgggctcaaagagagattaggcagctggatggggagcagactaaaaaatatgttcacctttaaataaatcagcaacgaaattggaggaggattatacctcagggacaaaagaggaagaagaacatgaatacctgctttacttgaaatgcctcccttctcccagcctttcctgcatggagtatgacaagagaggcccttggtaaccttcactttaattagaatcattaactgcaaatggaagtaagaacaactcaactctccttgtctaattacaggggctaccttactcctgtctgtaaaaggcaccaatattgtcctatgaggccctggcatgaagactttgctactctctcaagtaccaagaacagccttggagtggaagaaagaacatatttgactctaccatggaaattcttctatacctcaacatcattccttcatcatactcacatcctggcttgacagaacttatgtatccctgaaagccaaaggcagcttaagggacaggatagtggagaaaaatgcagccctggaactagactccttgtgcatgcatcctcatcacaccactgactgctacctggagcaaattacttcatatctccagattccagtttcctcatccgtaagaaaggcacaacaccactgtctacatctcatcatagtttttccctgacaattaataatacattacataaaataaatctttaataaagtcctaggactcagtactaggtactgtctaaatactagctatgatttaacatttttattggtaaagttttagaaacacttgctttgagattatggattcaaaggaaggtacaaaatagtacagagagatccctggtagtgtactcttcatctagtttctcaaagtactatgctgacatagtttataaaatataacatacctatagtacaatatcaaacccaggacactgacattggtacaatgcgtgtgtatagttagttcaatgccattttatctcatgtggagattggtataactaccattgcgctcaagatacagaatgaatccattaccacccaaatcaccattgtaatcctttggggaggcactcctgttccttctcctccatccattacaagactggcaaccccacaaccactaatctgttctccacctccacactttcgtttatttttcttgaatggtgcaataatatgctgccctttattaaacatttttttcttttttttttatttaaacttttattttaggttcaagagtttaagcgcaagtttgttatatagggaaattgtaagtcacaggggtttcgtataaatattttttcatcacccaggtaacaggcatagtacccaatgggtaattctttgatccgctcccttcacccaccttctacactcaaatatgtcctggtgtctattgtttctttctctgtatccaagtgtactaaatgattagctcccacttataagtgggaatatgcagtatttggttttctgttcctatgttaatttgcttaggatactagccttcagctccataaatgttgctgcagaggacatgatctcattcttttttgtggctgcatagtactccatggtgcatatttagtacattttctttgtccagtctaccttggatgggcttttaggttgattatatgcctttgctattatgaaaactactgcaatgaatatgtctatgtatgtgtctttatggtaggatgatttattttcctttgtgtatatactcagcactgggattgctgggctgaatagtagttctgtattaagttgagaaattgccaaacaaccttccacaatggctgagctagtttacattcccacaagcagtgtataagcagtccccttcctccacaacctcaccactacctgctattttttgacttgttagtaatagccattctgaatggtatgagatggtatcttattgtgtttttgatttgcatttctctaatgattagtgatgttgagcattttttcatctgcttgttggcctcatgtatgtcttcttttgagaagtatctgttcatgtcctttgccaacttttaaatagggttgtttttgcttgttaatttatttaaattccttatagagtctgaatcttatacttttgtcagatgcatagtttgcaaatattttctcccattctctaggttgtctgtttactctgttgatagtttcttttgctatgcataagctctttagcttaattaggttccatttgtctttttttttttttggtcacaattgcttttggcatctttgtcatgaaatattttccagagaccgtgtacagaatggtatttcctaagttatcttccagagtttttacatttaagtcttcagtagttttaggttttacatttaagtctttaatccatcttgagtttatttttgcatacattaaaaggaaggggtccagtttcagtcttctgcatatggctagtcagttattcaagcaccatttattgaaaaaggagtcctttccccttttggtcagctttgttgaagatcagatggttgtaggtttgcagctttatttctgggctctctattctgttccattggtctgtgagtctggttttgtaccagtaccatgctgttttggctactgtagccttgtagtacagtttgaagtcagataatgtgatgcctccagcttcactttttgcttaggactgctttggctattctggctctttttagattccatatgaattttagaataaatttttctaattctgtgagaagtcacgttggtagtttgataggaacaggacagaatctataaattgctttgggcagtgtggccattttaacagtattgattcttcctatccacgagcatggaatgtttctccatttgtgttgtctctgatttctttcaggagtgttttataattctcaatgtaaagatctttcacctccatggttagatgtattaggtatttttttgtgtgtgtttgactattgtgaatgggactgcattcttgatttggctctcaccttgaatactgttggtgtatagaaaaagctactaattttttacattgattttgtatgctgaaaccttgctgaagttgtttatcaaattaaagagcttttggacagagactacagggtttcccaggcataaaatcatatcatttccaacagatggtttaacttcccgtcttgctatttatatgccttttatttctttctcttgactgattgctctggctaggacttccagtactatgttgaaaaggagtggtgagagtgggcatccttgttttattacagttctcaaggggaatgcttccagcttttgttcatttggtatgatgttggctatggatttgtcattattattttgaggtaagttcattcttccaatgcctagtttgttgaggatttttaacaagaaggatgtctaattttatcaaaaggcttttctacatctattgagataatcatgtggtttttgtttttagttctgtttttgtgatgaatcacatttattgatttgtatatattgagtcaaccttgcatgccagggataaagcctacttgatcatagtggattagctttttgatgcgctgctggattcagtttgctagtatttggttgcggatttttatatctatgttcatcaaagatactggcctgaacttttctatttttattgtgtctctgccagattttggtatcagaaaaatgctggcctcacagaaggagttagggagaaggtcctcctcctacatttttcagaatagtttcagtgggaatagtaccagctcctctttatatgtctagtagaatttggctgtgaatctgtctggtccgtggctttttctagttgttgggcaatttattactgattcaattttggaaatgttattggtctgtccagggtttccgtttcttcccggttcaatcttaacaggttgcatatttccagaaatttatccacttcttgtacgttttctaatttgtgtgcatagaagtagtagtaatagtctctggggagttttttggtatttctggggggttggtggtaatgtcccctttgtcatttctaactttgtttatttgaatcttcttttttccttattagtctagctagtggtctatcaatctgattaattttttcaaagacccaatttatggttttgttgatcttttgtatggttttccatgtcttaatttcattcagtttagctccgattttatttgatgctctgagggtttgattatggtataagaggttcagttgatgagcttcatttctggaagatttcagggggccacggcttagctcagcactcctgggggagtatgctgcaaccctgggggggctggtaccagtcccccagctttgttctctgcccctcaaggttaagaacctgctgtgctggaggggcataggtgttccccatcttctggaaacaacactctgacagaggatgctggccaaagcacttcactggggcagtggcagcaggatccatgcttactagcatgtgctggcaacagtggcagaatggtgggtgtatgccaattttgtttttttgaaaatctatataaaagactcctatattatctgaccttttaaagtgggcttttgtcatttaacattaatgcccttgagatccatacaagctgttttgtgtattaatagtttgttcctttttattgctgggtaatattctatggtatagatgtaccactgtttgtttaaccattcacctgctgaagaaccttttgactgtgtccagttttcagctactataaactacctgtgaacattcattcatgtacagatttttgtgtacacataggtttccctttctctgggataaatgcccttgggtgcaattgttgggtcctatgataagtatacgtttggtttttaagaaatcactcggccaggcgcagtagatcacacatgtaatcccagcactttgggaggccaacgtgggtagatcataaggtcaggacatcgagaccatcctggccaacatagtgaaaccccgtctccactaaaaatacaaaaaaaaaaaaaaaaaaattagccgggcatagtggcatgtgcctatagtcccagctacttgggaggctgagtcaggagaattgcttgaatttgggaggtggaggttgcagtgagctgagatcatgccactgcactccagcctgggcaacagagcgagattctgtctaaaaaaaataaaaataaaaaaaaataaataaataaaaaataaataaatcactattttccagagtagtagttgtcttctatatttccatcagagagatttggtttctgttaccctcaccagcatctggtgctgtcattttaaaaattgtcctaatgtatgcagtgataactcatcatggccttaatttgcatttccctatgggctggtgacgttgagtatcttttcatgtgctacgtgccaccctttattatcttcaatgaaatgtctatttatgtcttttgtccactctacttgtattgttcattttttctatcataaagttttttttttccccacagttccatgaatactatagactttttttcctttttcaacttttattttagacttgggggaacatgtgcaggtttgttacctgagtaaaggtaactactgtgtgaagctgaggtttgggggatgaatgatcctgttacccaggcagtgagcataggacccaatagttggtttttcaacccttacctcctcttcctctccctctactcaagtaatccatagtctatattgttaccatctttatgtccatgagtacctgatgtttagctcccttttgtgagaacacacatataccagagttttgagaattcattatatcttctagatatgagtccttcatcagtaactttttaagtttcagagatcctctctcattcccttcaactacgagtgatctcttctttccctaacttctttacaaattttcacataggaccttttatcctgtctatcttgagtctgccatagatggccctccctaactgcctcactcatctatgaacaggctctatttctgatttgtcatcactcagtgtcttgctaacatttgggcacctatctggcattccactaatgtccaccaagtgactgaatcaactatacctggattttcattcagttactataagacttcagcctaaagcaaaagccacggttaccatggatacgcaggcttgggatagatatgtatcctaagcatttaatactttggaaaggataactaattacaaaaagaaatacacacactcagatgtgttagtgattaatttcttctcagctaccacacttctagctaacgctgtgacacactaacgtttattgaggagtttctatttacgccaacctggggctcacatttggctaattaagaacacatacatttcagaacttgtgatctgtgggctgtgtttacatatgaacatcatattcaatacacaggcaattgtttagcacctctaacctatttctagccttatatttaattagtgagaattgctgatggggaacgcagggtatgactttgcattaaacaaacagctatcctccttacaaatcacaacaacaatgcataattaaacaatgagctacctgagctttattcagtctttcttccaaaggaattaaatctctaatgaggaccaggcctcaggaggaactgcagaaggaatagaggtaaggagacataggggtcaattctagccctgcttcctggcctttctgggtcttaatgtccttattgtgagatgaggaaatgaatactcctccctggctccccatccttctcttcttctctctggtatgcatgttctaaagatcacatgcaataacagaggcaaatctctttgctaaagtaaagcataatataaaatataagaattgtcactgctgtgagttaagaggatttcattatttttacactggagaagaaaaacaattgccattaaacaggttctccatgacctgtccccatctcttccctgccctcatcacctgtccttcctctccctgttcacatgtaccagccacctgaccttgctttgctccttcccatcatatcaggcacatgccagccttgggcaaatccccctcctcatcaaagcctttccatgaccgatcctccaattgaaactatcactcactcccctcttatatcacttcttttaatacagtcagagtacttgccactgtctaaaaaaactgtttgtttacttgttttcttttcttttcttttctgcttttcctactattctctcctgcttttcctactactctccaccagaatcaggagcagtaaactcaatggctctgtcttacttccatgctacaaactcaggtgagttcactgtagcctccaggagggaaatgtacattatgttctctgggacaaagctcccaggcaacaggcaaaaatgttccttttattctacacaactttggaaaacacctctgaatccaacgttgagagccatcatccttatgctgagtactcaagagctcccaggattctacagcccataaatgagacaatttgacaagagtcactagtggtgaccacagtaatagtattaggatgaaccacatgaaatcactgagattcactgttttggccctaaccactttcatatggtttggcatagtaacaacaatggcagcaggagcccttgctacatgccaggctttgtattaaggctttaatagatactagttcattcacttcccaccacaatcttataacctaagtattaattacctatgtgttatgcatggaaacagcaaggcttaggaaggttaagggatttttccagaggagaggtggtagcatcaggtcacaaacttaaccccgtattatcctggaagagctaatgtgtgttcccttcctagggaccaccatgaacccacctgggttctgtgcatggaaataacacagaaatggaagttgctgttttttgctttattgcctccacgactttgtagccattgctgttgactgggaatctctaaattacaccaacactcagggtcatctgagttgacaactttcatggccacggccactacgcccaagaaaaaaataagttggaggtaaaatggggtataaaactatcttctagcactttctgctaattgtcttttacccagacaaggaactctgaaggactctgacatcagtttgcgatgcctcagctacctctgtcctttggccatctctgacccttcagccaacttgggaccctcagtcctggtaagagatcatcaggccttgtgccccccaccccaccatcttggtgagctgactctttcttgctcacaccatacctaagttccaaatagaactttagggcatctgagatcccacacaggcctccccactgctgggatcaatgataaccatctcatggaaagcctcttcattgagatgtccccagttacatcaccccaccagcccagcattctcctggctcacctctctccagccacagaatttgcatctcacagctgagaaatgggattggtcttctcctctctccatgtctctgaaaacatcactcaaccaccttggctcaatagtctcctgcttcaaccagtgccactgagcatgccaatctctttttgtcatgttgacatcatgtgtggccttgatttgcctcccccaaattcctcctaggatggcccttctcacagccttgatctcatcctgggcacctaaaggggtactgagaatggtccctcccacagctttgactgaaagttcttggattccttctatatccagtcaatttcactaccttctactttagctacttagtcttgcggatgtttgaattttttggacactggatttttttcatcgtataaatgatttcacatcccaaatctgacattatgtaacacctctttcctgaacaacctgccgagtttgtctataagaccacccacactgtgcattaagttcaccaggtataaaacataggtggccattgcaccaccaaagccagtatcccagacacagtgggttggagaccctcgggacatgcagacatctccccactcccagtcagccatctgactctgtggagtctcctccctctcttgttaccattcctcagttgtgccaatgtgacacgccacttccagactctcacctcccctgaccaaagctagaggcatggcctttcaatgatctcggcttgtggtctcaccatagagtctatatgccacattcctgctcaacatctagaggtgtcacttcaagctaccctcccattatagggtattaagctctgaagttagccagtaagggggaaaacatggttaaaccactctggaaagatcccttaaactgaccaaccttcaacaaatctgaaaagtctaatttctttttcttggaaccaagcgctggttctgcatttgaacacaagttggagtcctggttaggatttggagggctagagggtgcaaaaacgtccttatccattagggtcacactcatcacagcaagatgctccccttgtggacagctgtgtgggacggcagccagtgaagaggagactagccactctgaagcctacgttccttgagtagaatggtccacaatctaaatctaggggttcactccttctctccctctgcatttgtctctctttccatgtctgcttgtgtctgtctctccaccccccgaagtgtgtgtctgggtgtttctctctgaatctcggtcccctagcgtatgttgtgtctgtctttatgtacgtatctgtgtgtacctggctctgtgtctctctcagcatgttactgtgtttccatgtgtgtaagggtaaatctcccctgtctctatctcttcttgtctttctctgcatctgtccctgtctctacgtgtgtacctctttcttggtttctctgtggctgtctctctgtttctctctcggtcttgatgtctctctgtgtgagtgtctctctctccttatgactgtcttcatgcgtgcattgggtccttgtgtgcatgtcctcctcctccagtgagtgtctccctatgcacacatttcttgaggtgtagggctctgcaaaacacttagagttgacccatttcaaatatgttagccgcacatgattcccggccaggtatgccagcgctgccctcttctgcattgccacgcagacgcctaccttggtcgaaacacttgcagacatatctttagcaaggtatctttcctcgtttttccccaacaaaactcatgctgtaggaatctccaacatatacaatgaaagagtattgagctgccatagataaattaagtactgtgctcggcctcccactcagcaccaagaggccaaacagaatctaaaaccactgctgacacctagcacaccaaacctttccagcctctgcaactggcattctctgcatgtcaaaaacctctgaatcattctgggtcaagcacacatgcctcctttcacaaaggttctgcaaacaggtagcatcctgtaccccgagtgtgtgcctggtacctactggtgtacccccttctcattgagaggtcctgatgcctgtggtgtgagtcagtttgagtgtgttaatggagtgttctgctttcaaggccaaactgcataagcagagcccatccttttcccttcttttgtgcccagatgggaggaatttgtgaaacttgtattccagtgttaatgctgaagttgggaaatggctcaatcaagcaatggcagtttaacttgaagagtgcaaaggagaagagcagggagaaaaccaacactggaagcaaatcagaaggccagaaaccttcatgggcacttgcactattgtttacagccacaataatcatgtaagggaacccagcatttttcagaagttattttgttctgtttttttttcttttttttccaaatgtgtgtttgtattgctttgtttaaatataggcctgattcattcaggcttgggtctgaagatcccaggctttcagaactcaacaaagctttcatcatttgcaaataattcaactcaacaaatatcatttgagaaaagctctgtgctagtgcttcttgtagagacacaatgaagaaaaaatcacggtccctgctctttggagacaaataacttaggggaaaacacacacacctctcaactctcacctaaggagtgctgtgcaaagtgctgaaggagatggagactcctctcctgggaaaatctgcaattcgaaactcaaaagaagatgaggctaagggccctccaggtggaggaacagcctgagtaaatgcctagaaaggaatggcacatagtaggcacttgcaatcaaagctttgctaaatgaatgcatgttgaacatgttccagaaaactcaagaccagagtagcactgagaagtagaggtgtttcagggcttccttttagaaatttcttatactgaaggtttcagaatgctaggagggaccagggagatggtttattccaactggtttcttttgaaaacgaagaaaccaaaaacccaagcttacatgctagggccagaaatgagatgagaactcagaactgttccagaaggtaatcactttgaatttaaatgcctactcttctgatctcaatttaaggaactaaaacaaaatcagcagtactgtttgctagttttctgtgaatcattcagaccctggagaagccagcttcacttttgaaagctgagctgatccacttacaactgtgtggctaggttcccattactgagtctcagtcttcacaactgtaatataggaaaaacaacagtagctatcgtacagcgtagttgtaaagattcagtgagatcatgtacaaaaacagctcttaacaaggtcatcagtgaccttcactttgccaaactcaatggacattttttgtccccatctcactagacctctgggcagtggcatctggcacaaaggggctgctccttccccaaaacaccccggcaccggctcctgggatagccttctttcctgctattctttctttctggatgttcctcggtctccattgccaagtcctcttctatccaatttctaaatgttggcaaactgcaagagctcaattctatatcctcttatcttccccagcgacacacttttctcattgaacccattcagcccctccgctttacacaccatccaaatgttgctggcacacacttttatatccctagctcccacttctccgctggttgtcagactcaaatatcaaactacctgcttgagatctccatgtggaagtcatagaagagtctcaacccaatatgtcaaaaactgaactctccattgccccattcccaaacttagtttttcctcacctgcttaaatggtattgatactcaaccatgacttaagccagaaatctaagagtcattcacagcacctcctctccccctctcccaacatctgccatcaggtcctaaatttcatttgtgatatatatgttaaccgtatacgtttttctttatttctaccaccagcactgtctctcatctgaatgacggcaatcacctcctaactccactcctgtatctccacagtcagttctctgcccagcaaccgccatggtgtgtaacaaatgaaactgatcccagtactctgtgttccatccatcagtggcttcctcttgttcatagaataaaggatgaaacctgaaatacttcttcaaacttctccaggatctactcacaaaaatcctctggcacagctctcttcttctatcatttggctgcatttctacttgcctatttttcatactcggaacaatcatgctttttgtagagccagggccctcacatgtgttgctcaggtctttagtcagcaaactcttcttccttaatctagtggttaaaagccccagctctggagtcaaactgacaggggctgggtgactaaagacagtcttctggccaggcatggtggctcacatctgtaatcccagcacacagcctcccaggaggatcacctgagcccaggagtttgagaccagtctgggcaacgaagcaagacctatttgccaaaaaagaaaaagaaaaaaggccgggcatggtggctcacgcctataatctcagcactttgggaggccgaggcgggcagatcttgaggtcaagagatcgagaccatcctggccaacatggtgaaacctcatctctactaaaaatacaaacattagctgggcttggtggtgtgcatctatagtcccagctacttgggaggctgaaccaggagaattgcttgaacccgggagggagaggttaccgtgagccaagatcgcgccactgcactccagcctggtgacagaacaagactgtctccaaaaataaaaaaaagacaatctccttagtaaaactatgtaccttactttaatcatctgtaaaatggggataagaacagtagccacctcacatagtggtgaatattcaataaaacaaaatgtgtgaagcactgaaactactacctggcagaagaaaaacactcagtaaacattattgtcaaaaatccctatcatcctttagttctcatcttaaatgtttctgcttaaagcactctccattactctaaccctcagttttaatccattttatttcctagtactaatctaaattggtcatcaaatattgattttgagacttattgtccatttctgcctctcaaattacactctacagaacagggactttgtctgtgtttccttcagtcctggaaacctggcagaggagctgaggaactgagctttacaggctgagttctgtgaccctgtgattattatgttgaagccctcatccccagtacctctcaatgtgactttaattggaggcaggggctttaaagaggaaagtaagttaaagtgagaccatcaagttaaaattatgccctaattcagtctgtctggtgtatgtataagaagagagggaatttggatacacaaagagaaaccaggggtgtgcattcgagagaaaagattgtgtgaagatagagcaagaaggtggctagctggatgctcacaagaggggcctcaggggaaatcaactctgctgacaccttggtctttggcttccagcctccagaacggtgagaaaataaatgtcttttgtttacaccacctaatctgtagcatttttgttatatctaccataaaaactaatgcagtcagtaaagactgatgagtgaatggatgaatgtgtcaacccagtgctcagcacaaggtaagtatgcacaaaggttgactcctattcctgaaataatgatgatgaatgtaataacatctcaggagcaaatctaaccaatgcacattgaccaagtcactgagaaaaatatgtctcagtggcacttacagtgcttttcacctgtaatactgaagtgaaatgtgattagctatgaagatctgagaccttcctttaggagccagcacatactactctatgacttctgtttacttaatttgtacatgttggaacttgactgttttatggtagactcttggctatacaacatggaacactagacatttccatactcagtaaacaaatatttctcagacatgacagcaaaactagaaatgagaatattagattaatacttccaaaataacagcctcatcgttttaatcaacatgtccttgaacacgtttgaatgtgtgtgtaactgtgtgggaatgtgagctacatgtgtatttttccactgaaggtgaccataccatatgcaagagcaggatctcaaattagatattcagcataggtagccatattatccacatctaccaactgtcttcaaattaaagcccttctctagctggaacatgtatctgtcactggaaagtaggcagtgttgaaaatcatgacaaaattggcacatatcttgatagttgcatcatcttttctgtggcagtccccagtaatagagcttcatctaattcagcaaactattagctcataataagaaacagcatgtgtattgattcttttaatagatcttggaattaatacacatgattcctataaaaggactgtataaaaaaaatcaccaagttgattattgcacaatgaggtctcactcaaatggcataggctacggcagaaaggtaggcaattcctcttttgaaaaaaactctccatcttacagactgattctctcctgaggaagaaaaaatataatgaagtgctataattaggtatctcacatgtaagggaagataacaaaatcaggaacagcaaataggtttttactgagtgtcaactccattcaattagctgcagctacctagagggttgtattaagaagcccaaggtcgacagtaaacaatgccttggtgaaataatgatgttggctagggttgcaaaatgatgagtagatggccgctatgtaatttctactctgaaacagatgtcactaaagtctcttccggggccaaccttctatgactctctccttttttctcctcttccctcactcttgctcttggagttgggatgaataagttagcatctcctgagaatcccaactttctcctcttatataaagtggtcaggctcagttttcagtatcaggattcaaagcagcaacctctgtcattacaatcatgtgtcgctttggtataggcattgaaaagctgtaccagggtgctgactgtcacttaagtaattagactaaactataataaacaagaagagatcactgctggagacccacatttgttaatgacctccagggtcctctcccctggcaagagatagacagatgaggtaccaggagtgcaggcctccttgcacgtataatgacaacagccagacaacaatgcaacaaaaatggtcccatgtcctgttctgtgtgtatagggagagtgatgacaatcatcattaccaccagaactaccaaatttcctctccagttctttgatgcttctcaatcattgtcggagctaccctttaaagatgtctcaccatgaacagttactatgacaagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggctagagaactaataaggagataataacatatgtagaggttcatggaggaagggaatataaagtattcaaggagctatgagccagagcacatcgagcaggtcaatgagggaaagagtggtatgagaaaaacctggaaaggcagagaggaggtggaccatattaaggtgcatagggtggcagtggaaaccactgaaaaatttgagagagaggaagacagtgggtggaagaaaggggacaactgtgattgttcagacttcagtgaccacaaacaatacagggagcatggtgagatcagaatggagatgcagcaacctgtaacaggtcacttagttcagatcagagacacttggtagctttgattaggtgatggtggtagagatgagcagaaatggatggatttaagaaatattgtggggtaaaatctaaagcacttactgataaattggatttgggaagatgaggaagcaggaggcaaggataatccctagatttctgacctgaccagatagatgttgctactcactggctggcaacttcacaaggtggccttgttgactttggaataccttttgggcatcctagtggagtggcctaaaagggagttaggttttacatgttaggagttcagaaaagaggtctggggtggagacattatcttgacagtcagttttatagctagaaatggttgaggctttgggatagatagagaaggggtactttggaaaacaatgttcatggaaagcaataaacattctcgtcaatcactatattcttctaatacacttcttccttttgttatgagcatctgcatctttcttcctcttgcgtttcaataaaagcttctatttttaattacacttcccttggttctaatttttaaaagtattttgcatatctgttttatactatgtatccctataaccactccaacttttgtagaatgaggagagaggaccaattactagttttcagaagatccacatgagactccaaatggtcaaattatcctgacagcgaacccagcaaggaatagattaaatttgaatagtgcactcaaaaggactatctttgagactctaagacgattcttgattcattcatttcgtgaaagccaaaatgtccgaaagtggtttgcggatgaggggactgaatcgtgaatttgaggcctaaagaatttcccaatgttcagccttatggtggattaaatttaccatgactaattggaggattcaaagctgttaggaacactagctattagggccatttttctcatcttcgatcttactgcttgactgattcatagctggaactgctaggccgttatggaaatggaaatgcagagatgaagcagttcccaatgtcaaaaacttccagggacatgtaaatacaatacacgtaccaagtaatgagtttaattacttaattattagatactgagcactaaaatttaactaacacctggttccataaggaaaaaaatacttcatttcgctgtacttatagctctttattatgccttttgaattatctgaaatccactgatgtacgggtaaaaaactcctgcagctagctcagtgtctgtccaaatggccacccagttttgtgcttgaaatccaggaccccactggtgtaggcatctgtggggaatctcctggtctgtgggttgtgaagaccatgggaaaagcgtggtatctgggctggagcgcaccattcctcaaggcacggtcccacatggcttcccttggctaggggagggagttccctgaccccttgtgcttcccaagtgaggcgacaccccaccctgcttcccctcgccccctgtgggctgcacccactgtctaaccagtcccagtgagatgagccaggtacctcagttggaaatgcagaaagcacctgccttctgcattgatctcgctggaagctgtagcccagagctgttcctattcggccatcttgacagccaccaccccatttttcaattttttttatgacaggctaactgtgggctttcctaagagacatgagagtagtatccttcccctacaatcctcaggcctagcatggtgtctggcatataacaaataaatcaatgcagcctctcaaggaatcctcaaaatacagcagaatcattctagaaaacaattcatttcgattaaagaaatgaacaccatagagatgttccattggaagacttttgaaccaaaacatttaattcgccagtcctgaccatatctataacaaaaggaactatgtctttaacgtatttttcttgaaagccagttcatatggttgagagagcttataaggaatactaaaatagggaatataatcagccttctgtttttgagcaaaagtgctgtcaactagagatggggctcttggaaaatactttatactgcctgttctcagtttttttcttcttaagagctacttcatttcattgttcaaagtttagtgagagccaaaagaaaatacaatctatttacaataaacctatactttccagaatcaccttaaattatttctgctaactctaagcataaatcaaaagttctgaaaagcagaatggcctaaagaggaaatatgtcatttgtgtagttttgggaggggagggagtctgttaggaaagataaattattattgtcctaagcaaaaggacagctaatgaattcctaaatgacagggtttaatcctcaggcttgttgactacaaggttatagagctttcttcctttccattgttaaggagatatttaaatgtaaacatcttttctaaccttggaaggaaactgatggaaaacagtgagtattttcttggtgcaatttaaatattaaattcaaacttaaagcaattgttcacacatgcatttgctagctcaagaacacaaacataatctgtgggaataagaatcacaataaatgaaataataatagaacaactgaatccatcaatttttctagcatatatacactaagcaaatagtttgcactttgcataggattcagcattgccaatattttatttctaataagccaggtataataagaaaagcaaaatgtattggccaggtgcagtggcccatgcctgtaatcccagcactttgggaggccaaagcgggcagatcacgaggtcaggagatacagaccatcctggctaacacggtgaaaccccatctctaccaaaaatacacacacataaaaaaaaatttgctgggcatggtggcaggcacctgtagtccccagctacttgggaggctgaggcagcagaatggcgtgaacccaggaggtggagttcgcaatgagccgagatcacaccactgcactccagcctgggtgacagagcgagactccatctcaaaaaataataataataataataataaaagaaaagaaaaatgtattgttagtcttaaatattttctggttttaaattgagtcgaaaactcatggctcaagttcatttaaagtccaagtctgaattctaaaggttaaatgctagtaccgttagttcctcaaattattcacttgttttttatttttgttacatgagagagagaaggaggaggagagagagagagagacagaaagagatatcacagaattagaacttgaatctcattcagtggatagggatgagaagaaaaatgaacattcacagagcgcctaacatgtttcacgtatccaagtatcacatcaggaactttcatacttatgatttcatttattcctaaaaattaagtaactaagtttcagaaaaatagagtgacttgctaaagataattcagtgactgagtggtggaatcccagttttgaagatagagctctttgactccaagaagaattctcaatccataaagctttactacaaattagggaaaatggcttatctttaaaatagcgtgtgaataaataaatgagtaaagtttccatggggacataggcagcaaattaacagaacacaatttaaaatgttggatgtaaactaataaacagatgcatgtcactaaaacgtcacatttttcatcgtaacagtgtattatctgttggcaaagacctcagtaaagctgtttttatacaacagaagcacagctggctaaaaacagaacaaatgtggtcaaccaactaaaattttcaattcgttcaatgccaagaatctgcatggaatgacgttttaaataaaacaacctgaaagtaagctgacccataacaatttggtttttatctttaataactttaaatttttggttaatgtctctataaacagcctacatattattcagggtaaaggctcaaatatattatactaaaattgcttttagacccagaaaattcctttgcatggaggtatgaaaaaggaacatttgaaattagcttgaaatttgggtgtatttcagatatgacatgccattcacattcatgtgtttccattccccatgaacaatgggctgcgtgggccagtatcaatcatctattaatccagaactttccatactacctattagttaataaagtacattgacatccattaccccatgtgatgggatatttaacacacttccagaacatagaataaaaataaaggggtttatactttacctagaaggctagtgacttaagaattttggtgggaagtttcatccactagaggaaaagtcttatgattatgtggaaattatttatcacatgcccccaacaaaccccacaacatcacaatagacaaatagtggtgctcaaatagtgaacattatggaaataagggagaacatacatctctacccattcccaatagttttgaacttaggtatttataaaattaatttcatgatgctgcacataaatcttaattctaatgtgcataaacagaaaaaagcaagttgtataattattctgtgttattatttttaaaagccctatatatcaaaccaaaacaaatcaatataatgccaccaatgtgaatatcattaggctcagcatcttaaactcagcatgatatccatcgggccataaatttgaaggaaaatattcaataccagtttcataaatcatattaacattaggagaaaatctattatagcacaaagtcttattcaagggaaaatcatgttcataggaattaaacaaacaaaaaaacacttgtggccctctgctctattatccttaaattttaggaaataactaattataggagagttttcagtcatgtaaatcagagagttagcaaaacaatggttatattatgacagcaatcaataatagcatgcatttttattaaaacattactttctaaatttgtagggctttaaattgtctagcagaacacagcttgaagtatgatatatggatggaggttcatagaaaatatagtgtatgggaaatacagactccactcaggagatatatctgatttaaacacatgcatatatatgtgacaatatatatctaattatatactaaatctcacagaactacataaatatcttcttgcttgctttctacagtttctttaagaaaatattatttaagaggtgacaagtttcttgttgttgttgagcaacttgaattacttagtttcttgcagaactgtgtcttcttccagctagagtgtaaaatcacttggaatcataacatattcaaagagttttgtcttaacaaatccatgagtgatcaacttccttccatcctcaacaaagctgagaggtagaccttgccagttctaacctagcactggagtttaggtttattagatttagccagaaccttcaagtgattcttgaaatgaactttttaaagagaattaattaagcccaatttctagcctacatgattcccatgactatacatttatattagaattgatattcaaaactaactataaatatttaaaatccttttatcaacaaatgaaactagatcagcacagagaaagttgaactcaacttctaatttcctcctcttggctctatcaaacaagagcaaatcaaactggctgctaagagaactgatgaccaagacagactgggaaatgagacttctagggagtatgtcaccgtcttaaaggcctttctagactggatgaatagaaataactggcagataaaactgataaactgatttgaaaacatctaagtaaacatggccacatgcaaaggtatccagagaaagataattctagaatttgcagataaaactgctgaattgctttttggagcctgtgaagaattacagcagaggtattctaacaaagcagaggtattcaaacaaataagactcttagtattcaacctcccattgggcaaaaactagaagctggcacccaagagagaaagcacctctttcttgtcccccaagcatgtggcttggactggattttaccccaagtcccactgtagccagaaactttcatgtagggcataacctgtgcaactcacatatggttgtcctggatctaaatactgtataagaataaatatctctttatcaaaagaactaactacagctagccatgtgttacttaacaatggggatacatgctgagaagtatactagtatatttcacccttgtgcaaacatcatagagtgtactcatacaaacctagatggtacagctctctgcacagctaggctatatgctatacccttcagctcctaggttacaaaggtatagagcatgttactcacttaatactgtagttaatggtaacataatgataagtattcatgtatctaaataaatatagaaaagatacagtaaaactatggtataaaagataagaaatatggtattcctatatagggcacttaccatgaatggagcttgttggattggaagttgctttgggtgagtcagtgagtaaggggtgactgaatttgaaggcctggggcattactgtacatttctatagactttctgtacactgtatacttaggctatactaaatgaatcttctaaatttatgtaataaattaatcagcttactggaactttttaactttatcaactttaattttcttaactttttgacttttgtaataacatgtagcttaaaacacaaatacactgtacaggtatacaaaaatattttctttctttattctatttttaaaaccttttattttttactttttacacttttgtgttaaaaaccaacacacacacacacattagtctaggtctacacaaggtcaggatcatcagtatcactctcttctatgtccacatcttgtcccactgaaaggccttcaggggcactcaccatggagccgtcttctcctatgataacaatgcattcttctgcaatagtccctgaaggacctgcttgaagcggttttaaagttatctttttaaaaaaataataaatacactctaaaataacaataaaaaagtatagtatagtaagggtacaaactagtaacatagtcgtttattatcaagtattatgtactgaacataactgtacgtgtgatacttttatacgactggcagcatagctttgtttacaccagcactgctatgaacaagggaataatgcaatggactacaacgtaaagacagctacgacattgcaaggcagtaggaaattttcagctccattataatcttatagggccaccttcatacatgcggtctgtggttgactgaaattttatgcagtgcatgactactataaccttacaagcttgataaaaggcaggtaaaattctaaaatgcactgtttcagaagggttggtggaagcttggcaaaggtgttcacgaagagccagcatggctcccaaaggcacctcagtttctatgtttgttggataagcccagtagatccaaagaatgctacaaaatacaacatatagtatataaagctaccataattctgctttaggggaggatggagaagaaaagattagatgaacaaaggaagaaaagagtgaagaaaatgaagaaaaggagaaggaagaagaaagtctaagaaacataaaagaaaaaagaatggagaaaagatatcttagaaaatggaaaatgaaggaattaagaagaatcaggatatctgcaagttatatgacatactctctcacaatacctttgcgaagcatgtcattttcatctaacacagcagggctcaagcaagagtaatatagtaatattcaaaaagaccaggggtaggtagtcagttttccacctttaccaatatggaggaacactgatgtaaagaaaactatcacctatctttttagggaggcatttttagtgtataatcaggactttagaaggcaaactttctttaggctgtacccaccattgaccttaactgagaacacctctaccaaggtcagggggccaagactctccactccaggtgatgaaatcatacagtttcgatatgatttcacaatatgaactgtagatttttgataaagtaaaggcctggccagaaaaagggcagaaacctatatgaactttaaggtggtcagaaagctcagctctacttaagaaacacttttagactcactttagtaggctatcaaaacaaaaacaaaaacaaaaacaaaaaaagacacaaaaaggaaaaaaaaaatagttgtaccttcaagatatctcttgcaggaagcctagtccatcaagaaataaaccttcatctcccgattccaaaaatcagataccagcagttctcacaatgcctctagtggtaattctgtggttttatatcaagttctctatcctccccagagactcacagaaatggcatctcagcacttttaatccattactccccattaagtccattagttacataagcctagaagataccagtataggtcagcatgtgccaaagtgtgtttccacaagcactcaacgctgctagatgctaaaacacgctctgtgaacaaaagcgcttgctgtcaaatgcttttgagagatgctagagttaaacaaagctaaagttgtttatttgctgccagatttctgggagcctttcagatgccaatgcagcctgtggcagtgcaggaaagagaccaagaatgcaacatttcccacacattcttcactagggtctcttcatcttcgaattttgctgagcatcatcacagtcaactgctctaatgaacatattttgggaaatatacaaagaagaggtcagctaggtcatgtgagaaatccatgtttcgttcattgctcacacattaaattttctgcacaaacacattattctctgtgaaattatccttcactcgtagggaaaacaacaatagaagtcctctgcatctaaatccaaagggatctgagctgttctacgcatatttactgtgttgcttaagaatgtctcatggttctttcctatggcaatctccattccattattcaaaaatacaaattaatcacattctaagcaattgttcagtttccttcatttgtatgtggttgcagtctgtaagtgaaattccttaatttcttttctcaaagaaagcttctatccatacaaaacagtccccaaacccccaaattttgggctctaatatgagttaagtagaaaggtaaatgctaatgtttcattaatcctaacgcttgaatttcaccccaacctctgcagtgttctgctctctctgaagtgcttgtttgcttttcagttccccaaatttggctctggtaaaaacaaaacaaaacaaacaaacaaacactaatgggaacagtaactgtgttttgtataatttggggccattaccagctactttatgcttcatttgcgtacttgcgtgtattagatacattttgttaagttcacctaaggatatttccctcaatgggcacaaattcatggtgcctataaggtgactttagtacagcttcatcatctacactaatatttccagcagcccctcaaaagcgagatattttcttgaaagtaaaataacaaaacttactgtatgtctgatactgcagaggccacttaaattgtctataataagtccaaggaaaggatcgttgaagttaactggccttgggaatttcaagtacacctccctttgaaataaaaccatttccaaagaacgtcatgtcaaatgcacatctccctccagaaaattgtgttttcttttcaccccacccagaacataactgaatatcattttgctgggtagggaacctccctaacctgccttaagtctcatctatttccatttaaccatagttcccagctaacactacctctttcccaagtttacctctggcaagacaaaaaggatggtctttatgaacagatggtcttttcaaggtaaagtagttacatttaaatacagataaatgtactgtaaaaaacggctttaaaagaatttaggtctttaagggggaaaatatgagagcacaagacactattctttaattacatgagatttcttttttcttcccttgaagacaaaaccaattcctaatgaagcataatgaatcgtaaagaggcaccaatgctcatcccaacagatgtttattgattggtgttgactgaacacaaacacaagggtgttgcttactattgtcagtaagtggtgggaagcagcaccagttccccctggttattttacctttcaaagacaagctgacaaatttattttgtcacgagcagctgtgttcttatttttataagggttggcttacaactaagaaagcaagcggagggaacagccttttggtgtccaatgtgttatctggcaaggacagattgttttagggtgcaatggaaaagatttttaatgaaactacatttcaaacgagcagcatatgcttgattttcccttctgctactcatcctgccatttgttaatttttgttattgttgttctccgggactcctaaattttcatacaagctgtctcgtccggcactaacacagcttggggcgaattaatgcttgggatgcaaaaacctgcacgtcccactccagccatttttttttttttcatttctaaaatttctacattcaatcagggtttaaccggtgaactagttgacggaacaagcagggattaaaaaaaaaaaattcctcctctttgtgagtccttggagccccagagccagaaaatgtgacttcagaatatgtgtggacttgtcagcagctcagctgcacacaattatggggtcagagcccagattggaggtctggagaaactctgaaattgggaattaggacaaaatttttttctttttaacaccgtaatgccacatattaatttaaatgattctctcagaatgattctgtggcccagttaaatgaagttcaaggaaatgaatttcagcctttgacactctgagtcctatttgaaagtagtcggctttacaagattaaaaacaaattacagggaatacgaaatctttgattagcaggtgctttgatagctgcaagaatattttttctcaaaaatgtgaacacacatgggagaggcaccactattattatctttgtgtggaaggccttataatgaggattccattgtgtccagagactgaggacatgaattgctatgtctgaagggtcctggttcaagaggtgatttcagtaagacacagctgatagatagaacctaaggtttcatgggttcataaactctctttttttgctaacctcccataatcaattgaagaatttaagggactcacccctttctgtaggattcccttcataactaatgggaggcagaacttttcaacagagaaagagaatgctcgacatttttcaataccatgtgcatcaaccaatgggagaaaagggtcttggaagtttagacagagtctttggtcagctctgagctcaggaagactgaagtccatgtccaggttgccccattcactcattgtatgaccttgggcaagatacgtcaattctaaggagttcagttttctcgtctatactgtgggcatttcaagggtcactgtgcagatgaaacgagttaccacagggtgtggcatacagtaaaaacaagttaaatggcaacaaaatataatcagaaattgcaccaacgtcagtgccttattccatctcatttctcccattcagttagtttccaagttataagggttcaaccccttcatgctaggccctgtgcagacatgccttgctccatcacatgttcagccttgaatggataggaatgtccactgcttggtcactgttacagaactacacatatgagatgctccatcattatgtaactcatggaccagctagcaagatggcactagtgtcctagtgaggatgggtactcagaaccaagatattagagacagaatgtgccctgttaagttcagaacatataaagtaaatactctagagtttcagactaacttgatggaatattcaagaggcttgataagccctgaatggggccttgtgagacatagggccacttaaccttggacagtaagaatattattgccagcaactcaagtgtgtctctcatgaagaactggggctacctgtgaagcttggttcactagccatccccagactattccttggcatgtttggctgggaaggtatccttggcgctcactgtagtatcatacatttcagtagctctatgggtcagggttgatattctcaccaagcctccagcctaaacctctgagggtgcctattcttcattcctccagtgtcacctgtctcacacggggccagtcagctttttcctgcaggttccatcctgccccagattctgaaccaatcaaactccctgacaagtggaatccaagtcctatgagttcacagcttaaagtcttcacagcaagtcagaccaatgcctgaccctgctctgctcctgcaagtggcttataccctagtttagctcactgagtttctcttgtcttattcagtacaggtctcagtagtactcctgttcatttgggattggttttctaccttgtctcctcgaggttctctggaaaacagaagcaaaccagtatttgctggcccctacctagtgctttcatcaaattgatctacatgttgctcttcagtcacaggctccctcacttccgtatttttgctcctgacttatctcttcctcaaccccattctcaatctcagctcctctactgataaaatccctcccagttgaataccaactcttccatgaacctcagctagacagggtgtgtctccctcctctaactcttaaagtacttggtttctcaattctggtgcttctcactgcttcccatgatggcaattactgacatgtcttctctttctggttaaactcttgactgtcttccaaatgcatcttgccttatccactcgcatttcctctaatctgtcttccatcctaaccgtatagtgacgctcttgaaacacaattctgattccctctgtttctggccttcagtcatttcctaccatattaaaaatagagacttggatcccaaacgaagcctagaaggctttagttggccccattatctttactgccttatcttgcatttttggtcttctcttgccttgtgctcccaccacaccaacctctctcttctgccacaggccctctgcacatgctgtatccctccccaacctctgtctctgccttcactgacacctattcatcccttacaacccaattcaatcatgttttaaagaagatctcttgtggtctttccaactaggccagttttccctaagatatcctaccacaaacatgtcttctttatagcataaagatgtaattttaagttttttattaatttcctgctatcccactagattgtaacctccctgatggcaagaaccatgttagattttgttcaacatttcatccccataagttctgagaatatttatataatagttgctcaattaaatatttgctgattgaagttattttgggccaaagaccaggtttcatttttcttctcagcccactgatttctggcacaaaggagaggttccataactaactgttcaccaccaatgaaaatacaggtataatgtttaaaagcttcctatttcttcttgtggtactattaagtaggaccagagcagcagtacttcacaggggtagtgtggcatcttcaagtacaatgatttgtaggggataaagaaaagaaaaaaaaaacccacaaaactagtttgtgccacatataaggaagaatatggttctcttgggcaaaaatggcattgttttcaacaactgatatggactgcctcataattgctatagccttagcaatctatactggccataaaggcaagccaaagggaactgttatgactccagagagttaccattgcctgtctattaggccaagttgtaccccaaccccaaaatgacagatgatttgctacacagtgcccaagagaaggaagaataataaaagaaaagccgtgttctcattctgtgcatagttttgcctcacttcgtacagtaagtccaggagtcttattttccaaagtaaaaatggtgaaatttgtctttaaacactgcttctaaatgtgttggttagatgcttcatttctacaattaaacacctacctactggcttcagcaccaggtatttaggccatcctggcctagttccactgactattccagtgtctataaaacaccttcaccaagcatgagaaacaaacacagactttattttctacctcatctgtcttgcatttccttgtgcttaatactgtgacatttaagtggcagtgacacaatcagcaaacctagtgaaggatgagtctatgtaaaggcaaccatgtttgcgggcagagaatatcaactttatacgtacctaaatgactgctgtgtgcacagcagccaagcccaataaatgttaaatcacaaaactcacactataagctgaaagtgcctttaggtgtgtgaattccagtttcatgttgcaaagctacctaatattctaaggttgtcgggggagatatggaaattgagtctatagtagagagaaaagttctacaccaactccagaccttatcagtggtcaatataccaacccaacaaaagcaggttgcattctaccacggctattcattacaaataattttacttatattcagtgccaatgcccagccttctctagtccctgttctagctttacttttcttcattgcactaatcgccacttaacatgtgcatattttacttatttttttgtgggccctcattcccctcaaccaaaatgcaaactaagaagacagagatttttatcagttttattcattactgtatcccaagaagctaggatacaggggattctctctgagattatttgctggcaaatgaatgagattcttggcatttgctaggcactgttcctttcgctttccatgaattagaagaaggcaacataaatgaatagccaaaagcttgggcctcagagtgagataacctaagtcccaaaccttatgaagtgtttatcttgggcaagtctcttaaactctctgtgtcccaagtggctacctctaaaagggagatgataaaaaggacactacataaaagggctactatgaaatgtaatgagattataaatatactgtaagatgctttgcatagttcctggccacacagtaactaaacaacaaatgttagccattatttttattttctttctattatttttataattattaactattaaaataaaggtaggaactattatcattctctttctacaattgacggtacaaagaatgcttctgcttgaagttgcaaaatgttacaaatggttaaaaaaacattagagaaagagagcaggagagaaggaagagtaagaagcgttacaggaagaatcaagagatactagcctagaaataaaaagactcatcctggagaacttggttaaggtgggttctgtgagcatgtgggagcctggtaggtccagaatagacacttcttatagcagatctagaactggcaacgaactgtagtaagccaaagagtgaggtaggacctaacagattggactaggaatccaacctacatgacctagatttctgattatctggctccacttcctttaccgtcacagagagtaaggtctccagttcctcccctgtactagaatgctcccagacaacctaggtgattagtgagagtttaagttctctactctgaaggacttgggttcagacacaactcaatcacttataagcttagtgaccttggactgacccttaatttcttcatttgcaaaatgaggaaactaactgcatcttatcccatagggttgccatgaagataaaatgagatggctcccaacaagtactggatgctgtctggggggtaaaggaagctttcaataatcacataaacagaagtagcattcaacctggctgagcaaatgctttagataaaatcgaagttctttctcttccctgccctgactccccagaagagaataatatatggtataagcaaatccaaaaatacccgctaaaggaagttaacaatcagcaactatcattcttaatgtcttgggcaaatcagcatacttttcaaatacaaaaaacacaaacaaacaaacaaacaaataacacctcaaataattaagtactttatgaaaataagtcaaagtttctttagaaactttgtcttaagaatcagacaaaggccagcccaccacctatgtcatggaggggtcataaggaaagagaatgaagaaagagaaaaagaaaaaggggtgaaattctaatatttaacatctccaggcacacgccccagcctctcacgcagccctacctaccacaaccaaccaccacatttgatgcttgaaatctacctaaatcaaatcgatatttgccttagcactttccaaatatctaggcttcccctagaaatacttacaagggagatgatattcagtttagactcaaaggccagttgtttcaaatgtcaagtgaaataatatctcctcctccttcatcgtgctcataaacttatacaacaaagacatcctgaccctcagaggtcagagaactcaagcaagagaacgagaatgcaagatatctccaaggttattttggaactaggcatggcttgaagacacatctaatggtgaagggcttttaattgagatgctgcacaccacctggttggggttggggtctctgggtgggtggatcaggcagtgggggacagtgaaaactggtgaaattatcttggaatgtgcttttatccatagagcttggatatacccttccttagctgatcagagagggcccgggaaccaaaagacattaagatcttagaatgcattttctactctctcattttatagatagcacaactgagtcccagataaaataaaagtgtttttcccaatatcatacatctgctgatggtcctgacttagccactaggcaagtcccccagactccagcctgcggttgcttccatctatcaaggcctcttttcaagctacttggaaggctctcctagcaaagatgactacaatttatgctcccttcacaacattttgattgatttttggtggaaaagtaggcatccctgaagcatttctttaaaataaatccagcctgccaaaccagcactgatgtacaaccctagtagaagaatccaccattggccacaataatagcaaaaagggtaatgagaaataaacgtatttaagtttacaagcctcgaagaggttatcacacacaatgacaggaatctttgtgtcaggactgaacaagtaaccctgatttaactttacattttgatagagtcagccgcgttgcagtcattgtttcgtctaacaattaaaagcggaatttgaaactattcctgtccatagttccccttaaaaaatctaaagcaaagagattctctcatgccaggattgaatgaatttataattatctatctgtagctccaggacaaaagacttaaacacaaaaaagccaaataaaccaaggacaaatttctgatagttctagttaccctgcctattaaatgatagacacattaaaagaaagagagtgatatttggaatattcagaagttggtggtccatttctcatgctttgttttagtatcactctttcttagacgaaagacagtcatgaagttgtttgtgaagactctcatcagacaagagtacagtgttaataaatgcatttagcaagcatttactatgtgccaaacactatgctatgtatgggctgtcatgtacaatctcagttcatcctcataataaacctgtgggtaagtattattgctaatttcagtttaaagaaattagcaataatacttgaggaaactgaggcctaaaacaggcaaagtaacttactccagttgcatggctaataacttgcaatttggactcaaattccaaagcctgtatgtttttactcgctaaagtttgtggtcttggccagcaaatttcaagaaggcctgtcataaagccgtgctgagagggccaccttacatgccaattacaaccttatttaaaatttaaagtacgttatttcttcctgaaatggaaaataaaccattagatatctacaatattactatgctttagagtcccaaaatcactcatgtataattagttatacccatgatgtaaatattttaaatattattaaatgccttactataaatattagaggctggaatagttaaacagccaattaactagctagtggccatctctttacctctcagcatttctactctgttatctgaaacaacccatacaagtatctaagtagaagtttagaaacaacggggctttggggagctgctgaggagggacactttgcaacctccaaaattactgcaaaactatgtgcatatgcctatccaatagtttttcagtaattttggaggtttcaaagtgtccctcctgcccagctccccaaagcccatacagaaacctatttgagaagctttcgatctaagaaatgggatctgggaccttaaaaaaaggctaaaactcaatggtctggatatttgtgagactatattccaaccagtacaccaggttactgcttcccagactctgttcttcaaaagacaatgtgtcaagtttccaaattatggggggcaagggtagtgaaaagtgagtgtgaacctaacagacaactaactgaatacttccctctgcatctggaggcttaggaattcagcagacagacataagcaaaccattctgtgaaattgttagggtgctattctttctgacattgtgttggtttcctattgaacatctgaagactgttttaacatgtgtgcctaaaaatgtcacactgaggctgagagagcacagagccaggggccacccagactttcaaatcagctctcagaagcagccagggaaattccaaccttggtcttgtggtcctcaagaactacagaagcatggcagaattttagattcacaggttgtttgtacagttagtgcatttatacctaactcctcaaagccagagatattttttataactcagcattgccctcattgctttcttatcacatattttgcatgtgtttccatctccaagattcagggaaaacaagatacttagttgggaatgtctagagtggagaccttataaaaattacttgacagacttgggagaggaaagcattttgcaaaacaccagctatgagaataaacaattttagagaatcccttggggacattttttttcctatggatcccaaaatcttttttaaatagaaacatctcaggcaggggtaagaaattattggttaagcccatttagaacgtgtacgctgtcatggaacattcctatcaatggggcacattgaaactctacactaagatatggtggggctgtggtgctttactggataaataagaaggggtttggtcgctatactcccaccctgcccataaatgagtaagcccgtgtgacaagagtacatgttttcgaaaagaaagaaactgtgaaactgagcgtcaccatcctgccacataaaaagcaacagaaatgagaattaaattcagcactttcttaatgggagactgaggaaatctgggagatgaaacagtagctcttctccagtccttcccagcataataaggtcagctgacaacactgttcgacagagaagacttaatgtgtctgacagatggcaaatacaccatattgacttttcttcctaatttaacaaatttgaatcttttgtcaattttctttccccagtgaaaagatattctaaaacaccacttaagcttacattgctcttttccccctctccctcttacacattaagtttgacactatctaaagaaactgaagctaactcactaaattaactcacctttccagctcttcatgatcatcacaaatttgggcattggcatgaatgttaattcctcatctctgccaactgtaaggcagatactcacttcaggccagaggaaggtggctgaatggacaacaaggattccttgaactcttaaaaataacacacaaaagtgtgcatctatattcttcatacttcaaaactatgtatctatgttcttcaagagtccccagttttgcccagttcctgaaggtataatgcctctggctttagctataggttgttataattagccctcattctacagtttctaaccggactttggaattttatggggtttgtctatataagatggatgggatgatagcagagaagagcttcaaactagtggagctcctggatcacaaagctgtgtaagtcatcccaagtgtgactcaagttcagcctggagaagccatggccaggccaaggatagcttgtcccacaaggaggcaaggggccgtttcccaccactgcctcatcccttccaccatgtgaggacacagggagaagatagcatctatgaaccagaaagtgggcattcaccagacaacaaagctgccagtgtcttgatcttgaacttcccagcctcaagaatgtgagaaaaaaatgttggtcgtttataagccacccagtttgtggtattaccttagagcatcccaaatgaactaaactactgttttcataatttacaatgtgtcctaaaattaattataatcctaactatgaacatgaaattctgccaatgtgaaaataacattagtttctcttgacaacctttgtagttatgttacccaaaagtatctatagacaaagcatctgaagattttagtggttattcactattataaacaacaaccacaaaaaacccaccaccaacaaaaaaaacactgggtccatggagaaataagtttgaaaaatatttcattatgcaaagtaaaatggatttattacaaaaaccttcttagagcatctcatggaaatggagtttagaagaatactatgctttagattattcctgaatccagacacattttttttaaattttaactcaaaggattaaaatttccacacttggaatgcccctgtatgaggaagaactgaacgctgtcctgtcttgtctaagtttcagagtaatccctatgtttctagctgattagctggtttcataaggcaaagggccttctgaaaatgggccattgcttctgtgacaaattcaatatccaaattctattgctgcccttgaactgtgctctctgatttcctgctgcaaaaatgtaggccatcagtggggacgtgaaaaatttgttcattacacacagattcccacagtggcagtgcctggccacattaccgaacctatagataacatcacagcacctgacatccagcccacatttcctcagcctcagagtaaagaacataccacggtgcccgcacattaacgcagagagatgcccttgataattaacagttcttatggagtctctcgaatgctaaatggtcaaatagagaagttaaacacacataaaacatttaatgtgaaatgaggcaaatatgccaaattaacctgaaatgcacacaaaagcctttcagctctggaatcgatattaatcattttctggaattcaagaaaaagtctgatgtggttaatttaaaattgtattttatgatagagaacaaaaatatcccacaggattcaaggtatcagtttacactactgccactcctttttgctgccagggtcagcaaaaagaaaaaaaaaattattgatctggtattaaaaatcagttgacttcacttctttctgaacaggtattctttgaccactaagcactggctagtcttacctctctctagtgacaacatgaagagataaatagactattcaaacagagctcttcgcgttacattagctgaataaatagtgatgtatggtctcttttctcaagcactgccttagcttgtgaagatgagagtgaggaagatggggcttatgaatcctatttgaatatttaaataaacacaaaataacatccctgaagatggttgtttaagtggaaaaagaaggtatgaaaatctgtcttttaattgtagcttttggggcaacaaaaaatcccccaagaaacttttgagattccagtgtcaagtgaaatcacagaagaaaaaaaaaattaatttgtggttttataagcagtatccagaggaaatgggatgccagtcccacagggttttcaaaggctgcaaagctagcacaaaccaattcacctaaagtgaagtatattatcaataactaactgtgatcactttttggccttccagctaagatcaagtgtaataactaactttactttgggaatatttcacaatgaatttttgccctctttaatctgctttaagatttctgtgctcaatttccggtatatgccgtacttgcagaaagggatgaagttctgagctaggttaagtgcttgtggctaactacaaatgtgttaacacaatgtaattaggtcatcaaacagcatcatgtttattaggtaccaatagataaaaaaagggagcaggcctagaccagcacatcagccccagtccctactgtcttggaactgggattctgagacatctccgtggcttctacacattactggcataattactaaatccaaagttttctatttgtaaattagagattctagcaaggaaaagatgaagtcctatgcatcgtgcattagccaggattctttttttgattttttttttcattctgttgcccaggctggagcacaatgccactatctcagctcactgcaacccccacctccctggctcaagcgatcctcccacctcagtcttccaagtagctgggactagaggcatgtgccaccatgcccagctaatatttgtattttttgtagacatggggtttggctacgttgcccaggctggcctcaaactcctgagctcaagcagtcggcccacctcagtctcccaaagtgctaggattagaggtatgtgccaccactcccagcaggtcaggactcttttggaacaaaaagaaggggtatatttattggttcacataaacacatcctcaggaatgttaaggcagaaccagtacagtcctaccttcctattggcagttttactttctatggtttcaagttgcctacaatcaactatggcctgaaaataagtgactagagtacaatattctgagagcaagaaaaagaccacaattattaactttgtactacaatatattggtatagttgtactattttattagtagtaattgatctcttactgtgtctaatttataaattaaacttcatcgtaactatgtacatataggaaaaaacagtacaaacagaatttggtaccatctgcagttttaggcatccgctggggtcttagaatgtattccctttagataaggcggactaatgtatagtcctttccctctccagtgttggcttcattctctcagaataaagatgacaacctggctgtggaaggtggcctcaggaagctcccaacctagtaatcagagaagaatgagaggattgccccattagtaccagaaaatccctatattagcaaagacagggacctgatttggtcaagtctccattcctgtattacccctgtggccaaaggggattgagtaactataattaatccagtcatgagggaggaagagttgctgcatagaccaaaaacaagagcctctacgtactgaagtgatagggcaaagaacatatatttacgaattataaccaagtctaaattgtattcgaattcctagaagatcaatgttacttaactttcctgtgaataatactcttgcctcttactaagtagcacactatccctaatattccaaggtgaaactcagtcactgagaattgggcatgctgcaccagactgttttcccagtagtagcaggagatatgctgaacctcatattctttctctttactgctttattatcattaatgccttagactgaatttctccagaactgatcatgagacaggaatctgagtacaaatggattatttgagagatgggcccaggaagcaccattaggggagaagtggaagtaagacaggggaaaaaagaaatctactacaagaaacatttataagaatattagtgcttcaagcaattggggctcaaatccactggggggggctctggaagacagcgtggaacatgctaccctctgagttttcgcacttacgacataggaagctggggaatttatcctcaaattcccactggtattggctaaacattgttcctaaagtcaataattcctgacactttaggcctacactctacaccagcaagagaaagccccagagtgcagagtaaaaggcatgtgaaatagaataaccttagcacatatgagaagggtgagtcccagagaatggaaccaaggcacacagccttggctaataccagtaacacacacttatgaaaatgtgccttcatttattcaaatacttaccaagctcctattaagtttgagttttcttctagatgatgggcatacactgagggacaaaacaaagattattgtcttatttaatacccagcacaactgggcggggcaggggcagattccaggggctacatgtcataatcctcttcacaacagcaacttcaaatgtggtccctaatcttaagagtagcagcagggtcagcagtattgggcttcaccattactaagccaggtgtgttgaggtctatgatccagtaatgaacctgaatcagaaatggaatctcagataggtattggaaaagtgggagagttcccatcgtaggacagtgagttacattttgtttaggaaactcttcagggacatcttctctgtggtggcttgtgtccagaggcactgcagagttgcctgctctaactcttgacagttgagtggggcatgcagcttctggacatggaaaggactaaagttaatttgcccatctggggattgaactggcatcagtgacttcaaatgtgccctgcagagcccaaatgatctccattacaaacacagaatgctccgccttccaaatgccacagaattccattttatctgcactggcagggtaaggcagagtatttgccaaaactccagacatagggggttatttgtaaaaccttagagtattatcaggtgttgctttcaataaaccattacacttgtatagaaagtaacaaactacgtggtctaaggaccagttatccctattccaaaaaataaagtgtaagtaagtaaagcaattttacattgaatcttgaacatctatgtacataatttagaatttgctaaaaggtaattttatctgtgctgattatctttaccatttggcatttcccatctcagggcaatgagtacaacttcacaagtccagctccgcttagctgtgagtactcaatttcactaaagacttaaacagaaaattaaaaatctgtgagaattgggatgagtcctgtctgtcttaaagcagggtgagcaaatatatgtggcacatgcccttaagagacattattaattgatcacctctcactttcacactgagcctaggctgaaccttagaatccgtcacagcgcaggtgtccactcagtcatgactggccttccagaactgggtactggaaatgaaacctacttgacacttaggatacatttatagagcctggtcccctcagtactatactcccctctcacaaacagagagagagaaaaaaaagaggaagaggagagcagagaaaggatgggggaaggaatgagaggaagaaaaaaaactctgaaccaagtatcacttcctttgcggtctgcacatgtcaaggaatactccattttaagcatattataacggcaaaaagaaaaaagcactatcaatagcggttcacactttatggctgctcaccctgaaactgtagcagctaactttcttgggaaaactcagacagactcattctttccaaaaacaaggaaagaagaaaaagaatttcccacatccttaagataactgagaagctctcagtaggagtaaactgtccaaataaaattcaacggcaccccctttggaaggatagttaagaaacaccacatgtacaaagaaggattaagattccaaatactgtcttttctccaactcgatttttccttcttgtgcccttacttctcaaacagttattccctttgctatatcacccagaagtctgtgattggatctcccttggactccaaagggctctgggtatgagaaagtagtccaaaatatatatatatatatatatatatatatatatatatatatatacacacacacacacacacacacacacacatatatacacacacacacacacacacacatatatatgtgtacatatatgtctaggatttactatagaaaatttttaaaatatttttatgtatttatatttataatatatttacatatttagttttatatatatttatataaatatatacatatatttatataaatatatacatatatttatatatatataaatatatttatataaatatataaatatatatatataaatatattttgtattatatattaaaatatatacgtatatatgtgtatatatgtataggatttactatagaaaaatatttcatatttttatatattcatatattttatattatatattaaaaatatatgtacgtatgtataggatttatatacatatatgtatatatgtataggatttactatagaaaaatattttatattttatatatattaaaaaataaaaaaataaaaatataaaatatataaaatatataaaaatataaaatatatctatatatatctatattatatatagatatgaagatataaaaaatctatatattttatatagatataaaatatataattatataaataatatagacataaaaatatatatttatatattttttctataggaaatcctatatatatttatttatttatttaggactgcttttcctgaaactctgtaaaagttttcatcatactagctatttcttgtgatgagccagatcatcattcacctggtataaatgagcttggctgtgaacacggttagaaattagagccaaggatgatctattagttcatcgtgtgtgtctcatgggacaaaagcaaatgtgtttctctaaagagttttcttgaatggtttcccaagtccaacttgaaatcacattcacaatcttgtcattttcctctttcttgcagcacaccagtaattagatgttttaacacgtcatggcaatgatatctaacatgaaggcaaactgtattaagacacagcatcacccagttttatactgtaagctcatttccaaacattatttgtttttataaatttgagcgaggctgactctttcctctctgcctttaattaataaggaaagcttaatatgcacttttttttcatcaatctggcactaaaaatcctgaattccttttgtagtaatttgaaagaagagtttggggctattaggagaaattcacattaggcatttccctacatggcctacttatgtttttcaaagtgaagggatatttcaaggaaagaaagacttggggtactagagatgtctgccccatctaaagtcttatttttctatttcctatatcaagaagccttaggtacattttagtaacatagcttgaaatatattttgaaaaggggaacaagacgtaacctgacccactacagaaaaatgcctcatgtagatccttgaatgaatttatgactgtaaaagtccctctcttttgtttcctgggtaattatttcacacatttgggaggtttatagggaatgcgtatcagcttttcaagtaaaaagtgtgagtctctgactcttcctggaaatctggaagcaacagagaatgagaaattctcaggcagcctccaaaattgagcaagagatactgcaggtcaccttcagtgctgaatattccaaagttaacttcgttaaaaatgcacaaacaacctgataaaatatctgattttaccttttaaaagtaggattaaaaatttaggaagcttcgtgacttactctcgcatctctctttgatatttctttgtttggtatttctctcacctcttatgccctggtggagtctattgttggtttatgtgtaacatgatcgaataaagcaaaattgtaaacattttctttttaaataaatagacttttacctgaacattataatcacagtatctcattcatccattcactcattcattcatccatctattcattcattcacccattcatttattcactcaggtattttctgagttctttctgtgtatctggcgctcctctaagcagtggggatacacatgtcccctgttctcatgagcttacagtctcctggtgaaggattttaatcaaatcatcacacttgtgcctaagggtttcaaactgagataaggatctcaaaataaaggagcaaacacccgaaggatcaaggacgacttccctgtgggggtggtccctgagccaagggcttcagcagaagcagaggttaagtaagtaggaagtaggacaagccctccaagataggggaatgcagttagggcctcgagcaggaggaaacaggggcaaagctctgaaagtaaaggacaggtagtatttgctgagctactctaagacagattctcccacctatgctgacagcatgcacaatttcagctcaatgaatacaaatgaatgctctaagtattttttagattctctagattatgcacattgaggagcagtttggggtagggatgatggaggtctggccattagactcaggctttaaagaggttctgggaaggggagccaatctgaagtacctggaaattggaaaaaatagatgaacagtgattttatctggcttccaatggcagataaatttcctttcgggaaaggcagatattctcatttcaagccaggctcctctgccctcactttagcatatgaggaaactgagctcttgagttcctggaaacctttgagaatatggagacagccttttcactaggtcagtttagcttcagagggaatgagatggctgacttcccccacacattaggactttcattccaaccctcggccagcacctagggaacaaagcaaggccccagctttagttctacttaaagtgagacactgcttgctctttcacactcaggttaacattcactccaacaatgagttcagaagtgaccatgggaagacaagaggctttccaaataactacctcaccatggcacagggtctctgagggctgggcatgttagagtctgagatataaaacacagtataaagaacgttctattttgcaaaacaatcacattctacaatctatacctaagtaacaggaagagagcagatctcattatgtcccttctacaagaagaacatctgcattgagttgggtgtcttcatagggagtcattctcagggaacgtgaagcttcctccccatcaccctgacctcccttcccctgtaaatttccacattgattgattgtaaacaaattgtgttcatctgcccagattccattatatcaaaaagacatactcctctccacaaatatcggagatagacagacagataaagaggattactttccagtagcaggggttcctccccactcttcctccacagagaactttatttctagtacatagtagaagaaagagtcaagagacggatgagaagacaaactcagcaaagccttatttttatgctgctgttgtttttaacctttagtgggaagtaataggagacctcatactttatgaagcctttttgtatctggtggtagtttttaaaaagaccatcagctaaaatataaatataaatttaaccatggatgattgtaatttcctgcattatatttttatgtattttcgaaaagtatctgtaatgagcgagtatcatctctgtaatcagaaaagaaactatgaaaatatccccagtgagatctgtgtttgctcacagggcactatttggcatgatgagagtgaggggaatgatctgaatgttttcagtgccaagcaccatgttggcctcaatcggtagcaattctaattctttttcctgtggatttgtatcagttgctggttcatttaaatcagctattaaaggaataaacatgaatcttaaaaatacatttagagaaagtatattgttctaaattaagcaagcagttggcatttcaaatcatatggaagcagatgaggggaacccgctctcaccagatctcaatccactttgcaaactgcttactccttaacttggctccctaattagggcattttatctttgtgagcatttaccattactgcatcatgataactcttggctagtattctgtgaagaaataattaataataatccacaccagccaaaagtagatagagcaacatgagcaaagaactaggttggtgtgatgtggctcaataaccacttggggaaaaacaatgagagggtttttattgaccaaagtggtttaacaaatgacacttaagtgatctactggcattttagaacagaggcaagactgctcactcattaagtcattttaaaaatagtcattatagagcttttgccataaatcaagaacaaaagattccaggaaataattttttataattcataaacacatagtaatgtggaaagaaggactctatagagttgaacagggttatcaattacattttccagttgtctatcctagagacaacattccttccgtgagttcaaaccttaaacatccagatgaggtattgtgggtaaacttgaggattgacacacttcagcagactaccagctccatgagatcaagggccacatctgttttatttagcgagaagcagaattaggccatgtgtgacagtgggtgttactcagcaggtgctcagtgaataatgaatggattaatgacattgtatagtagtgtctgactttgcaaacagaaaatcacagcctttgtgaatgtaaatttacacagtaaacccaataccatatagacttttagtgatattttggtatttagaaaaaagactaagatcttctccaggtagaaaggtattttgtcaagtatttgctgtgtgtgtttgacttgttttggcctgcaatgtaaatgatcctgatagacatctagttctactgggttccacagcacttctttagccagtggggtcttgtattcaacttgtatttatcacgtccttctaatttcacttgtctcaccctggctgttattataatcccaaacagacagatacattagtaccccaggcttaagtctcatcctattcattgctatcgggttattctctaggaagcatctttcttttcatcttagtcccttcttccttccttccatcagtcctgaatgctttctgagtcaaattccgagagcagaccctggctcctgaatctttttatgctcagaccctgcaactgctcaacagtcgttgtctccctgatcctcttcacacagccatatgtcggccaagatgctcaactcactactgccacctttatacctaggctcatgccagtccctttgcagagaaagagaaacacagagggagagagaaacacagagtcttgagtccctggatcaagccatacctgaagtcagaaacttcccttgaactctttaattatgtgacccaataaatcatccatttactgtagccagtttgggttttctgacacttgcaactgaaagagtctttaacgtatgcagggaagaggagatgaggaagagaggaacataaaaatgaagtaaaacgaaacagaggaagaaaacaatgaaagatttgtccaaggctgtagaactaaacagtattggataagaatatagaacatgaagcccagagcccaagactctttcccctactacttcccttcagaaattagtactattactcattgccacacattgttactttaaacctaaccaaatgagaagtgacctgccatcaagctcccgcaggtttaagacatatatttgtcctgagtaacttatattgttttcctggcgtagtacatttaagaattacttttacaattaagctgcccaaggggtctatagatgcccgttttaatttaaataaatactaatgctaaaatcaatttgtaggatatttcaattggaccgataagtacagtcttcactaaatccaaagtatttccctattagcgcatctttagaagcgtataccaacaacacatcaggattttcagaaacctgctacaaatacattactcccagagactggatcaaacagctgatgatcaaaacataaggcaaaaactagtatttcatctttgaattcggagtacctgatttctactaaatattgattagagtttttcccataagagatcctgctttgtgcctccttaattttcttggtttcaatagtgctttgtgcagagaacagcagaagtaaggcagaggatacagctgtcatctgtgccacagacattgacatgcagcttagtcacagaacagagagaacacgtgaaagtcaccatcacaccctcgcaacagtgtcagtgtaaagactcaggttccagatatgaagacaggactgaaaatgcttctggctacaatgaaatgaatctaccacacacttgccaactttattcaaactgatgatatttttctttaaacaatggatttagttattctacccgtaagaagtccaggtcgttaatgaaatgataattttctacaaactaaaaacaaacatatctcatcctactaatggttcctgcctctccaatatttcacttaggccatctcccttttctcttctggtagaacaacttcaataggtaagaaagttttcttacatccgggaaatttctttaaccaccaaaatccatggtgtttgcttttcatcttcaactcactccttggtcgttacgacatgttgcctcctatttctggttatctatgttagtttcctgctcttcctacagaattgcaaccccggaaagagaggtactgagtctcacacaccttcttcacctggagcttgtaacaacatcctacaaagcaagtaatcaacatgtgttttacagagaaaactggttatccctggactgtattaaaacagtggtatgggtactctaaaataacaccaatgtgagtgtagaatgcatttctcatttaagagaggtgttcattcagcctgaggatgggagaatttacgaaacctcaaaccccaattggcaaacagcctctctaccttcccagtttacaaaaccctacctgagagaaggtgtcttctctcaaatgaagacttccagatcctgttctccacagacaattaaatgtggtttaaaagttgctgctgggagctgaggttattacccactttctgatgaggccggcgccaccaaaaccagcctgtgggagctgatttcactaggactcccccaacattttcttgatgttggaggtgtaacggggtctcagttcctgttcaactctgcctctgactggattctaggtcttgagcaagtcactgcttccctctgaacctcagttaacctcatctttaacatggggataaaattcctggcaccatagctacctcactcaatgctggggaaaattaataatattgatagtgttaataattaaataatagctaacatgcactgagttataccatattctaggcactgtgataagtcccatacctcccttaactcttactattctcataactactctatgacaccaagcaccatcattatgtctcttttacagatgaggaaagtgaagctcagagatgttaaataacttgtccaggatcacagagctaggaagaagcagagcaatatttgaacactggcattgtgggttacaaagcattactcccagaatactgccttacaaaaataagataagccatgtgacacaaaaatcttcacaaactgcaaaatattaagccactgtaaagtactgttaccatcaatgcaaatagatgctcattacatttattgtaaaaagcaggtaaccaccaacccgtttagggaaggtgcataaacctctgtcagcaatactcaatccatctgcagagaaacaattagaactgcattagcacataatcacagaagaagttctcttgacaccatttctgccaaagaactcattcttccctggaatttgaaaaggcaaaaagaaaaaaatcccatgccgcatctgacaataggaacaaactcttcttgcagctctggtaatgcaacacttctgaaagaacaagttaaggaacgtacttccactgccctcattagctgacaacctctgtggggactgcaaaccagccacacattcaaaacaaatcccagggaagaaatcacaccacaaagcctgtttctatttgcaagtaaaatgacggccccaagtgtctttccataaagctgtgtggtaccaaatccaaagcccaaactggttacaaagggtcgccattgataagacatggcatttcaggtccacccaccatgggccaaggaggtataaagctcagaacgtgacatgcaatttttaagccctcctttcaccttgtctatgcactaagttactttgacgccacacctgtttctattctgcctggaagccctgtctgcacaacagatggcagagtgtttgcctaacaaatgttcttgtgggtcagtataagaaggtggtggtggggattgttgtgggtacgaaaggagagaggctctgctagagcagcaaagaaccatcgatctccaacttagctagggaaacttcccacccaatgagggtctgggtatgtctgagctctgaatgttctcacctctgttcatcccttctgacaatcttgtccaggatagtacaaatctgctgctgcaaccggaaattacaaagaaaatctgatgtaggcatttagaaaaaaaaaacaacagaacaaaaccttatcaaatttaaaagttaacttcaaattcaattctaactctatctccaacttagctctcttgaatctaactgaagattcaactttcttaactctaaacttaacccttgaatcccaactcctagctttcacctctcaagtgtcttaactctaacttaaagtcaaacttagtctcttgaggaggtaattaaacttcaacaactaattggaatgagttcttgtgaactgagagcttggcttatcaacacatctggtcttcagaggttaagaaaaaactcactttctgttattgtaaacttaacaccagagtaatgttttatttcagctatgatggtaatattttttaaattatgctattatccacttaaaaaatccatgatgtaaggtataaagtaacataatgctccttgatggtgaaagcacatcttaggcaccatgctttggagaaaaactgtggatctggagggaatctcctcctcccaccctaaaccacacatacctaaaccacacacagcaccgggtatacctcagtcttcaacataaagaaccaactcggcacgttccatttcatttgactcacttgcttagatagcttaggaaaccaatctgctcaacattagtaagtctgggcccattaaaaggggactgacactaaactgaaatccatttcatctcttctccagggttttcctcggactctctgatcagcctttccttcacacaggggtgaggccaaaactactatagatgaagaagaagagagtgagatgatgttctttttgagggccaggatgacactggctttgtccagtgttttcatcacagaaattgaagtgggcatgtagtaggttctcaaaaaaacaaaacaaaactggtgaataaagacgatgtgtgctaagcactaagcagagacctccccattcgtgctcttatttaatactcacaaaatcctaacagcagggggtattattattccaattttgcaaccaaggaaacacatgcaaatagctaacagtggacagcatcagatttaaatacttaaagcatgcatttcccatgagtgagagagacattttgcaaacatgggtagaatgtggctttgtgacttgcctcaagattcaccccatcaatttaggcaaaaaatacaatcttccctgactatttagttggaagataacaagtcagggaaattcagtctagcagtccatgggtaagcctcaggggaataggaggcccctgaaattaaatgcgacattttgtgtgtatgtgaatttttccatggaaaaagtctgcagctttcgaatacttgaaagattctatggtcctcccagcccacaaaatttaatgacttagctgcttttaattaaagttatgcttctaattctcatccccaaagagtccaaagggctccagacaccctttgtatgcctactgaaagaaaaatgattagcatgaaagcctggtgggtattagacatgagaatagtcaaacaccttaggtatggaaagcacccacatagatcattacttaacgaagaaaagtaattgagaatgtattccattgctagcatttgtccacaatgagattgagaagccattctattgctgaccagatggtcctgaggatagtgaaatgacagaacccctgtatcactcatcagattcactgctcttcaaaatatgaaaaagaaccaacaaaatcctcattatgacagtgcctacaaacaagatccttctgaccatttcacattctgcaaacttcatctgcaataagaatgtccagacctgaggctctatacttggtgaaaccatgctcatgttcaaaaagcatttattgagagcctactatattctaagtaccgcaataaatacttgttcctataccatctggatgccctcatgtgattctaggcaacacgtttaaaagagaacagtcaccaaatagagaaccctgagatgggaggaaccagtttgggaaagggataaaaatcatgccatgtacacagccaaaggcattgatgattctttaaagggaaagtaatacattttctttcaacttctacaaagtttctaggtagaagaagaaatagagaatcaatccaaattgccagagaagtctgaaagaggaccacaaggtaaatatttcagagaagcaaagtgttggttcacaataataaaaagaaagaaaggaaatgaaaaagcaaactattatagctggggttattcaacaatggaataagacagctggtaaaatgttagtcgttgctggaggaatttgaaatgcatttatatgttaaaagcactaaagctaaaactataaaaccaaaagatgggttagtacaagatgattgtcctaaaatacaaagaaacacacattgtcagtatgtgaaccttaaaaactaatgttggttattctgtttaaagagaagaatgtgatgttcacaaatcaacttatcacaaattacatgcttactctagtaatgtaatgaccttgggagctgactcatagtcttccttgacctaatgagcatgctgagtataatcaattaggtttgcaattaaaattgcaatttatctaacacccccctctacccccacctttttataaggctcaggagacagtggggtgataaatataagcccttctgctgtggctatcttttattttttaagcatttctattacgtataatttattaaaccttaaatttcttccctatttgtaagtttcagcaaaatttagtcaggtttcaacacagggtatcaagggataattaggacagttagcagtaatttatcatttctcagctgggttttcatgctttcgctgactgcccgtagaaatctgttagccacttctacacagatcactatgaaatctgctttatctttgtgcaaattgcttttctattttcctaaagtgagctgaaagatgagccaatcgactcctgaaaatctagccaccggtgtgcttgtcatcagagtgcagctgaggccagggccgcagatgaagggctacagtggctaatggatgatgcaatgccatgagaggcttttttccagcctgctgcgggttagaaatttaaaccaggcagcccgacttcaggttagatcttcacaaaatatgcccaggaatctatgaacatgccaatacacattttatggagcaaatattgcctagtaagccaccagagaggaaaagcctagaaaaggcagagacactagtactataccacttccactgaaaagagggattttatgaagcctgaaccaaaaagggaggacctcgtgttctttagagagattcatttactagatggtgaaaaatgaatgcttcgggtaatttcattttgaattgatttatttctaaatggggggaaactgacacttggtgaagaaagtaacaagtggttctctggaaagagccagccagtctcaggtataatccaattattccaacacaggaaataaggacacagagggaagggtggaaggtcacctgagaaagtcattccttgcaatgaataccttcctgtccccttccctacagactctcagagaagtataaactgacccatatttccagtttatttctgacacctaaacctaatcaaagtccactatttagaaatccaatagttattcgcaattagactgcacggcaaattaaatcataaatttctctatctcagccctggttgtcacattcctaaaacacaacttgcctccctccggcactttatttaaatctctgaggccgggctccaaagcaagttatggatttgataatttgctaatgtggccacagtaattgttttgagccatatttatgattttattggatcttacaacaatcaataataatccattgatgtccctgactcgggttttctcgcagtcgacaaatggggcagcagattcatttttaatgtactcacttagcactccctccctgggagagagagccctgcatattttaaaaaagggcaagaaatgaatggcactggtacacatactttactgtgaaaaactagctgcaggataagatttaatgctaaaaagaaaggagagaatagactaacagggcccattttgtgcagcaccaccatcgttaaagttaatggaattaccgtgtggtcacgcactagagggaacctattggaagttaagctcttctagggccattgattcacagactttcattcaaagattcccactagcatgtgatgagtattgcagatatgcagaggcactttagaaactgtttactcaaactgccagttaagcatattaagaaacaacaataactgaatattttagagtggatgatctagtggaacgtgtcttctgttagacatagtaaaaacttcaactccgactggcttaaacaatagaggactttattggtcacctaatttttttcaggctggagtgcagtggtgcaatttcagctcgctgcaccctctgccgcctcccaggttcaagtgattcttgtgcctcagcctcccaagtagctgggattacaggggtgtgccaccacacctggctaatttttgtagttttagtagagacagggtttcaccatgttggacaggctggtcttcaactcctgacctcaggtaatccgcccacctcagcttcccaaagtgctgggattacaggtgtgagccactgttcctggccagatcacctaatttaaatgtctggaagtaatgcaggcttcaagtctggttaattcaacaatccaataatgtcacctagtgtccagcttctttctgtctctgccatgtcagcctcagcatctgttttgctctgaggcatgttgccctagaaaatataagatggctgctagaagctgtcagttacctgctttcttgttcataagcagtagtggagaaaacagcccatccacaactaatgcatctaagtcctccatgatgatgggactccgatcctttagagtgtaggattcctaaagtcaagggaatcctacactctaaatagcttaggaaaggattaatgaaagtcattactgtggcagagacaactgacttagactgggatgggcaaattatggccctcaggccaaatttggcccaccatctgcttttacaaataaagttttattggaatacggccatgcttatttgtgacaattcattttcatatattctatggcttcttttgtgctgtaaagtcagatacataattatgacaaagaccatctggccctcacagcctaaaatgtttactatctggccttttacaaaagaagtctgccaacccctggtgtgtaccaaacaaggtctgcacctggagctaaagatgagttcaaacccatcctaattttgtggctactaaatcaagagggagggtaggaagaatgctagagggacaaccacagtgcctaagatagacatgagagaaaatccttcaagtctagaaaaatgggcttagaaactaaaaaaaaaaacaatttaggaaacctatcataagcacatgtgaaataccctctgccctgaaatacactctgagtatcatcaaaacatcaaatatatttaaaattgaattacaattccttaccacagcataagtcccagtgtaacggctccccgcccactcttcccacttctctcctgctgccactctccctacactaaatttctgccacctggtcttcaattatttcctagaatgtgccaagctcattcccactgccatttcctcttcccagaatggtctttcttctccagctcttcgctggctaggcgcctgtcgttccctgttctgggtttatgggttatctcttcagtgaccaccccatctaaagtagccataccaccccattccccttccaccatgtcattccatttcataacaccttgttttagtctttctagtattaacccaaatctgcaatattttatttgttccctttcacataaggggaagaagacaatacactgagagtttttcctaggctgtcttgccttccactttaacccagtgcctgggagcacatggcacatagtaggcactcaataaacacttattggagtaatatgttaatattaactatagaatttctacaactttttcagccttcctgcattatggtgttcatttcaaagtctgtacttgaaaacaaggactacgtctcattcttcttaggttctcagagcctgtgacgatatctggcacatagtaggtgatagaagaataaattaatgaatgaatgccagatagaaaaacatgagtaggcaggatactcatttcctggaagggaggaacagactactttggtagtgaggaaatcgagatcagagcgattcagaactggaagcagctacctcacagtgctttgagtttccaggtatagaggaagatgaaagacagacttaaatgctacaggggtgattaactgtcaagtagtggatgatgctaatgacttttaaggtcacttgctcctctgggattttcttgaattatcccgtgctctgagtttcttccttaaagagtgagattcatcgatggtcatctgatagtggagcagagcttggagtcacatttattccttccttggccaaacagtttcatcaaaattatactgctagaacctgattacgtctgggaatttataccatttacaaccaacagacgaatttaaacgcaaataaaagcccctggtgagctgtttgtcagggcaccaggatggaaagcatgataagaaaatattttgtgggggaacacgaactgatatatggaccccagagtgggagacttgaatgtgaacgttaggataaatgaattccaccacaaagtaaaagaatatttggtgtgttcactttgttaactcaatgttgtttattcttctcaaccaccctaggcagggtcaacatcttaaagaattccatcttcatttttcatgtaacgtcaggaaccaggaagacttgtttaaaagaataaactaccagggaaagaaatggaagttttcattactggaatccaataatattatctttatgttgaataagcctagaatttcaaaccactgtttgtgtgtgtttttttgtttgttgttgtttgtttgtttgtttgttgcccttccctcctgaggttttggattaatctgatggagaaggcttccgaagatatatgtctcaacttccctgattttggtgaacaagaggcttctttggagaacggatctattagacaataaggtaggatggatgcctcatgacatgggaagttaaaatttcaaaatgaccctttcccagcactaacataattgacttagaaggagggaaaggattcctcaccatgtttggcctgagggccattatagagtctcaccatcccaacatttttcactcaaatgtcctcaggaaggtcattattctaattcttccacatctgtggctctgcaggttgccttgtctattattcattaagctggtttccatctgaccctggctcagccatgaaatctttaccttttccagctgctttttgtgtcttgagacttactttattaatgactttggcataaagggtaaagagaagcgcctgaggggactgaataatttgagatgagtatcaagaaagaatcaagtccaggtcatctagaccaagaatcaaaatatatttataaaaataaacaaatgaaattgcagttgatattctgggtaaccatcagaatcaactgtggacctttcaagaagctacttcatgggccccaccctcagagattggaaaataggaggcatgagaactagctatatgctaaagataataaagcaaagagaatgaattataatagtcatttcttaatggaaagtgcttcaaatggggcccttggtttttcttttaaaatgcactttaaataatagaatcaacaaccatgtacacattacccaatttaaaaataaaacactgtaaagccgaaaccctcaggtacaattcacatcccacattgcactgcttcccctcactatctccacccagaggcagtaagaatgttatctgtgtccttccttctaagccatatatagatctacatgtttataaattatatggcagcctataagcaacctgttcttttattttattatttcctgctgttaataactactagtcaaaagtttgtagcatttggatctgtttcagctaaaaggcccaatttcaatcaaggcacacattattgtatggtctttcattccccattctgtatttaaggatgtggtgtagtctaaaacaaatggttccagagcactttaagaggccaaggcaggaggatcacttgatgtcaggagtttgagaccagcctggccaacatgatgaaacctcatctctattaaaaatacaaataatagctaggcatggtggctcgggcctgtagtcctagttactcaggagggtgaggtgggaggattatttgaacccgggaggcagaggttttaataagccgagatcacaccactgcacttcagcctgggcaacaaagcgagactctgtctcaaaaaaataaaaataaaacaaatggctcatctactgaggttgaattggccactaatatttaatcaaaagtactgaatctttctcacatgattaattgggctgcatttattttacttttttttttttttttaacagaattgacagtttggccagccaagtatttggatatcacaggtttaaaattttgaaattagaatgagctgattacatggagttagagatttttatatttgatttcctaggcttgaaacacccatagcaaaatggtgaggcagagtagtgctccttcaatgattagttattgagcactagtatcctatagcaaaatgacaacagtgagtaaccggccttactacatcaacaaaggtaagactctgactgaataataacgccttacatttaggtggtattttagggtctacaaaacacttgcctttcacaggaggtttgacttcacagtgattaagtagaaattacaggctctgagcctcaggtgtaaaagacagtttactgaatcctataaaacactgaatgtccctactatatgtgccacgtgtcggcattacaaatagcaaaataaattaaacagccaaatatccactttgctatatgtcagggcctctaattactgaggggatttgtttggtagtactaatgaaaaattaaacactaaaagcatataattctgccataaattgacatacagcaataaagcagcatttaggttaagcttcacctgtgtaataaacagggattgtcctctggatatttttagatggaaaccaacattattccaagcagagcaaaataatacagattaatatgtggtaagggtgacaaaatatttacaaaacctgtgcttgagtttcttctactgtgattacaggatacaacatatttctttaggaacagcctggtcatatgatataatgaagagttgaaattttggataggcttgggtttgaatcccaattccactatctgtcaactgtgcttttccagtatgtgattttttttctttaaacctcagtttccctaagtgtaaaatattaatgcctacttttgcaggttgttgtgaggactgaagtaagaattataaaactaatggtgaacatgtattgagactttactatgtgccaggcactattttacagggatttacatgcattaatccatttggtcctcacaacactcccaagagacaggatactcttaagacctccattttctaagtttatgaatgaatgtgggggagctcagaaaggttaactcgcccagggttcatgcacctggtaggcgacagctctgggtttgaaaccaagtagtctggccccagagtcctccctcttcatcagtatgctttaacttccctgcattttcttctcaccctcatccctgcttcaggatctctctcatctctttcaccttagctgcctttgagtttgaatgaacagggaaaaagtaaataagaacgtgaaaatactagggagcttggttaatttttctttcagtgctttgatccaaatggtatcatgcaaatcaaagttaacaaactagaaacggaaaaactcaatgatttgtatctacttaggaaagggcctgagggtttagtaggagagaggaagtttcccaaaggagacaggcaggcccccagccccttctgcctggagagctggggactgggggttttgcctcaaatcaccaggagcgggagagggaggggaagtcagagatatttacatgccagaggaaaagggcttggaacctcaacacttctctaaggcgtccactcccacatgtacacccaaacccatccccctgagcactgcagttgtctttggtttaccaacccagtcaaactggattcattctgagggcagagatgcaaattttaaggcaattatacaagataaaagctacagcatcctgaagataccaattcttcatgcaggaaatacatgcattaggtattaacatagtcagggcactgttcaccatggctgtaatgaaaggataaaagtcctatggcaaatcacatctctcttggagtgtctttccaaatgaaaataataagtaacggtaaaagaaaatcattttcatcctcaagataaggctttctctctttctgtacacatcaaatctttcctagaaattggtttgggttgagagcagcagccccctacaagtgcttcttatcactcctttaggaaagcagcttcagaaaagtgaagtgtgcatcagaatcacttgtggtgtctgttaggacagagtcctaggccccacatcagaactaccgagtcagcaaagcatggggcaggcaggcttctgtcctatggctaccttcttcaggtaactgtgaagtactctatcgatttgtaaccgcgacttactcgtgatcatctgtgcatacaccagaggctaaaaatgttcggacagagagggccagtattattttccccaattaagaaggcagatttctgaattttcaaagtgtcatttttataagttcagataagatatttaaatagcacaagtcatataatcagagtaaagttttctcaagaatttaaccaaaaggcagtcattcgtagcgagagaattcagtgtataataattaagggaatttggcagcaccacaaaccatctcaatgctagttacaaccccttaaagcctagccacaatctattttatagatgagaaactgagattgagattaacgttaagaaacatgtacgaggtccaagggccatgatgtggcagggccgggatttgaactggggtggactggtcagattctatatccatgtccaaatcctagccaatctctgctacatataccatgtactgaacatcaatacgtcagtttttctccactatcattcaatataatagatagggtttccgcattcaaaaaaaaaaaacaaggaaattgatgttcagagaggctaaaaggctgatccaaaggtgcacagttaggaagttaatatggctaatattcctaacggaacctctgatgccaaagtatgttaactactagacttaattaagagataaaatgtcctcattttcatgaatctgaaagattaccaaattttcaggtggaaaatttgttctagaaccacagaaacttctcagtgaacagaagagcttcctttttatctcatttaatttttgaattatacttctacaaataattatcttcttcttctagagcaatctaaaaagtaatttctaatatcttaaaagttattaacagctacttcccactgcgttaatactataaaattaaatttctaagtagaagattcaagtaccataaacatagaagagtgtaagcaagcataatctataaacagttcttacaagattccagattacctgcctggaataaatctgtccttaatatacctaaaaccgcctcccacccaaagatgaacataccaattgttctaaaagatagctcacatttaacttattaagcagcatcgcttctaaagaaatgaatattgccttaatggttagattagatggaattacattttggaacatgatttgagaacttgattcgtggaaattttagtcttcgttagtaacacctggaatatagaagacttttgatagagattccaggaatattgctgactgcatgctggaatacacatacatatcgtcttctacttcatgttaactaaagttagaaacttatgagattcgttccaacaagcaacaagcaaagttccattatcatcatcattctcttccccacacaaaagaggcatagaaaataaaccggagaaaaagctgtgtcatttccttacccattgcccggttcatggctcagacccctgtaacacaatacagattaacgagaggaaagcctaacgaatatatttaatataaattttatgtgccatgggagcctttagaaataaagacctaaagacaactgtgtatttttacggacagtcatgcagaagtatgattggatgataaaagagtatgacttgatggtaataaattggggaaaacttagcaaggcctgtgtgttcagattcttcttggcatgtgagtagagggcagaactcctctggaatgaaggtcttatgacctacttgcatgggtgttaggtcagagaattcttttatggcacacttgagggtagacaaatggaaaaaggtcagagagtgatgttcctgcttctgtagttttctcagtttccttcaccttaaaatactcagtatgcagagctagcatattttgggggtagcgtgtcctgagacctatcataaacaatgacaaaatccaggtcctcacaaagcttaccttctcaaagaactagagaaaagacagaggtacaggtgcatagccaaacaaacaaaagacaatgaagaatgcctcgagagaaatcaaatcatgcaccaggacagagagtaggggctttaggagagctacttcagatgaagggtcagggaggctgtttggatctgtatggttgaagatgaaagaaaaagattatttctcaagcctgcaggacatcaaactgctgcaataatcaccttgtggatggcagggttctactccttttaaacccaaaaaggagagttaataatcaattgtgaaataagaggtcacttttttactttgatatttccctttcctgactacaagtgccttactgagtaagcaaggccacgcttgttctttgcaaagcagaatttaaagcccctgaaacaaaaaaaccctacagtggtatcatgttcaagaggctaactcagtggtgcaccttcattaacgataacaacaggtgctccaggggaaaagaccattactgggcttattgctattaccactcagcatgagacaaaaatggtttagaacccagggatcaggcagaatctcaagaatgagacacagaggcaaagatgaagagaacagtcactgtgctttccatggcaggttgtcaaatgctgccttaaaatgtgcaactgtgtgaattccaaaatatgaaatgctcagaggcttgaattgtagtattcacaactggacagctgaatattaaagatgctgctttgtcccctagaggggctggctactgcaagactggcttccaggggtcataattatgtggccattgccactcaatattttatcatcatacaatactgaggctggcaaatatctatcacgggatgtgcttgttaataatgaagattcccaagccccagtcacagtattctaaataagtagatttggaataagaactgagaatcaactttttgttgttgttaactgataccaaagttaattttcatgcaggtgatacaaagatcgcattttgaaaagcagattcaacaactttagatatggatactttgtctaaaaggacagctttggaaccttcattgttctctgggattttatgtgtgtgtgtgtgtgtgtgtgtgtgtgtgtgtgtgtgtgtgtgtgtgtgtgtgtgtgtgtgtgtatggtggttttcttataaccaccatattctacaaacgagtcaagatatccccattatttcatatcaggaaacttctgtgatcaggttggaaacaactgaaagatgtgcaaaacagcataacctgctgatttaaaaaacagaatcgttttaaaaagttcaacttaagctaaataatcagggtgatgataacaataaccacattcaacaattcatatataagtactatatgttaagaattagtccatcatcatcaccatcaaaggtaacaaaaacattacacattttggccagataattgggacatcaaaaagtaattactattggagttacacaatctgtagccatagttatcagcccagctaggctcactgcttatttgttttgtgtgtgtgtgtttattatttttagtcaagagataattcaaatatgataaaattcaccattttaaaacgtacaattcagtggctttattatattcacaatgttgcacaaccatcaccactaagtccacaacgttttcattaccctaaaagaacctgtatccattaggaatcattccccattccttccttgtcccagtccctggcaaccactaatctactttctatctctattcagagcctgttgcatagcaaatattttctatcccgctttagaatggctaaatgaaattttgagatcatataacctatctattcatataagttttagctatgcttactatgcacctattatcattctgtgcatcccacttaatacagtttgtgcattcccccatgtcactagctatgcctctacagtatcgctttcaatggctgaaggaattccatcaaatagatattgcatagtgcatctaactaatccggtatagttggaatttacatttgaatactgagttttaaaaaatcttggaaccaagtttaaacatttgtgttttgcatttcaagaagtgatttcaaaaagaagccacaggtattaaatcctttctttgcatccgtatatttagagcctcacatggaggtgagacagtgggacagaggaaagctgaaagcctctgtgtctatcaccataccctgtgtgtagagcaattaggaggctagcccttttttatgataaggaatttggtagcccatatggtggcagtccctacataaactttcactgcttagaagtatttcccagagattgtattttaaaagtcccagaatagctgtgttaaagacaaaagtaaagtaagatcaaaagggaacttacgtttatttggcattgtttgtgtgggcagcaccttatccactcacagctagtcttcgaagcattaaactttatttcaacaaagtgtaacattaacatcccagcctgacttgcttctgacttctagcaccaaaaatagagccttttctatgacttaggtgcagaatctacccgtataggaattagcatttgtatgaaaagagctgaaacccagcttctgaatcagccaggattttattattttatttttactacagaagcagagactatcctaataaatcctcctttcttctcctagcacacttaaaaacccatctttgagctccactgactccattaggtttgaactttggtattaagtacacagggaggaaaagagtaggtgtgggggtgacgagaaggagaacagagagaagcacaggagaacagaaaggaagggaggcagcttgatgctactgctgcggttattgcttcactcaaaaacaatgaagcaaaagcagactatgtcaagaagcaaaggtgtgtcaaagacaccccaggcttaacatggggctgcacaaacccacaggaagctcacatgctatttcctagacactctctcacatgaaccactttgacttatgtttccggactccttgatttagtttctgttttagcgtttgcacaataataattttactactaaaagtaaatgtcttgtaaaccaatgggaaacatattgtttggcagagtttataatgtcaggatttacggctctaacactgagggtctctctgacctcgaagataacataatgaaacagcaatgtgctgcatatgactcgttgtgattttttattagttctcataatcgcctcttattaatttgtatgcacataataagcactcaccttcacagtctgtccggcttcggggccatcctagaagtaggaaaaaaccaacagaggtgagaatagatagatggtatctcctgcttattcagaaatatcacccattaataatttagatgcaatttcattgtgtgttaatttatagtattctcatggggaccattggcttcaaatgtgcgggattagacagttctccatttccgcctgagagtaagtgcgaagttatgtataaaaatgatataaattatccagcaagccaactccttgctacttttcatgctctttgctctaggctatggttttaattgcattaaaggaaggctgaaaatgtttggggaggtgaagtatcacaccttctggttatgtttagaggtggtttaattaatgtctgattactttaagcttctactcaggaaatctgctataaacataagccattaaggaagaatatggggtatttcatatgggaagagtcctctggctattctgaccttgtgggagacaaatggtagtgttcattgtagctggacccttttcccaaactggttccctttctctgtttctgaagcttagttggaaatgggcaaactcaccaagtcaccagccataatataaagcaaaagcagatactcagctggttgagatggccaaacaaagcaatggctccacaatcagaaattccaaaatagaatttcacctctgcaactttagccaggtttgtctacctctatgagcctgactaacggggtgagaactcccgccgtaaggattaagcataactgtgtatatcagggattttcaaacttagagtcacaatccattagtgggtcatgaagtcaacttaatgggttgcaatcagcattacaaacaatgtaaatcaggtgttttttttgttgttttttttttttttttttttgagaaagggtcttactcagttgtccaggccagagtatggtggcatgatggcggctcactgcacccttgacctcctggactcaagtgattctcctgcctcagcctcctgagtaactgggactacaggcatgcaccatcatgcctggctaatttttgtatttttcttagggacagggttttgccatgttgcccaagctgatctcaaactcctgagctcaagagagctgccggtcttagcctcccaaagtgctgggattacaggtgtgagccaccacacccagccagaaatcagatcttaatagaataaaaactattagactgcacagaatgagtaaacattgttttgtgaaactctggtttcctttatcaatataggcatatgcatatatttcatatatgtgtgtcaggggagacaggcatgattttgaaataaatatgtatcttactgtaggttacagtaaaaaatagtttgaccacattgcatatacgaaagtactctaggtgctaacacaagtcagctcttacatttatggaattaactttctagtgaaaaatgttccataaccagcaatggccatttcctataaatgtgatttttattcttgtatctcactaaacattaacagaggttttcattcactgccttcatttagtctctccagaaacacggtttgcaacataagcttgataaacccactctgaactgaactacctgcctgaaggggactcaaatggtttgacatacaacacatacacacaaagcatttgggggaagtttagctactcttaacacagacatggcagcaaaaaaagaaagaaaaaaatctgtttgagaagaagatgagcacttttagtcagagccttcataacctgaaaacactggctttctttatctggtctctttgaagctctatggtaaagagctaaggaggggaggaagaatggcaaacattcagtttaactaacaggctgagtacagagtcctcacattttgaaagtgtgtccttctaaagggcaattacagagtcatccaatttcagagccatgaaggactttatacattgataccccagccctttccatagagggcctgaaggagctcatggtatgttactacggatttactcaattccctactgatgactcaccatggacatccttctcccaacctgacaactgttggctcaacctctgcctaaaaatcttcagtgactggggatctgatttcttcactggtcagtgggccacacccaaccagtgaatctagcttctaactaatctgtgatcaatctctgcatcttgaattaaagacagacaaaaggtaaggcccaacctaagctgcatatcactgccaccctggaattagagcagggcttagtctatgcagtgctcaaaaattagttaccatggaatgaaaatgatttttccagtcccagttccagtaagcaatttggaatgtctgaatgtccattaaatcacttatccattactcccacctgcttggtaaacaagcctcagacatcaccttagacactatcccacggtccatcttggggccaatggacagtagggttgccctgcattagaaatctctttttttggctgctacctaaaatacaaacaatcacatctgccctcctggtaagatatcaggaggagcaagcccaatgccgggatatgaaagggaagaaaaatcatttctgagaaatctgtacactcacctgcatggaaaaggtgagagaggtcccatggaaatgtttttccaccactgtcccgactctctgggtcgtctgaaacaaatcggccacttcatcaggacgcaggtcatggaagcgctccactggccgcagcgggcacacaaggacatctgtagcaaggtctgttaaggcccatgctgctggctttgggtagtgttcttaccaagcagttcatacccacaggattgaatcctctcggaccagggcctgaactctcaaagactaaggaatgaagaaacagatatttaccatccactgaactccagagagttgaaagagagctcccatacatggataattacactttgaaggagaagctgtggtatgcagaagaatttcttgcaaaagaaagggacattcgtgtacagacagactcaagtgtatggtgagataattatgcgaggaggcaagatctattctagatcattctctcttgacccctattctaaagctgtgtccgcttcagcagccaaaggcactaggttgaaaaagcaactggaatatctacttggtttctctaggtagaacatggggataaatttttaatttaaattatctctttagagaaataagaaaattatgcaatgaacatacaaaagtagatgtttattttatttttaaaagagtatagacattctgaaaatgtacagtgaactttatccataactaagagaggtgccatgtggttaagcaatttatgacaagagttcctcagactaattttttttttagaatccaaaagaagacatttgaaggtaaatcatgaacgaaaggttgtctgtttattcaaataaagcattcttaatgcattctacaagttagacaaggcaacgtatttacactattggtctcagcaacatataagatctgagaaaaaaggatagaaatttgattacttcttgataggaaattaatattcactgttacaccatcaataacatttcagtcactatacacacatgtatgcacacatgtgtatatacacacactatatatataaatatttgtttagtttttagatactaacaagagaaacaaactcttgtacgtttttctgtttcttttttcttgttgttttaagacagcatgctcctgcctggagctaagcagctgaggggcataataaaaccataattctgcaattgctagtctcactagaatatcaaccccattccgctattggtagaactcagagcccaaggggaaacacaactgagctcagctggtcaggcctgatttccataagagagaggggaagagaaagaagaaactgattaattttgctcataatcaggaaattcatgtcaatggtaaactaggaaaagaagcatttttaaaatcagagttcatttttcaagagaggagaagggaggcgttcacccacagggcatctgatacttaaaaagataattatccatctttggcaggcccgctttattatcatgggtcaatgaaccatttagaaatgaagaatttcctttcatttcctttgagcagattgccagcctccactcccacgaagctgctttttctgtgttaaaagggacccttccccatattcctcctccctgatttgaattacaccctcacttaggcctgacttcaccaaaccacagcaagggtgacaaccatgcaagcttccaacgaagtccataagtgctatgttaggctatgttcacacacagcaactcggtgggggaggaagacatttcacttcaacaatggcttactgtgaaaactggtggaataaatcagacaacctatgtatctaatgtaaatttagtaatatcaatgacatccaaaaatgttttttttcaacaccataaaaaaacttattgtttgtcaattttgcttgtttgcatgttgctcctagaaaaacaactcagggaaagcaaattaattagaagaacagcagatagcttttgtaattctaatgccactttttatatgccaattgttttaaaataatatcacagatgcaatataatttaatttggagcctcttaggccttgttaatgggtaaattccatattatacataggctatgaagacacatttacttctggatcctgtttgcttgggattatctcctctgtcaagatttcttagccaacatgtaggataacctttaaagaattaaagttactatattgaattgaataaatgttttatccagtacatatcatgtgtgaaaacttgtggaactggttaccacttctccctataatctagagtatagagtttttttagcaataatattttttaaaggaagcgaaggtcaatagttataatttaggttgtatagctgacaaggagatttctcacagtagatgaaaaccaaaggcgacttcttagagcagatgagatttaaactggactttaaaaattggggagtgatttaaccagtggattgggctggcaacctactcactcatccatcccaacactgcagtctcctctcagtccagggtctatgctggaacttaggatgctaagatgaccaggacagagtagctgaccttgaagagttcacattctaatgtccgcaactgtcatgcagtgtaaacagatcattacaacacagagagatgaatgctattggtagaaatcagtatagaaagctgtgggagcacaggggaggtcagatctaattctgcctcagggtgttagataaacttttccatctcattttacatttcaccttttaaagtagaacaatttctccacacctagaccaaaatctgtccttaaaaatggtccagaaacttaaggttagcttcaaagaaagttgttaagcgttcctcctttggcccaaatcaccatttcacttttgtacgtactcttacttactcaatctttccaacaaacccataaactattaatactattataattcccatgttgaagatgaattataagcaataatttcttatagaaaattagaaacttgccacaccagcacactcaaaatgagattaaaactagaattcaacccgtctgtccgattctaaagttcatgttattaatgacagtgctgtgatgtcatgcttgttagagctttcatgactccatttttgcctagcctcttattaaaactgtgccctgcattccctagtcactctgttcatagaagggaaccactgttttcattaaatagaaggctatgatgcaaacatgctgaacgcttaagaaacacctaaccttggaaaaagaaagcagacgagacctacaatcccacaatgaaaggaggcctcagcactgggcagtgagtatgccttcatcctaacagagaatcgtaagatcaaaaaggggggagagtaccagcttgcctgaactggaggaagtaaagagggatacaaagctggcattttgccccttctcatcctgactttgggttgcttcaaggtgacttgggctccatcatgggccagactcctgagaaagtttagatactgcagcctctatcactgggtcaggttgtcagacacactgaatccattgcttgttggacagtctaattactgagaattatggaccttctcacaacacatgattcatatcacaagagactaccagaaacttggcaatcctttctttttgttttcccttttcgtctcctcctcttcatgctcaccaccagcccagaactgactatctctctttttgaacatgaacactttaggtgtttttgctgcattaaagtggtgtgaccacatgccaagccctatgctgaactcttgctgacacactgccaactcagaatacacacaatgaaagaaagacatattcgcattagtcaggtgcctagagctggtgtggtttgctatttgcaaatgtgaccacaagaatccctcccatcctacacatgctgttttgctctctggctttcccccactttccatcaagagttgcagtctatttcccctccccttgagtgtctatcttactttgtgtttgtgttgttataaaagaacacctgaagctgggtcgtttacaaagaaaagaggtttatctggctcacagttctgaaggctgtccaagaagcacgatgctggcttctgaatttggtggaggcctcaagatgcttccattcatggcagaagtggaagggaaaacagtttgcagagatcatatggtgagaaaggaggcaagagagacaggagggaggtgccagacccttttcaacaaccagctcttctgggaactaatagagcagtagagagctcactggttaccacaaagatgacatcaagtgattcatgaaggatctgcccccaaacacttcccattagaccctaccgccaacatcagggatcaaatttcaacatgaggtttggagggtcaaatatccaatctatagcagtgttgctgtgtgactttccaaggttaggccttaagtgaccttgaaacctctgattattgctctcttggaagcctgagaccaacatgctataaaaaatcccagctagcctgttaagtggcaacatgaagaaagaactaaggcacctcagctgatagtcagcaataactgtcagagatcatctcagaccttctagagtcaggagagccactgacttccagtttctatatcacttatctactgctgcataataaactaccccaaatcatagagccttaaaacaacattgatcggccgggcgcagtggctcacgcctgtaatcccagcactttgggaggccaaagcgcgcgaatcacctgaggtcagcagttcaagaccagcctggccaacgtggtgaaaccccatctctactaaaaatacaaaaaaaacagctgggcatggtggcgggcatctgtaatcccagctactcaggaggcagagacagaagaatcccttgaatccgggaggtggaggttgcagtgagccaaggtcacgccattgcactccagcctgggctacaagagcaaaactctgtctcaaaacaacaacaacaacaacaaaccaacattgataggttttactaccataagtctgtggatggtttttgctgagggtctcacctggactcactcatgcaactgctttcagatggaaggtaggctggagtctgggctcagctgcatccactaggcccttcactctacatgctcttccatcccaatagatgcagaatctctgaatttgcttaaggcttacattgtcccacattctatcggtcaaagaaaatcacaagccaacccagattcaaggtagagatattctgtcttctaaaaggaggagtggaaagatgacagtcaaaagggatatggacactaggaagttccagggatgtttaaaaattaacaggggcccaaggtatcttggctgtcctagtgagtaaatacaggatggcattttagagttgagatgctcctttttttttttttttttcctgagatggagtttcgctctcgttgcccaggctggagagcaatggcacaatctcagctcagtgcaacctctgcttcctgggttcaagtgattctcctgcctcagcctcccaagtagctgggaatacaggcatgcaccaccatgcccagctaattttgtatttttagtagagatggggtttctccacgttggtcaggctggtcgtaaactcccgaccttaggtgatccacctgccttcacctcccaaagtgctggggttacaggcatgagccgccgtgcccagccgagatggatcttaaacatcaactactccaataccttcactgtcagattttaaaaatagggagagaaaggttacttaacttgttcaaagtcacacagttaggagcacagttgggattggagctcaactggtgagcttccccaaccaaagctctttctgttacactgagatggcaaaacattgcacatctgccactattttccaatggtaaacttatggcagaataatcgaccacagaattctctcctttaaccaaagtgtccccaaatacttgccaatataacctctgagcagtcaacaccagtgagaatgggcacgcgacatgagatgcatgtgccatttctgtggcctcccacactgcctcatgaaacacagaaccaactgcaaaggactggtggagtcagaacaaagggggatgctgcaaaagggagaatcttcccaactacataaaatttccattatgttgccacatttttattcaaaataaatttgataagttcaaaatttgctcatcaaggataataattgattaaaaatatttttaggaggatttccatgacaaatacgaaatatttaaacatggagcactgacagataaatggaaatgtactgattcagatgattaattaaagatgacagcagaatattatgatcggagttgctcagactcgcccccatttagttttctatatctgatctattctagggattcagaatatagaagtcaccaaaataaagcaaatcatcaaaatatcactgattttgattaggctgattagcctgtgtatatattaatatgaagtaaggcagtatcagataatacaacacagaattaatcattcttctgaactaataaaaaagagtctgtattcatctcgactgcagatctgtgtgtagtttagtgataagcaaggaacattccagcttgcaatgcagacctcagcagaccctgtataattcattatttgctctaacaaacactcctaggccttgtaaatgtttaaaataattcttaatgtcacttcacaaaacaatagcaggatggactgtcagctacttttcaagaaaatattcaatttatttgatttaaatagcacaattacagagctttgagtcaaagtaggcggcatctcaaaaagtaatctattcacaacgtaagcactttgatggattttcatatcagaaaggcagaaatatcacccttaaatattaataaatacaattctgaagaagcatcttgctttgtttgggccacaccttttttcagtggggattaacatactcatttcagtaactcaataaagggttcatgggatattcatcaaccataaccataaatgacacagatgtaattttaagcaaatgtgatttccagaatatgataaattccagagcagtgtgattaagataatgataacactctgctcagagctggttctcaaggcaagcatctcacaaatatccactatctcatgttttgccctgggatatgctttgggtcagagatatgatgagaccttgttcatctggaggaagagaacccaggtatccttgtctaggcaacatgccctgagctgccctcaaaactccggtaccgatctggatgctcaaaagtaagaatcactttcatcgagagaagcaaacagttgcctttcaaagaaagtaaattgacaggggagtccgcagcccgatagcattctggtacagattctttggttgaatttcacatatttttctgtgaacttttcaatgcaaagtaatcttatactgattgagggaagagcatcatatctggaaaaaaatatgctcatataaactaagtatgtgggaaagaagtaaatgatatcattaaaggaaagaaacaatatataacatttgtttgctgcctagtatggtctagtgataatcaataaccctttgagttaggataatatcacctcccaatgtccagattcagaagttgaggccaaaaaagtttaactgcataaccaaggtcacgtagctattaagtgaaaatcccagccaggggcatgtgctacaacactgttacaatgtccatgctgtttcaatgcctctcaaggttataaaaacctccatgtataatacctactgcagtgtttactagagtgggatagcagagccctgcttccacgggatgctgttatacattatacagaaaaaaaactgtgcggtcaaagaagattgagaaacactgcatgaaatgaagtaaaatagctctctttaccgcagtattcatcagcatatttactgtactactatgcattctggcttctcaaaaataagaaatagtatgcagcactgctcaaatttgcttatctacaaaataataatgattattaattattagtaatattgtagaacactacacaggacacatgtttcagaggatgttctttggaaaccttgagcatcatttcccaaaacacagagaggcctgagtaatttttctgttttttcaaacaaaaagttgagtacatgtcctattaatcacatgggcaaagaaagagagcattctgtgaaatgaaatatgctgagaagttgagcattaaaatacatcaaatgggatatggcagtcattagtgctgtttgccaaacagttcaggttactgccatgtctgggcatatggtaggccttctggacccttgcagttgggtgaagctcaaggaatacaggtcaaagagttgtgagcgaaaatgatatacgtcacttctgggctaaagcccttaacttctagtatgtgaccgacagctttatttccttcaccaagacaggcagcaatgctttgcaatggtagctgctctggcagtgagaccccgaattataggtcagcaggggcctctgagcatcgtggtcacagtgactagggcaagtttgttcttaaataggttttacctcttttgctaaccccaaccaacttgtagtagctatttacagcagcatgttgaagaggattctgaagctctgataaggagcaggaggaaagaactgaggaatttattagttttggctgccaccagggaggaaaaaaatattagcgtgtataccaagtacctgccattcttcaattagacggcaataaaaatgttttttcaagaattctctctcccccattcttaatgatatagaagtcatttctgggacttgcaatgtctctcagtaaccgttatgaaaatctattattattgttattgtcctagagatatacagaagtgtctagaatttagataattctggttaggagagtactgaaaaggaaaattaactgtcactcgaaagagtctgtccacaatgtgtaaacatgagaatgggaacacaccaatatgaaaatgagcatgttgtaaaaatgctcttaggagttaagacttgaaggagtatggcaatagaagaaataaattgcactcagcagctgaagaaatatttaaagataactccaatgagagattattttaaacttcagatacactttgctatgagaatcatttcaaaaactctgtaaaaagctttttagtgaagtagagatgagaaagtaatactaaaaatctgcaattcattgcagatctagaaaaccacatgcaacataaataatttaatagcaccctcaccatatacacagtttcatttcaccagtatgtgaatgaggggagtgccctgagcacatacctccatagggtggctagagtgaaacctggggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactaggattcctggtgctacacacagagcttaacatagcattggcctttaataaatacttggtgaaaaaataaatgtcatgtaggcttattcattgtttaatctgggaaacaattctttctaatgaataatttcttcaaaatgctccccaaactgtgggttcttaaaagaccagtgaaccagtccagactcaacttacttaaatgtaaaccattaagaaaaatatacttcatggtaaaaaaaaaaagaattatgaattcctaatacaaatgtaacatacccagctaaagggatagaaaaataaatacaaactggtctttccttcacacatcaaaagtagtgcatgtgttttaaatggaaaacttcagaactattaactcagtgaagcttggaaaagttcaaagataacagtgttctatgctttttaataacaatgaggaaccctcttctatgacagatactaatgttaatagaaacatcctttatttcaaataaatgaaagagagtcacacttaacactaatttggcattctcacagaatatgaatcaacgtctttctctcttaaaatcagtcctccatgagctagcaacctaaaataaatgtgaagatttcgtagtgagaggtattcatcatgtgttcagtgaatgaacttctgaatgaattagtgaaagatcacaaagttgaatattagagaaaaggataaagccaaaagactttcaagaactctgtatttttttgtatattcattcagtaaatatttgtgaattaagagccgactacctggcaagtactatataagacactgaggatacagcacaaccaggtacagtcatcctctcccttccaaagatgtgaaatctagagggtgagcagacaaaggcaactgacatagtaactactgtgaaaatataaggggtgagatgagaaagaaaaggtgcaagaatgcaagggcaagaccgtaacaagccaaaccagctaaggtggctgtgaactaggcccagttcacttggtctaactggatcttcaggaaagagtgcaggcccttgatagccttggtcagcagtctgtatttattcgccatgcatggagaagccactgaagcatttcggagagtggagatgtatgacagattctgggttctctttgcaaagctgaaggccactgggaatatctttattgcagactaggtaaaagattcaaagcaggcctggcctgtggtggtggcagtagagatgcagagaatttgagatgtatgtttgaggtaggagcaacaagacttaactaatgggggcaaaaaggaagagaaggatcaaagaggattccaaggttctggcttgggtagtaggtgaagagtgatgtaattttgagatacggtgggtgggacagtgtcatgtagctcaccatttggagacttttctttcttgaatttatagaattctccagaaataactagagcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataagaaatctagatttaaatcagaagaattctttgaagattagtccccaagagaatgattagaaacaggctcagacttttgctcactttggcttagaatctaatatacccagtactaaagagtaagaaaagaagttcactctgtctgagcaatgtgccataattcacaagcatgaagcctccataaaagacaaacaaaagattttttaatgccataacaccgaagtcattttaatctgattcagcagtgaacaatttaagacatgtctcctccaacaaaggcagctggacacataaagatgattgtgtgatccattcaaaattaaagaataagctaaatcatttacaacaataaaaatgcagaaaattctaccagaaaaaaaaaaaaaaagagagagtgaaaactttcagcagcaagtgatttccaaatgtttccaaaacaggaagcaaaagacattttaatgtcactgtggcagcttccagaatagagtaagttaatcaggcagcctctaaaaacaaagcagcaattcattaaaaacaacaactgctactcagcaatgaactgtactgccagagtgtcaagaaagcaaactttttcaagatagtgatttgtatgcaaatatagctcagcatttatcactaaacctccaaggcctgtaaagggggggaaagaaaagttctttccatctgcttacacctgtctcctaataaaatcaactgccaatcacaggggaggctggggcattttaaaaacagtcaaagaaatacattcacaaatccagggtttcaaacaaaaaactcctgtctactctttcttcttcaaatctcctagcctactgtcctcttcctaaattggagttaatatctgtacctacttcattgggatgttaaaagtgttttttcaaaataatagcatatttcacaccaacaaataaaagctgaacgaatggttggtttagaaaaaaaaaaaatagtcaatggaaatgaaatccttcaaagcttccctcaatccagcaatggtaatgcggttatgtgattgaaacagtgtctcactagcaccagtgttatcgtttggaacccagatcttcattcatctcatgtttaaaatgtctgtacttttctacattccactcacccacccatctccattttctcatttgatctctgttttttatttccccctcataatgtaagcatcactggtagcagagtctaggaattaatcatcttataatcatttagtcttcctctccagttctaacttacgactttttcaaaatatggttgctaacaataaaaaaaatctcaaaatgtgaaaacaaacaatggaaaaatattgtaaatatttaaacgcatttagaatttgcaagtttttttcactctaatgtcatttttcaagctatgtttagacagcacagaacactatatggtttacctaatgtttaaattagtagatctggccaggtgtggtggctcacgcctgtaatcccagcactttgggaggccaaggtgggtgggtcacttgagatcaggagtttgagagcagtctagccaacatggtgcaatcctgtctctactaaaaatacaaaaatcagctaggcatggtggcacacacctgtaatcccagctactcggaaagctgaggcaggagaatttcttgaacccaggaagcagagcttgcagtgagccaagataacgccactgcactctagcctgggtgacagagtgagtaagactgtttcacacacagacacacacacacacacacacacacacacacacacacacacaaaattagtaaacccaataatccacaaagatctataaaaatatgaacttacaagatttctatatatttgaatttcattttgtatataactgaaaaaaaatatttaagcatgcctaaggaaaaagaaaactgtggaaacaaaacaaatgttctggcaattctgcaacagtttcacatttgtatattgttattcctcctgaagaatcctaaaattcactctcattttctttatatgcttagatattaaaaacatgtctttgacaaccaacagtcttctgtcatggggaatcagacatcggccccataatctctcattaccaacatcaccattgtcactgtctttaccatcatcacttaaaagaaaatagaaactgcttaaataaccacagctaaaataagtgtcacaagtttcttactgattaaatgctcctccgcgagactgcaacctcgaatactacgccatagagttcagattccaacacctttaatgtttctataaggaaaaaaaaccacaagcgttctccctgaaaacgtactcttaactcagaatctcttctggttccatttagtttataaaaaaaaaaaaaagaataattcagattgaaggatagtattttggattttcagtgttattgatattcctcgatccatcataatttagctaacatagatcactgcctatagagcagtgctgtctagtggaactttctatatcctatactgttcaatatagtagccactagccatatgtggctactgagcacttgaaatatggctgatgtaatcaaccatatttaattgcattttgttttaattttaattttacatttaaaaattaaatttaaactttacattttaaataccaccctgtagctagtaatcacttgtagctagtagctattacattgtacagttcatcaggagaggccacaaatttatggtaacaaggagtggtggaactggcacaactggaaaacacatgccccaaggtgggtggccaccacctagagatttttttgttcctgaagaaactagaaatttgaattgctatgtgtaattctcttctatttaacttttggcaactataggcagtccttctcatggttccaatatgcacatatttcagttactccagtttaaacaacaccaattccccaacaacacggtttaaatttcagttaccatgtcacattaactctgggtcattgggtaaagtacaagctccactactagctcttcaattcacaaattaccatgtagatcatagatgtgcatgatgatcagagaccagtcacatcacttcttccaaagtctgtcagtgactgatcactgcacatctggtattcagtcagaggcagccagcaaagtatgtagttttgtatcccactgatcttccagtgatgaacccacatatttcaccaaaatggataatcgaaagagggaactggccaagaaatatgaaacacaagtgaccaaaaacaaaaacaaaaaaccaaatgtgacaaccccagaagtgcactttgaatcaaatgtaaataaaattatagaacaaataactgactttgggaatgccaattgcgctgatgttcaggagattctagatatgtaacccaaggaatttagtaaagacaaacttattaacataaattaccaaagaatttatgatgcagaagaaaaagatgtaccagaggaagtgacatcaaaaaagtcacattttaaaaaacgtcctatttcatgacattgaaaacacaaaggatgaaatattggaaggagatccacactttaggagggattatgacaatcagccaaagcacagaaaagatgccccatctgtactgttagttgcaggataagaaaaacaaggcaagaattgttcaagagactctcaataagtgattttcaaagaaataaagcacttcaattcttagtgtttctaatgttttaaattacagtgtactaaattagtattagttcgttttttacttctttcattatatttttctatttctttatactctgataacttatagagggtttttaatgattagagaaaaacgttaaaggtcatagaacagtcatacgttttcccattgattactaagtggacattgcatggtttccgcttgcgtggtcatttttatagtcccacactgctgtataagatgaggggtacttgtacttccaatgtgttaaaaaatattgggtggggcaaataaaacatataggtaacaggccacaaatttaaaacctgtgccaagaactagtgtcatatgtgatgtgcatcttaatattaggagagagcagatgaaggaaaatcaaggactgtgactttaaaaagacatatatatgcagtctctctccagaaagagcagacccgtcgtcatatgctcctgaattctcccaccacactgcctggcaaaattaaagtcaaagttctcttttgtttcccaagtagcctgagaactgcatgttactgtctacctaaataacagaggctctctaaaagaaaatgatatttattgagaaatgggccttgtcttgggaatacatgtgccacagtaaattatgagtattcagccaggtgaaggaagacaaaggtttttaaagggcaagtgaggagaattacctaattgttttgaggtaattatccttggttactaggatcaataacattgtagcaccagaaagaggttggacaggcagttgttgggcagatgtcctcatagaagcattgtgtgtgtgtgtgtgtctgtgtgtgtgtgtgtgtgtgtgtgtgtgtgtacaaatgtgatggccttggtgcagcgtggctttttgcagagtcttttatgatagtttttgttatcaggcatttgtacatgagaacgctcccgtcatggcctttcctagctctatttgtcagggttttgtttgtgactccatttgattctgacaacttttatattatcaaacctcctgaactctgaatgcatcattaaacctggctgttagcattaaggtttccccaccaaatgttctcttgtacatcacaatatgactgaagggagattacataatgagtaacatcaataccatgcatgttctatattccatatggataatgcgcaacaagcaaaattcctgccaaaatccttattttgacacaaaaaacagaatgcagctatagctgtatgttttccttcacaatgttccactataggccctttctgtagtgcattatctgccgctggtccagaagctctttaaaaacagaggccacttatttttcatccttggatccaaagaccagcatatggagcccaggttaggacagatgtcacctcttagtagacttatcaatcccatcccatgaaggtatccctccttccttttcttcccatttgtttgtatccctcatagcttatatcaatcttgaaattttagtactcatttatgattacttgttttctattgagaatgcaaactgaaatgagggcagaaatcaggaatgtctgcttctcagctgtattctacctggatacagtatactgcccatagagcacttgctaaacactgaattggtgggtcaatggatggatggatggctgggatgcatggacggatggtagatgactgggtgggtggtttgaaaaaatgtctaagggaatgactattagaacgaatgactgttgaatgaattactgtttcattaataaataaaaataaataaataaaagctaaaactattattttagtaagtagagagtagaaaaaataactgttattttcttaatgttttataaccataaacataacattctctgggttgtcttccttttcccaagttatgtcctcagataaatctaaaaatgagaattcttccaatgggtgatctcccctggtccagtccactatttgctgaactacaagatggagaagtttcactttgcagcagcatgtgtgaaaacagcttggaaatttttgtagagaataagctcaagaagagtcaacagagaaatgttgtttctacaaaacacgttttatctcagattgtgaatgcaagtctggtgttgagttgagggaggtgatttctcactctgatcttattgacagggatagtcatggagttttctgtcaacctgggagccaccaggaacagcctatagcacattcacaaaagagatcagtatggctgaagaaaatcaaagaaaagagaaatgaggaaacaagggtcaacctttgactatagcattgcaaaggcagtcattctaggaaggaggaaagatgcaggtgaaccaactagtaaatggtagaacagaatctgaatccagcatatgacctgtggagtgactcagatctggattccaattccatttttgccactttttagccatttgactctgggcaaataaactcttatcagtaacctcacctgcaaaatggggcttatttattctcatggaactgcatttcagagtaaccaaacagcaccaatgatggacaattcttcaaagaattctagcattaaaagcaaaaggacccccaccattttaaatccctaaaaatataactgactcatgcaaaattatcaacaggtaatttggggcttaggtcaggagttcttaacctgggggtcccacagaggcttagcagagggtgcatggataaaaggaaggaaacacatgaacatgaatgaaaaaaatgacacacagttatttttactaatttttaactaaaattttgtatcttattaaatcacagatgtaggcaatgaaccactgtagtaacagcagtacctatgagttgtgtcacagtataaatcacaggtatttaaaaaatatgtaaagtaataacttgatagttattgcagttaccttgaaatatcatttattctagaagtacttatcattacaattactatcacacaattatgatggtcattatagctgctaccacttctcattatttaatatgtaataaagaaatgcataattcactgtatcacaaatttgctgttaatactgtgttaactggtattaaataacatgaatttccttggtacttctctatacttaactgtccttaattaaaatcattattgggtgggagggttgctcgaggctaggagtttcaatccagcctgggcaaagtagtgagaccccatatctaaaaaaaattagctgggcatagtggcgtgcacgtgtggtctcagctactcaggagactgagatgggaggactgcttgagcctaggagttcaaagttgcagtaagctatgatcatactactgcactccagcctaggtgaaggagcaagaccgtaccttgaaaaaaataataaaaataaaaaataaaaacattattgggggaaaaggtatacaagcgtcaccaacagccaaaaaggtgactgaaccaaaaaggttaagaactcctgctttggatgaaagtgtgacgggaaactttataatggagaaccaggctgtcactacctaaatctgctgatcaatttcaggattctaagagcaggacatccagacattatgcctccctatacactgtgatttgaagcacataatactactactacaaatgcttatatctgaaaataatccatagacccgcagctgtctaatagaactttttgcgattgtttacactatgcaacacagcagacactagctgcatttgaaatgtggctagagcaaagaagcaacctgaatttctaattttacttaagtgtataatcagccacctatagctagcatctaccctggagcccaccttagagctaacttactttacaccaaacacaagatagagaaacaagttaagtaacactaaagggaagcaaacagacaaatccgtactatagaacagtctacaggacaactgactcagttaaaaaaaaattcaatggcataacaatattggattaaaacagcactaaaacaaataataacctaatataaggtgtggatcttttttggatcctgatccaaccaagcaatgataaaaagacattttaaaacagtcaaagaacttgactactgcattaagaaattcctattaattttgtgaaatatgataatggggccaggtgcagtggctcatgcctgtaatgagcactttgagaggctgaggcggggggatcacctgaggccaggagttcaagacaagcctgaccaacatggagaaaccccgtctctactaaaaatacaaatcagccgggcgtggtggcgcatgcctgtaatctcagctactcaggaggttgaggcaggagaatcgcttgaacctgggaggcagaggctgcggtgagccaagatcgcgccattgcactccagcctaggcaacaagaacgaaactccatcccaaaaaaaaaagagagaaagaaagaaaagaaagaaagaaaaagaaatatgataataatattgccaattagggaattttcgtagtctttaaagatacatgctgatgtgtgtagagctaagaaaatacttctagcaattgccttaaaatatttcagcaaaaactcaagtggataaatgaagcaagtgtggcaaaatccgaatgacatttgaatctggttgaaggtaaacaggccatcctttgtattgtttttggtgctttttctgagtatgtctgaaacatttcaaaattaattttaaatgggataatgcattgggtacagtgaccaacacatagtaaacattcagtaaatgttaattagcaagtattagcatcatcaacattatcatttatgttctcaaaagtcaaaactaagatcaatcagtaaaaaatacaaagaggtagctttcagcttcatctaagaacaggctctgggaagatgaaaatacaccgtctcgtgagggagtagccaacagcatattcaagataacaataacagcagtgacttacatgattgagtacttataatggggcagatgtggttctaagcactttccatataacccctcactcaatcttcacaacaatttcataaggtaggtactctaactgtccctgctggagcagagattgatcacttggtgaggatgctgcagaagagggtcaaggtgaatggctttgctagttgccctttaacatccctgataaccctgaactcctctgattcaatgaacatgtcattcagatgaattgtgcaggttggccagctggctggctcacacacacatacagggcaattcttgcttttacttactgaaaggtctttaaacaccacctttccctttcaagtaggagactaaaacgtcacaggaatttaattatctgtaggcaagaagatgatatgatcaagaaaatgctacatttaaactactccatttacccactttcaaatttcccatcaattagaggggaacatcttccctaggcagccatttgaccaagaaatgtccgtggtatatcttcgtcaacatgtttcagaatataaatccagattacacaaactaaagttggtataaaggctgtcatcatatattatatcatttggaaagaaatattggtgaccttatccagtatgactgttataatggtaataaaattgaatctttgaagattacacttctggtcaaagtagtaaaatgtgaccttattctattcaacattgacatttattatattaatttacatgtaaaaaactgcattagaatgatattaaagccctggttagaaatgttagaaatgggaatgttcaagaacttcagaaataagatttcactttaccagccattcacagcattgagtttgtttgatgcaaattaaactaaatttccttcaccaatctctgattcggttctaattttattattatcactatctcattcatacaggagatatttttcccaatgcctctttaaacattttataaaccttaactcattttcatcatgctctggataaaaagataacacagagcactgaatatataaacctgagtcagaggatcaagccatctgcttatgacggggagagtctcctcagcccagtaaaaatgagcttagcgatgagtatacatcagatagtgcactaggtcctagaaggataccaaggtccagaggtgagaaaagagagtcagaccgccacgtgggtttcacagaatggccaccatgcagcaaaaagatcgctcttgttgcccaggctggagtgcaatggcacagtctctgctcactgcaacccctgcctcctgggttcaagcaattttcctgcctcagcctcccgagtagctgggattacaggtgcctgccaccatgcccagctaattttttgtatttttagtagagaagaggtttcaccttgttggccaggctagtctcgaactccttgccttggcctcccaaagtgttgggattacaggcgtgagccaccacacccagccaaaaacatttttttatactggtcaaaattttatagggaggtccctcccttaaatataagttttgcaaactttcagtttgggggtagaacatggaatcatgcaatgaattaaggacaagattcagccacacctcaacagattattctattttcaccattagcccaaagtccaggcttgctaggatgggtcccaactgtccttccaattttgtttctcactattctcgccagcacttcaaggttccaaccaaaattaactttttgctatgtatttcctcatatgccttagttaatattgtcttctactctgaatatcttttgactttctatcaataggttaagctaggtgttgctatgataacaagcagtcccagcatttcagaagcttgtaacaaaaaaggtttacttcttgcctgctatttgtccatggtgggccagcagatcagctctgcccatctctggcactctgatatccaggctaagagagcaaaaaccagctcaaatactgttaggaaccatcccaaggggaagagaaaactgcagggtcttacaccagaagttaggtgcttagtccaaagtgacacaattcactgccataactagtcatgtggttccaccaaaccacaagaagcataatgctaccatacacctggaagaaagaagaactaaaaatatttggtcaataccatcaatgactccctatctccatgtgtcccaaatctgataatttttccagatctaagttagattccacctcctcctaaaagaaaaccacagtccttcctgctaaaaggaaaccgttcatatggttaatatacagagcatgttattttacctcataagactctcatgactctctgagaaccgtgtctctattggaattccgtgtttcccataatgccttgctagataaatactgcttgaatgattgaacaaggctgtctgtataatgagagtttcatctccaaagacttcgaataccctggaggctagtaatacgtggtaagcaataaaactttattttttcttatttatatcataaagatacttaaaacaatattaaaatgatcataaagatgaaataaaaatgagcccatagtcccgccaccctaaaccaacaaatgttttcatttcttttcctcctggtcctattcaaagggcatccatttcctttacatagctgtattcagggtgcatacaaagagagaattctaaatagaacagaagtaactgcccagtcaacaggttttgtttgtttgtttgtttgtttttgctcttccccaagatagagacacattgggccatatcctaatactgagacttattttctgcaataaaatttccgttaatttaaagcttctaagctgtttaatacagtcaccatcattaggaaatatcagtgtagtcttcaccactacttcctctccttggctcaacactggaagaaattgcctctagtgaaaggagattgacttccaacatgagaagaaggaagaaaaggagaagtgtgtgctaaatcttggacagttctggggaacatcgtagaccaacgtcaccttgtcacggtccgacgttaagacatcattaacaagagctaacaaccaacattgaagttttaacctcattcgtgaatttatctgattattattttgctccatttagctcatccaattcttttcattttatcatgcactctttttatttgtgtagtctgagttgaaccttttctaaaacaaggtagaaaatacatacataatgcttcaaaaaaatgttttccatactgccaaataggcactaggaagtctcaccagagttgataaacaatctagatggccatttaacccactcagcttacttaaaaccaagtctttcttttttttttttttttgagacggagtcttgctctgtcgcccgagtgcagtggcgaaatcttggctcactgcaacctccgcctcccaggttcaagcaattctcatgcttcagcctcctgagtagctgggactacaggcacgcaccaccgcactggctaatttttgtatttttagtagagacagggtttcaccatgatggccagcctggtctcgaactcctaacctcaggtgatccgcccgacttggcctctcaaagtgctgggattacaggcatgagccactgcacccggcctaaaaccaagtaagtcttaaaatttgtactcagaactactttttttttttgagatggagtcttgctctgtcacccaggctggagtgcagtgacatgatctcggctcactgcaacctctgcctcccgggttcaagcaattctcccgcctcagcctcccaagtagctgggactacaggtgcatactgccatgcccggctaattttttgtattttagtagagacagggtttcattgtattgcccaggctggtcttgaactcctgagctcaggcaatctgcccgcctcggcctcccaaagtgttgggattacaggtgtgaggcactgtaccttgcctcagagctacttctatactgagaataaataaacacccaaacacctttcaatgttattaaatttcagagtaatgactttttgtctattttctattttaatagctgatagattagtaggttttcaagctatattttaaaattttatgttcagtttcctaaccactgccacatgtacacataatttatactcttacatttttgaaagggtttattattttatgtgctatagttattgatctgaatcaaatctttcttacttgattcaacagactatagtgggaataaaatgtgactatttacgaatgttaaccactgctgtaattcatatgaaatctgccaagcctattatattaggaataatgttatatattttatctaagagtctgataacacctacctcaagtctaaatattctctgaaaaatttgtcagaataaaacaagtgcccttaaataatattttcaggtataactgcagacagttgcttgtacgtttgtctttaactttaatactgtctcaatatgcatgaaacgcttgatagttcaatagttgttttcatgagttgtgccttcattaaggtacaaaacattaaacacctggaatgctgctcgaactattcctaagggagaaattttggtgacaaatgaaagggatacatttttaagctgaaaaagttgctcgctactgataaaagaatttatatcagaatattccaatagagcagaagaaagcaacatgaaaagaaaattaacattcattaagaaacagctaccatggtgcgaaacaaagatcacaaagccaaaactgaacaacaatcaaatttctacacaaaaaataagacacatacaatgcctacagttccgattgtctaatgctgtgtaacaaactaccctaaaactaagtgacttaaataacggtcattatgtactgcctcttatggtttctggagggggtggtcaggaattttggatcatctcagtcagaaggtctggctctgaactttcatgacactccagtcataccgtggctgagactagggccatctcagtggcttctatatgtatgcctgaaacctaagctaggatttgaatagttaggggcatccctctctggctccttaaggtgtttccatgtgctctctcccatacggtggcttcaaggtagccagacttatcatatattgccttgaggttcccaagacatatatctcaagctagaaagaaaaccaagaaaagccaaagttcctttaaggacctagtcttaaaactcatttggccttacttctcccatcatctgagcagctccacttttatctgtttcatacatggggctttggcataagagcatgttgaccaaaggctgtcaaagtaaccaaacataaaaagtttaaaagctagtggctgggatgaagtctaatgccccaaacttcaacaaagctaggtgatggaaaaatactgctgaggggaaggctgcttaggtgatgggcaagagagtccttggagaatgcagataatcaaaacagcacctaattaaggtacagataattgagagctggattatcactaagattgtatgtataaagatgcactaaatatcttattttcaatttctcttatttttctatactgttataatagaaataatgtaataacagcaaaagcaaaaaatagtcctataaagtgttcacatggtgaattcaatactttcacactgggaagatgatggtggaagatagtatctcaggcagtgcagtccaatggaagatcttagaaccaaatgtattgagttgaaaacattaatgctgtcatttctgagccatcttaactttggcaaagtaattaacctgtcagagtctaaatgtcctcatctgtgaaatggaagaaattatgagttcacaaatttacactgaagagtcactgatccaccattctttaattcagtcataaaatatttatggagagccaaatatatgccaggtatgatatggtatggaaatacaataatgagccaaatgcctacaataatcaatcaccaaacaaatgtttatcttaagatgacacccataaacatgtccaacaaagatagtgtcaaaaaattgatgtcacctaatgaataatttccttctttctttttatttatttatttatttttttgagacagagtcttgctctgtctccaggctggagtacaatgatgtgatctcggctcactgcaacctccgcctcccaggctcaagcaattctcctgcttcagcctcccgagtagctgggattacaggcatgtaccaccatgcccagctaatttttctatttttagtagagacggggtttcaccatgttggtcaggatggtctcgatctcttgacctggtgatccacccacctcggcctcccaaagtgctgggattacaggcatgagccaccgcgcctggcctttccttctttcttgaccttcctttcttcataccataactcagtgataattagtagggggtgaaacagagccataatacattcatttgtgaatctcccctgtcctcctcacacttaccttttctctattcccttctcccaagcctggttctggctctctcatgcttcagaatctgtgaaattggttcggagggcttcaagagaactgcggaggctaagcctgtatcataaagatttaggactaggggagaggaagcgaacacaaagaaaagttggaccatgtaagaactagaaggagagactggggagctggtcctggagtgactccagggcaccaacatgtaggggagaaatactgctgaggggaatgacatgatttctgtttctttgagagattcaagactggatttccttttaattaacatggggtggctgatctatacttcttgaaggcaactctaggtgggggtaaaccacctggggcctcaagatttattaggacctcacaatagcaaacctgttgctcccctaaaagctagaaaggggggtttacaaaggagataaaccacaggtgtcagatatgtatccaaaacatctctctgaaggacttttctcaataaaaaaaagctactgatgcatttaaaattaagtaataaaacaagaagtacctgtgcatgaaatatttttacatctcccacctccaaccctgaagccatcctattagcaacctaccctatgatcctgacatgacccgacagaaggagacttgcagatccaactgctcctcagactctcacttgcacagggggcattttcaacatgtccagggagcatttgctgccttgataatgacctttgaggagaggaaaccaactcagaagtaccttcatcctccttttagtttgtcttttatgtttttttcttgagccaatgacttctttcagacagcaataatttacacttcaggaaaatgtcaaagtatagcaatgccctgaataataattaccgccaaggttggaatgaagcctttcgaagaaatgctaagttaattagccacacacttgtttaccattaggccagtggagaaaacaaggagcacaggatcagaacatgcctgcaacatatggtctttattaatggcggcatctcaattagtctatgggaccccacttctgtcaacccagagatgatctgaataaagaaggagaagaaatgttcacaaagctgtcatggggagaagatgctacctgagaccactcaggacacccacaaaagaaacttggatttctgttgttttctgtcataccttcatacatgaaattgcctcttttaatctttccacaatgcatttgttttgggacaaaggtcaagagaagggcagattaggaaataaggaggtttacccattattaccaaaaatctatttaaaaaatcatgtttccatgaatatctcaatttatcccttctaattcttattctcatttctgaaatatatactttgtttagctttttggaaaaatccacattttaaagaagtatacaataaaaaaataatactccttatttacatgcttctgcaatcatggccgcctttccacagaacactctcagacgaaggcccttttgtgccggcctacttagatgttaccaaaggtgtacaaaaacgcatctcttgcagatggctggaagatagctctgagctctttgtgttcaatcaatcccccaggaaaaggcattagaaatttattagaagcagctccctgttctcctcagtttctgagcttggaaaaagcacactacactgaaaaagcattttgaatggaaaatgtaacctgaagtatcttacttttttctttcctccatagtcctaccatcgatatatcctttgtaggactctattagtttgctaggacgagcataacaaaataccaagtaccacaaactggctggcttagaaaagagacatgtacgatcccacagttctgaggacaggggcctaaaccaatgggtcaccagggttggttccttctgaggactgtgaaggaggatgtgttccaggactctctccttggcttgtggatggctgtcttcttgatggatttcctcacactgtcttccctctttgcttgtctgttgctatgtctaaatttccctttctttaagaatacaagtcatattgcactagggcccaccccagtgacctcatcttaacctgattacctctgtaaaggccgtctccagatacactcacattcagaggcactagggattaggacttcaacttatctttctttgcaagggatacaattcaacccataacagagatgagtaaaaaaaaaagatattaatgttcaaaaaattaagtaaccaaacataaaaactttaaaagctagtggctgggataatgtctaatgccccaaagtggaaaggtaccattgtcacatatttcaaagaggaaaggtaccattgccacctatttccctggctgtttgttaccttgatgaagtgtctactgtggcaaggcattatgcatggcactgggcaacagagggaaaaaaacatggagcctctatgctcatgaatttaccctctccttttatgccagccttttcaacctgggggaaagtggactggctagagtactaatcaagctgtgaaggactttgggcttctacttcattctcccttgcattgacagctggacagttaaaagcagcaacaccaacagctgcacagcacccaactcatcaacccacaacaacggtgacatcacctaagttagcatggaagtggccagtctgcttttgccaattctttgggacattaaacccatgataatacttttaatataattctgtgtgaaccaataatgatgacaaactattcttcttgcctggttggagataataagtaacaatacctcctattttctacgaactgtactttttttctagcaccgtgccaggcacttaccatgataattttatgccattttcacaaggtgagactgatattactagctccattttacagatggagagattacatgtcttgctaaagctaccagctaatacagagtaaaggttaaatctgaaatcaaggtgtctagaaaatcaaccccatgctcttgagccttacacaatagtgtctctttcaaccttttgaacctgagcacttatgacaactgcccagtatatgtgtacacatattctgtgcatgttatagatagacagatagatagatagataaaatatctattttctccccccaaaatctatgactaatgcaataaacctcccactgattagacagttatggctttttctcacatctccatcagtgacataacatattaagcaaaaaagtccgacccagctgattagtatttgatgtgctgaagagcctaatgtttctttatatgaaacatcagacagtggcagcctacttaattactaggttgactttatgtcttcaaaataataaaacagaataatccaaacgacaggccaacgtggtgagtgatatttgaacatctactcgaccctaaaactgttaaagcaaaagtacttatccaaaatccaatactttccatttttcttttaaatgttgtaagtcaaaaccagctaaattgattttttgcctttgacttctgctgaaaagttcattcctaagcagattacatgtgtggctttgcagctcagaggaaattttacagccaagtaaaaccctaaaatcaggaaaacatgggtttgctgaatacagtagaaagacgtgacagatcttaattataaaagaacaaatatatcttgatagatgaactgtcttttgtgaattaagactcaaaagttttaactccttgattaaccgttacccattagtaatatagaaagttgtgaggcaacgtcttcaaacttctaagtagaacagagcactcccaaagcatgcagaaccccctgtaacatcactcaacgcattttcagcatgagtgcccagggtaagccttcctcacaatgttgcaaagcaaatcgtgtccctcattcccttttctactcccagcactccttggttaagtgttttaacagggtaagtgatgacggtacaggaagagaagaaggaagaggaggagaaagaacaacaatgatatcatggtaaaggcctgtagaaattgatctaccagacaaaactcaagagctcatatgatacaggattttgcttgcacatggtcacaattaaataaatgatgaaaatgagactcaaatatagattgtatacctcattccactgttacaagctttcttctaaatgaggaatcatcaaaaccaaacagaagtgtctatcttaggtcaccttaccctcttttctgattgttgaaattaaggcagtgcaagaaacctggggagacactggaaagtgtccccatgccaagccctgtgagcacaatgagctcatgaaagaaaagcccagagccaacaactaataatcgtgcttaaaactcatcatttaagaatttcaaaataaacactgatcaattgaagttattttgacccaaagtcttacgtaccttcttttgcttgtccatattggccatcataaaaaacagcaaaaaaaagaaagaaagaaacaaagatggggagttgttgcttaatgggtatacagtttcagtttcgtaagatgagtgagttctgaagatctgttgcacagtaatgtgagtatgtttaacactacagaactgtacacttaaaatggttaaaatgatgtattattccattaacttaaaatggttaaaatgatgtattattctcaggtatgataaagacatacctgagactgggcaatttacaaaagaaagaggtttaatggacttacagttccacatggctggggaggcctcacaatcatggcagaagacaaggaggagcaagtcacttcttacatggatggcagcaggcaaagagagagtttgtgcagggaaactcccccttacaaaaccatcagatcttatgagactcacccaccatcatgagaacagcttgggaaagacctgcccccatgattcaattacctcccactgtatccctcccacaacacgtgagatttgggtggggacacagccaaacaatatcaaatgataaattttatgtttttttaatggaaaataaaatttaaaagaaggaaaaagaattctctccccttccctctctccctacctccctaccttgctttctcccctccagggaagacatgtgcctccaggatggaaacaaatggattgatctggaaaatacttaggaggcagaactgaaaaaatttgaatgtgaggatgagaaacagggagatcatgggtgatttccaagtctctggatcaactgaaatggagaatggataaggaggaacacctggaggagagcacgcttggaaaggcatggtgagtttcatctaactagagatcaccagcaggagtctgccctgtccatctggagcccaggaaggagggttagggtggagattctgtacatttctacagccaactctaatttttggttacaatcaaagcctatgcccttctaaaacctttttcttccatcactaatgatcagctgtgtttccagaagtatgaatggatttatcctatatttctgcctaatatttcatatatgaatacttctaggcaggcattgggtcatatgtgtaaaacgaaagcaagtacttaacacaatagaccattcaataaagctgcttttcacatgcttcatttactactttccattgcctttttcgcaagcaattaccatctcacacatgcccagtttcaccattctgcagaaccaaatgttgaatttaggcaaacatagggtgttcaataaacaggtggattttgaacagaacaccaatgaattcaggaagcacggtcaaccagctgcgtctgtcaatggaataatcagtagctggctgcatctgtgctggctgggctgccatcggtgtttacaagctggaattgaagagggctcggccagctgacagcagaagtttgcgcagcacctgtctaaagtatatatgactgcctccaggcaatcccattagttctccactttcatggacactaggacttgttcacaaatttagggggaaaaataaaaaagacaaacagagctagcctctgactgagaaaggacacctgaaagagaaacaatcccatatggagaaacagaacaagggggtgagaatgagaaagacaagaaatcactcaagaaagccagtaatgtttacagatagtagaaaaattttgtctgtaaacagtgggcttggtagcatttttttaaatcagagatgttctggagaaatatgtaaagaactcagcccaagctttctgatgccaggcagggcataagtagtttacatggaaccttctgacttgtttatctgacatagtaaacagctttctctgatcccactgtcccttttacgcattacaagataacaaaaagttatgcgattttaggaaatcaagtatataaacagggctattctcagcacatccactgaatattaagtgcccacttttatctgctagaacttgatgtgtgaaggtaaccaacttaaatgcactgaagagattgcattcacacagtgaatagtgacattttgctaggaatttgttaaattttataatgcaagcatactgccgtaatgttccacaaaacgtaacagtcggtgcacagcaatactgccctctggtttgtgagggctatttccatcctcaattcattctagcaggaaaaagaaattaaagatatgatagaatgctatccacattgttataatgctggttctttctgaggttagtggtcacacacagtgctatagaggcggttgttctttcttgtgcctgtaactgctgaggttaatctctcagtgcttccaaatgcatatggacatttacacatatggacactgaccaatcctaaaagaaaactcaggataaatcatgttcaacttcaaaagtccagcagctaattcaaagccatgctcttgtagaaggagccattgaaaacaacagagaaaccagacaacagtctttaacgtcttatctttgtttatgattcttaagaccacacctggcgtgaaccgatatgctaggtcaccctggttcctcaggtgcattaggcatatgtgagcagtgaaactatgacaaccagaatgcaacatccaattataatgattagaataacaacaaacacttaggcaataattatttccattcattcacttcatctccccaataactctacgaggtaagtacaattattattccccacttcatggaccactcagtgccatactaagagtcccagagccagtaacgagcagactagatttaagatcaaccccatctgacttaggggttctgctcttactgttgttctgtacctaaagctatctgatgtattttaaaatgtaggtgtatcagtttggtggggttgccataaccgtgagttgggtggcttaaacagcagaaatttttcttacagttctagaaactgaaagtccaagatcaaggcatgggcaggtttggtttctcctgaggcctctctctccccttggcttgcagatggtcttcaccgtgtgtgcaccttcctggtatgcctttgtgtgtcctaatctcctccacgtataagaacatcagccagaccagattgggacccaccgtaatggtttcattttaagttctctctttctttgttttcttcttttgagacagagtctcactctgctgtccaggctggagtgcagtggcgtgatctcagatcactgcaccttctgcctcctgggttcaagctattctcctgcctcagcctcccgagtagctgggactacggacatgtgccaccacgcttccctaattttttgtatttttagtagagatggggtttcactatgttagccaggatgggctcgatctcctgacctcgtgatccacctgcctcggcctcccagagtgctgggattacaggcgtgagtctctacgaccggccttaagttctcttttcaaaggccttagctacaaatgcggtcacattctgaggtactgtgggttagggcttcggtgtgaatttttggggaaaccacaacgcaccccataacagcaggtgtgttaacgttctacaaaacgcaacggtgggtgaattgtaggacttccctctgctttatgagggcttaattgtatagggccttattttggatctttccacattcaacaagttctgagaatgtgatacttggaaaccatgttcatcagaagagtgaaaggctttcaggtaaacgtcctttgatctttttcaccgtgatgccctccgatgacattaactgtggtagtaaccagcatcattcagttgctgttttagaaggaacttaaaaatggaagatttgaaaacatgattgtgaaaccataattttgcactgagtccagtattaacagtttttcaacagagttaactcttgctgctttttgttttaaccctgagtgtctagaactgagttgggcaagctccttaacccacagcacaccagcagcctagaactctccaagatgtcacttggattttccttctgacctgcctttcctgatcccttgctacctcaccctatagacataggcttacttttccctaatattttcctgtactttaacgcatagctgtgtttttatgaaaaataaaatactggggttttatgctcaacttatttaaatgatatttcactacaaattatgttcttcttctatttgtttacatcattatgcttttgaaaaccaccagaatatgtatgtgtacctctggatctaagctgttaaacatagtagccactagccacatgcagctaccgggcatttgaaatacggctcatgcaagtggaaaactaaatttgtaattttaatttatctttaatttaaatttgaaaacctgtatcttaattatgagaatacttttaaatatttttggaatatcttgatgaatcttcttttttcagttgtacattttataaaacttaaatatgaatcaatcagttccaatgaaaatttagcctctgatttaagatgtactataaaatacacatcagatactgaaaatagtacaaaataggaatgtaaaacatatcagtaagttttatgttgatgatatactgaaatactactttacatatattaaataaaatacagcattaacatgatcacctaattctttaaatttaaaaaagtaaaaataaattttcttggtacttttttgtgtggctactaaaaatctttaaattacacatgtggttcacattatacttctaccagacaggggtgatctaggttttaattcctctaactactacaagtattctataataagcataaataataattttacttcattctcttatcagcaggcaaatagattgtttctaattctttaccatatcaaacaaccctccaaattcctgtttttatgcatcctcactaatacttattatgatctttcttgttgcttttggtcaacttggtggttatagagcagtgtttcttatttaaatattcatgtctcagaatactgaaagtgtacatattagccattcaaagttcccctttcgtaaactgcccatttatatctttgcttattaaaaattttgaattcacatcttttatttaccaattagtagaagtaaaaagatatattcccagtataaatctcttgtccactgttagacgtaatttttcagctattatacgtatctccaatattttcttagcttgtactttgttcatttttcccatagtttatttcattgaacacaaatctttaattataattaaattccttaaattttacctttattatttcaagaaattctaccctagtaagaaattgtgaagaaatttcatcttttctactcttggtttatagtttcgccttccatatttggatcttcagtccatcatgaagccctatagcacttagagcagcagatggttgccaacatcctaggcttaggtacttgccatttgagaatctgaacaaaactgaagactttcttactgaaagaatgtatgtgcataaaatactatatatataatttcaggctgttcccagacctctactgcaagccctttcatgtatccttatgcagtccacagaatccaggcgcaggatccccgagtctcacagattctactctctattcaaaaacttcattgtatttttcatggctttgctcaccatctttttctgggttatctcatattctcaactagtttatgagctccttacggacagagacctagatccaggcatctccaagatttttcatggcacctgagagctgggagtgctcaataaatacgccccttagcaagtgatattccagaaatcagactcagagaagagaatgtggtgtaaggcccaggggattactctaaagaggcctccattaattcatgcattcaatcaacagtcattgagcttgtccactgtttcaggtcctgggctacatggaagataatcaagggaaaggccacagtttgtgtcctcagagggttcctattctagaggggacagcaaaggagaagtaattataacacggggcatcaatgctctgctaaagtaaggaagtagggagcttctggtctgcataacaggagggtacctaatggggcctttgaggtaggggaaggttgggcctctcagcaggagtcatgtttaggcggagactcacaaaaatgcatagtgttaaaaaaattaaatttagcctgaggctgtctccgtaatttgagtccctacctaaggaactgcagcctaacctaacttagtctattaaacacaccgaaagcctaatttaggatgctttttttttttttttttgtaacagcagctgagcttcagccaatcacaggctgccaactgatcagaccatgaccaaataaggtgaacacctagacataacttaaggaggaggcaggatttgactgaggaggcagggctcggacaccagatcaaatcaaagactacctagaacagggacagagtggaagtacatttccgtaagatatgcccaccactggtgccatgccactttatctctccagcacttaatagattctacctgaacccctcaccctcaactgctattaactgaacctggaaatctgagtatctatatctgtagtgcattaatgattctatattttgcacccactgtgtattaatgacacaaaagtggaggtttcccttcaatgctttgatccaactctaagctgccaagtccccaaggctgtaacagtgtatacaggattctacttgtgagcaaggaaacaaaccatatatggtgacttctctcagataacaacatacaggaaaaaaataaaacaaacaaacaaaacaactgcctaatctgggaaggtaggagtactgacccactctgtgaaacaaagattggttgggtatctccattggaacagggcaagaatatctctacagacccaatttggcagcaatggatagatatcagatgttgtggagcctctatttgcaccccaactggactaatttttgtttgtggccattaatggggaaaagtcataccccatattcactcttgactaccccatgagccacttgtttttaggagtggctttcccttgtatataaaaaacttggaacagaggtgaatgtaggatggccactcttgcttctctaggggtcacagtctataatcccataagaaccaagaacaccagaaataaacaagcaacagcattaattctagcaggaatcagagcagcaatagaacgagtggcatcctggggcagctttgcctatcacgagtacaccctgaaaaactagactcaaactctagaatccctagccaccaacacaggtcatgtactaaagggaatcctagagtccttagaatctttggcaaatgtacttcttggtaactcattctgagggctgcccgattagttgactgctctttggtcaaactctgttaaattaaacttgtctacagtttttcttttaccagtaggcagctcatctgaaaacagtaggagggaaaagagggaatcctagaaatcgatctgtcataaacattgtgaactggctagagtgctcctgccttttcctgggaatcagaaagtagcagccagacaggaaaccaaaccacctgatcttttacaaacaggaatcagatcactgtactgccacatttaaagccaccaggggcatcccatctaggatgggatgggaaaaagtatgtctaaaatatatatacatagtgtatataaatatatattatatataatataaatagtatataaaatatataagtatatattacacatataattttttcttagtataagtatgtcccgcgtaatatttgcaatgtaacttacactaacaaagtatgtgttatttatcagaaagtcaaatttatggcagttaaacctgccagcccaaagcacttaaaatataaaattacacttaaaatagagtcttcagtattatattttctctggctttcatcttagtgtgagctctgcattgttccccatgcttcaggcatgctgaccagtgagaatgagaataagaatgccaagctccatcccatcttagcaccttggcttctgtatcttctttccatttagaatgtgttttccctctttcttagcgtggttggtttcttctcttctttcaaataccagtttagatgtcacctccatagagaggccttccctaaccacaccacctaaagtaggctatcccaattattttctctctagatacatatatatatgtcagtccataaacattttattctttcacttctaaactgttgccctcaccattatgtcagagacttctgccttttgcatctttgtgtccctagcccttagcaaaatgtctgtcacatacgagatactcaacaaatttttatcatataatggaaatcttaagttagtattttctctggtgcttccaagacatgcattttgcctagacatgttattgttcgtcatgtgaactggctatggcaaaacacattgccttcagagagaaagagccacacaagttggaaaggaaaggtcacaaggatgaaagaactctatcaacattaatgccttataaaaaaatctcttaagagataccaaaagatggaaagaaattgagtctatcatttgaagacatcccccacccccgcttttttgctttcctgcaagtcatatctgagtcatacctaaggcactttggctgtgcctccttgtggtcctctccatttcttactacttcatctcatcactttaccaccttcaaagagtcctttcctcatataacctcacatgatgttcacaggattaaaaaactccaaacgttcaatagagaaacaacattttcttaaaaatatacagacagacatatgcgaattctttcaacatgcttataaatctatccacaaccctactcagagtatgcttcaaatgtaaatcagaagccatatatattgtattcttccaagtgattactctggaaaagaaaaatcacacatatttattgagaggagaacaaatttaataattttgctcaatcatcaaaaacatttctaaatatgagctatgataggaaaaaaatcagtttaactttacatatgaattattttcctgttttaatcatagaattttttaaagttttggattagattcaaatttcttcagagaactaaatgataagtttgcaaacaattactggaaagaaataaggacaggtgagagcaaaagaaagaaaaacggttacagagtgtaaaactattttcaagcacaaagttaaaaacttctaatacagaacctggaaaacactttatgtgtgtgagataaatgaaagcgttgaggtcagattagaaaaacaaaacaaaacaaaacatagcttctactgacaaatgtaaatgcaccctgtgatcctgttgccaatgaagtggcattgctctgatgtaccactcccatcccaacccaagcacacacttgtcaatgagcaccagggttttcaaattatccagaactctatcataatgatggagctaggaagttctttcagcctcttaacagcagcgcattattttccctatagataatactgagaacatggcaacacttctgcctgatctgcttattaataatacccaacacagcatttattagatagagaactactagatgttaggtgctgggttaagcacaggaaaagaatcaacaaattctacatcattttctttgttgtgttggtggtggtggttactgttgtttataccttcagatctctttctacactaaatttttgggtagaaatgtttaaatatcatccttagcctccgcaataataatagcatttcatcactatcactggtgagaaatttgtgttttatttttgtttacattttacattaagaaattaatgaagtgggaatggctacctttgctgtatactccaaactcccactgatctgtgtgtgggttgcgtgtttgtctagagaggacagttgcccaacacaggaaaaaaaataccctgtcattatatgatttttcacagaactaaaaagaaataaactacccccattccaaagcgtggcctcctatctttttgctacacctcatatacttttctcacatggcaagaagggtacccttgactgctcagtgcctctccctcctcttgatgctgagatgctccaaaacaccactggggttcttcaggagggatttcattgtcaactccagcttgcagtacagggaagtgacatctagagtgggcctctttttgtcactttccccatactaccacacacataaaaatgcctgtcaaacactgtcctacatacatggatgagaaaaagaaataagcactctactatgaaagactctaactagaaaaagcaaggagatgccaactgacaaatgtatggtgatggactttctttttttttttttttccaattctcagatttatttctgaggctctcagccaatttctgtgtcataaagatggtgcagttcagagcttaattgctttagcacttgcaccaagaaaaactgtattgcaaacaatgaagaaagaagagaggaaaccaacattttctaggcactggccacgtggcaaccagtgtacaaggcatttagagaaagctttttgattccattcaatcctggaaaccaacatgttgaagggccagatttttcaccattttatagggatgcaaactttagctcagagaggttaaatgacttgccaacagtcacacaactagcacttagaggaacgggaaggctaactcggagctgatgctgcagcttacactcactccccactcccacgcaacacaaactctttctaggcagcttcgaaggtaccaaacaagtggctcctaaggactcagtaaacattcctgtcagctggccaagatgaatattttggataatgtccagacacgtgaaataccagctttaagttgtggaagtgcttcaggcacaaccaagtctcatttacgtcctttaaaaaatagtcatgacctgcccccttcacacactgtcattcttctggaaggtatctgagagcacagctctgcaaatgccaagagcattatgcagtttccatacatagggcttcctgagtcaggtttggcagggcaggggttcagtgtacaatatttctgccttatttctttaagtttctcttggctacagctcttaagagacacacagagggaatggattctgtagaagatttctcccagaaattttggtgtagattagaaagcttggtttgcttctggttctattacttgagatttatttggaactaaaaggttttctgcctgagagtaaccatttaatatattggggaggggggaagaataaaatgctccttttgttttgctatttgcaccaccctgtcccgattctattgtttgcagtaagttttgtaagagaaactcttctgcactccttattgtgttacaagtttagatgtacccaaaccatcagcagttagattccaagtatacgcttttgattgattcaagtgcattacccgggagggtgtgtgctttgctctgttgttcttccagccaactcccttgccagctgctgaaatgatgccaccaccggtctccatgtcatgcagattttacaccctgataccaggaaagcagaagcatttctcaaaagactttttgctggcttggcaggaaaacagaaattgctttttatcaaaatgaaaaaggttttcttcatgggaaacagcaaaagcagtttgaaagaggggccaatacttttatcctagataaggtgttttcagcagagcagacagaaaaacatgttttccttcctttcatgacatcaatcagatccccaaagccagctacctttattcacagaacagatggagcggtaatggtcccagaggccactcttcctggtctggggatcttgccatccctgcctgaaagttctcaaatccaagctctgggaacttgggatgcttttttctgcctctcccacactccaagaggaacacatccactattatgcatgtcttcattctttgtcctgggtggaacttctgggggtgggagaatgggtgataaagggggaagtgggattcactttgtgaacacctactagaagccaagccaggtacatcctatgcattatttcatataaaccttaccacaaaactttgagtggtattattatgtccatatgacagacgccaaagaagtagactaggggagttaaatgaaatcccaaaagtcatatactaatatgtggaatactagtaaaatctggaatgtgaaccctgcctggtctgttgcttcagagctttgatgtgccaccaacaaacacttccatgcctctctgcttagaggcccagtttaaaatgctatcctctggataaatatgtggtaggtccatacaatggaatattactcagccatgaaaatgaaattctgacacgttacaacatgaatgaaccttgaaaacataagctaagtgaaataagccagtcacaaaggatgatattgtgattctgaaaccaacccaataatcccatagatagttttttggatagacgtagaaattgacctttgtggtcttaatgcttgaagtttatatttgttttaactgagttccttcctcaggaaatgaccttcaggcctctcgaaaaaaaaaaaaaagtattggcaaactgaaactcaccagatcaccacattttgacaatgagatgctggacccctcattctcaggattgcttccttgcctctccctagttcctgttttcttatacattattacatttcttcctggctatataaacccctggttttacatagtctggttttggtcagggaaatggatttgagactgaactcccttcttcttggcaatactcatcatctcagtgactggttttctgcacggcaaacagcaggacctagaccgaacccctagtgttttggtaacaattccacttctgtgaggtacctagaataggcaagcttacagagacagaaaagtagaacacagattaccaggggctgggggagggagaaagtagtccggggaatagggagttattgtataatgagtacagagttgtgttttttttttttttttttttttttttttgagacagagtctcgctctgtcaccaggctggagtgcagtggctcgactcgatctcggctcactgcaatctccgcctcctgggttcaagcaattctcctgcctcagcctcctgagtagctgggattacatgcccagctaatttttgtatttttagtagagatggggtttcaccatgttgggcaggatggtctggatctcttgacctcatgatctgcccgcctcagcctcccacactgttgggattacaggcgtgagccaccgtgctgaccgtgtacagagtttctatttgagatgacagaaacttctggagttggatagtgtgatgactgcacaacattgtgaatgtactcagtaccactgaatgacacagttagaaatggttaacatgctaaattttatgttatgtgtagtttgccatcacacaaaaatgttccctgcttttccctttgaaagatgccacatctgccctgattccaaagctctttcttagaattgactcccactagctgtaaagtgacacaaaagatgatctactccaggcatgccaactcaaatccactgatagtgacagctagcaacactgtgttaagaaagattatgaggatgttttcagggccaaaaaagataaataacatgatcgatttgtaaaaatcccctcacaatgagacatcgaaatgttggataaaatacaacaaaatattaattgttctgggaaatgtgaattgggaaacacagaccaagtggcaaaagcttgggcagagagtcatggtattcagaggccatgatggtcaaatacaggttgatcttctaaaaacataggaaccgagtgagtaagaaaatcaaggcaactaaaacgaagaaaatgttacagtaggtaggtagtcaggcgtgatggggcaggagagggccctcccaacacccccaccaggaaagccacgctaccatcaggtgatggtcaggtggttgttaactctctttaaaataataatttgtcacagccagcaccagggaaagaccgtcttcctatattgataggaaacacctgtaactggtaatcagcagttttcaggagttgggcgagtgagcacaagcatgcgcattaagagacaaaatggcagaatatggttttctggggcattccactggaaaagggaagaaagcctcaggtgggcatacatacaacttcttaaacacactcacatgctcacctcccacatgttagcaggccacacacatgtgggtggcccaccttaagagaagaaccatgggaaaagggacacaaggcccagaagtacaacaacatataaaacccacgtcaaaaggtcaaacgttacatgtgaccttcacagtgcctgcttgggtctcttccagatatactttcctttctttcctgtgctaaagctttttaataaacttccactcctgctctaaaacttgtctcagtctcttttcctgccttatgcccctcagctgaattctttctcaggaggcaagaactgaggttgctgcaggcccatatcgattagccgccagtaacccaaatattcattgcccccaacaaaaagagcagaggttttctgtgcctacgaggttcatgaatgagggctgcctagagctccccccattcttgttgggtctccccttctagtacaagactccttgtagctttgcaataagtttaccttttccttataaaactttactagctattcttcaaatcgacaatggtttgacttcaacaggtcttcatggggtgatcacatcatgtgtcatccatagagggtaatttgaacttataagcattaaccgtgctccatgagttgttgttttttgttttgttttgttttccttttgctttgataaacaacatacccagatacatgggggaaaaatggtagtcatccaatttcttcatattgccagactcacagcaacaggaaagtgacgttattaaccctggggagcctctataacttcttaaaccataaacaaaaataaagaacataatggaaggtataattggtgttaaaaaaaaaaacccaaatgttttctgaattccatcctcatgttacacactcaaaaagtttctctgtaaagaaagaaaatctttgactcaagaatcaactttctagctatctcaaaaccaaattataatgaatttagaccgtagaatcaatactgggggactaactaaggatcactaaatcctgtgttattgattgcttggagaaaactatctttttaaatatgcatcacataacaaagttctttatttctaagaactttctccaaatcctcccatcacatggtttatgtaatgattaatcctttgtattaactactttatgtgtcagaaatattaaaatgcatattaactgttcctgggaaatggttctgcagtttctcctaaaagtatactacctactttgaataagttacatgaaaactgtggcacatttgggaagaaagcagcttagtaggagaaaaatgagatttgcaattataagaactcaatacatgggtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaatttcaggaacaaaaacttttcacttttcaaactgcaaatgaaggtggggtaaatgtgtgaaggagctaagatctagatatattagagtttctatctctgaatccaggaaggactttgtttatagtggtggaaatcaagcaaggagctattggttggtccacacaatgcctaggtgttggctgtcatgctccattcagacccacaatcccaatgaaacctgtcactttcaagagtgcaaataataggatggggaaagagtgttagagtaggacgttttctaacaagagcccagtggattcctacctttcatctaataaatttcaatggtttaagagagcagatccataggtgccacacagcgaaaggacctgtgtaaaaatcacagtgagactctggagtaagagatggaatgtgatggcccgaggccctgccctccaaccttgagtccacaacatacgacctctttaaaaaactccctccagaagccctacagtttcctctctggtttgcgtcttactgctgaagagtctgtttgtagagatggatatctgactaagctagctttccttttttatgctctttccctcaagaaccaagggtttttcacattccaaaataaaatgcaaactgagagcattttgtatttttgcatttcgattccctgttttgtcagtgagtaattatagcaaataaaatattgcagctgaatgtaaattgttaggcaaccagatcacagcaggatatttttcttccacaagttttacatcatagagtgttaaatattaaaatattgcaagtcaagtaaacagagagggttctttgctcaaaacattaattttaaacaaacatttcactgttattcagatcggatgctaggaaacaaatgacattttctttcaaataaggtgaatagatcatatgaaaggaaagcagacaagggaatcatacagaaggaagggcatttatgacacgagagatgaatttcagccagaagaacaggagagaattcacatgtaggagagaaagcaaaagaaagagaaattggcaaaacaacatggaaaagagcaagaaatgagaaagactgacttactgctagaaggggaaaaaatgaagatacgtctcatgtcagagtacagagacctgactcaaaataaggcagctggggaagaaatgaaattctttctaacatcatgaatttctgtttccttaggttattaccagaaaggtagaaaggagatgaattttcagacctccaaaagatcaccaatcaataaaataccaatcaataagcattgattgagtacctaatgtgtgctcaacaaccaagtacaaaattagacatggccttcttctgaggtaccttactatggagttgagatgaggagatgctgaaacaatgaatgagagtggaaatgtattctatgctgtggagtgaagaaaacacacagctcaggattcaatgataatgacaatgagggtggttgagagtaactgtcgtaacactcttattttctaagcacctcctacattccaagtactgtgctggatgcttaatattttcatttccaacatttaaaacaatccattaagaattatctcctctagtgaagaaaataaagcttcaaaacttaagttgcttgtattacacaatgagtaaatggtagggcctgaatttaaccccaggtctcccaacccaaagatcacgatctttcttctactgaagtgctggatttatcctaagaaggcattcttctgttaatccttacaccagaatgccagctaattaaaacagaaacaaaaacaaacagaaacgctgtttgagaaatgttctttgtaagggagatgacctaacatgaatttttggatgaaattataatggatatggaggagttttgtttttttggtttgagaaagaatcttcaggaaaacatatagaatttgcaggagagtcatgttcattaaaccatctcagagttaaagactggagggaatagatgttaatagccataaaggccttgcagaaaaaggcaaaccttcttttccagtaggagagaagaagtgaaaagggatggaggaggagaagagtcaactgaggagcaagaaatgttccacaatgagaccgcttcacaatatctcccagttcacaactaaattaaaataatgcctggggagaagactgttacagatacatgcaaacaaattgcacatcctgttaagtagggcaaaacagacacttggacagagaaaccagaggaagacaaaattcacagagaaggtggagagaactttaacttctcatgaactgtggaattggtagtttgagtacattatagttagatctccattgagcaacaaggtcccgactgacatctggtctacaagatcaactttctggcaatacggtaaattttttgacagttactaaatgagactgaatataagcaaaataaaaatcatcttgtgtttcaagaaactgatatactccagatacatcaccatagcatatggagatttctttaactagaaaaaatagtccatccaaattcacattggttgaggaagccagaacactgacttatccatgtttaccacagctcatctgccttccctcccttaataaaagcagaggcccagagtgactgccaaacaaaatctacctaaaaaacatgccattcaatttttttagaaggccattgaaagataagcaaattaaattaaaagaaaggaatgaagagattttccttctgtctggttgttgagagagaacatttcttgcatatccagcatttggcaatctcttagcaaaatggcaaattcacaaaccctttaacccagcaaatgcattgctaagaatttgccctacagatatacttccaaatagtatgccagaatttgtgcaagaatgtcctttgtagtattgcccataaaaacaaacaaaaaaatggagaagaaaacccatataccatccattgggttaaacgcgttttgatttatcaatacaaaacaatatgtacagctattaagaataatgaggtaggtctgctcttcaagatatactatgctttgaaacaagctaagtgtgaagaatgtatataatatgccatttaagtaaagattttaaaggctccgtgtcgttttgtttagatgtcaacatgtgcataatttctttttctgaaaagctacagaagaaacttcacaatggtaatatttggaggacaagaggccagcatgtcagagaagagaaggaaaggaaagttttcattttcctcttatacctttccttcctgcctgaagttataggtatggctaatttgatttaaatcaataatattaatgaaacataaaagtaaaataattacctagtaataataaaactatgttgtttataactcttatttgatgtttggattctcagaatttacttcactgaactccgaaatgggtggtatttttgaaatttttagctgcaatgaaagaacacagtataactgatgcaccccacccccaaccaaaccaccctcataccttgtccaccactgccatctctatcttgcatttgaaaatatgcagagaagactctgtttccatgctacagacagtacttctagaattttgaccgcatagtaaacagtcattgtatcatccacaccctgaatgatgagggacagggacagacagaacctacctaccatgtgagcagctctagagctgtcatagctatagctgactctagctcacaaagcagacatgaggaaaagcaaagtttgcatgtgcacatacacacaacacaagcacactgagaatgaaggagaacaatgtgagactatactggtcaaagagtatttaggatctgccaaataatccagttttgtttgtattttcatttacatccctttcaccttaaccattttcacagttatcaactctctaatacactgacacatgctgtgttaggcacttcgcaagtattatctcatttacttctcatttaaaatgccattggttaatatcataatcttcccattgcatatgaagaaattgacacttaaagatataacacttaccctactcaaagtcacacatctacatctagcaagtgggaggtggcattcaaacataaacacagctggcctcaaaggcactatgactcactgtattcattcctgattcaagtctcatgccttgccctgagactgttctttaggacataaattgggcaaagagcaatcaactcacaaaaagagaagaccttccagaccaaaactaggaagtttggaaaaatgagaatcatgaaaatatgcgtattacacatacagccaggttgaagaagacagaaagcattagaatgtggaggaaccttatgagctagaatgcttagtacttaaagaaatgtctttgggatcagccatgctcctgggatgaatcctgacctggccatgatctaactgtcaccttaaccatgtcaccgagaggcttaacctgcacttacttctttcatctgtaaaatggatggcataatagtgcctgcttcacagaggcatggtgagggttgaataagatcatgcacattaagtacctaggacccagtaactctctgtaattatgctgtgtttgagatcataaagctcttaatcattataaaagtacctgagaaattctggaatgctataacaggaaaacttctgaaaatatagactacccctaggcaagccctttgttttacacagcaagaaagtgagacctaatcagttagaggcaagatgcttctcaagtcagtctattgagtttttattttgcactgaattacacatctacagagcttcctgtagcaggaaactctgctcagtttgcccattgctcattcctaacacctttttctcctgcctgttcccatcccatggccaactactcattctctcagaccatcttgaagccagtgaaaatctgctggggaatactcgggggaagcatatgattttccagtagcaacactgctgctgccacctctctccctttcttcctaccgtgaatttgatcatggttccaggaaatagggtggccatcttgcaaataggcagattaaaacaatcactaagacactgcctacctccaggaggtcttcttgttaccaaagaaaatacacccctatttttttaagcaactgttaaaggcagggtttctgttacatgcagctgaactcattcccagaaaatgatagaagtcctttttccatggacattgacacagtctaggatgggatggtggggatagtacagggtactcaccagctgttggagggaaatccccaggttgtgagagctcttttatttaaaaaaaaattaaaatgtaagtcaaactcaggcttagttttgaagttcatttctcaccttgttctcatttttatcttgatactccgaatgaatttcccaacgatatctaagagcttcccattcccaggctggtccagtgatttttagtgaaattaggttttattgaaagtgagttgatttttacttattaatgttctgctaattagagcactttgtcaatatctccatgcatgcattatattctcatgtccacagcatgtgtttagaaatatgtggataacaagatggagagttagactgttctggccctaatgacctcccgccctctcaaaacgccaacataacttctggtcacgtaatcatgggccaccttgtactgttcactgactatttgttataggttgattttaatccctgacaaattttttttttttttttttttttttttttttttttttttttttttgagatggagtcttgctctgtcacccaggctggagtgcagaggcacgatctcggctcactgcaagctccgcctcgcgggttcacgccattctcctgcctcagcctcccgagtagctggaacaacaggcacccaccaccatgcccggctaattttttatatttttagtagagacggggtttcaccgtggtctcgatctcctgaccttgtgatccgcccacctcggcctcccaaagtgctgggattacaggcgtgagccactgcgcctgacagacaaaatttttaaacctgtgaatactgacacagcgcttcatgttttgctagtcactctcagtgcctatcacagaggtaggcaaatcaaaaattctcatgaagtactagaaaatagatgcacctgtcccccaaatgcacagcataagaagatacccagggactaaaagctcccaactccaaaataaacctattcatgaacatgagtctctattcctttgctcagggaattcagtgctaaagtagatagcaaatatatttatattaggggaaatatctaaaaaatggcacttatagatacatttgctaaatagatatggaagtctatctgaagacctagcactatgccagccatacaacaatctcttcacaaatatgtattgaatgaatgaatgaatgaatgaatgaatgaataagcacacatacacagcagaaaaacagactatgaatgaatatatatcctttcccctaaagaaagatactctaaaacaaatgggcagtcaaaactacaatctctcatttaactgggaaaagtaaagaaccctctatttcatctttgatttcctccttacatgatgtacaatgcaaagggcttgctagtcatatttgtcaagagagcccacaggtactatctggctcatcacagcttaacttatcaattgccattgttgtttggtggatattgatctgggaagaccttgtatcttgcgaaagtcacttctacagcaactcatcactttttctttttagtcgacatgaaggctcaagtgttgtggtatactgggaatttccacgcgacagccccattccatcattaaatacccagtgagagcttgttaactagatgaatgtcccaattaaaccagcacgttcttgtcgctgcctaacagtgatggtgggttcagactaacagtttgaagggcaataactaaaatggtttgaggagcctcaagtgtagtttcaatggtttcacacttatccattcatttgttcattcaacaaatcactcaggggcccagcatggtggctcacacctgtaatcccagcactttgggaggccaaggtgggtggatcatatgaggccaggagtttgagaccagcctggtcaacgtggtgaaaccccgtctctactaaaaaaacaaaaattagccaagtgtgatggcacacacctgtaaccccagctactctggaggctgaggcaggagaattctttgaaccaggaggcagaggttgcagtgagctgagatcgcaccactgcactccagcctgggcaacagagcgagactctgcctcaaaaaaaacaaaacaaaacaaaacaaaaagcatttttttggcaggtcccaatgtctatttccaagctgaaaatgtttgctttcccaaaggggcataaaactgtgatttttcttaacagcacagtttaagtggtcttgactctgcatcttaagttcccagggttaagctggagatcttgagaacaagaaaagagtaaaaatagcaacagtgcaaaactccagacatcatgttggctccatacggctgtgtgggttgtgcactgtgcaagttcagtgtgttccattactaggaccatgatacaaatggcagggaagtggtagaaaccccacccaaggggtatcctaggcccatagtgctccctagtacaagggccacaaactactaaatgtccaaaatcacaagtaaaaactgttcattttggtagaggaaatacttgatttcatacacatctaaatttcacaattaaagtctcaaataaaaagctgccaagtaaaaatgctcaatgaaacataattttttcctctacctgatttttaagtaaaacaggcaaagaagaaacaaggcaatgattgaatagaaatgctattcttgttttaaaaaaaattagacggtcctaagaatctatgctaaatgattacattaatatgcataaaatacataaaacatatgtacaaggatgtttattgtaagactgtttctctattactaaaatacagaagtggttatataaattatggtacttccatacatgaaatgctattaagtcaataaaaagaatgagtaaacttgtaattgctatcctaaggacaaagctccaaaacatactctgaaagacaaaaaggtaatcatagaaaaatataatatgatcctgtttataatcaaatctagataatgtacataaagggatattaagtcatgaaacagtgcttggaaagatacacaccagtcatctgacagtaataacctatgaagatgaacgaggaagtagagaaatttcatattttatatattgtaatttgaactacttttttttaaataatgaaaagtgtttgtgtattaagtgtattataaaaaatatccaaatagttcaaaatgacagtaaattacaggttatgtatagtttaatcccaacctgttacaattcatgacaaaacaaatggtttaaagttaaaatttctaatgtaacctatgtcaattacacattctgacaacatatattcattgagcacatacattacataaaacactgctccaggggctgcaggtccagcaaagagacaggtaaggcccctgcttgtatagcgcttttgtccaagacagtaaaagagactcatatattttaaagagattttcagttaaccatcattttcatagtaaataattcaactaactatgacattttgggcactgtggctgagaggtttgctgtgactctagtaaagtttcttcttggaaagacattctgtgccataaagagcattccctgcctatcaaatattcatccttctcagccatcaatcaactgaagttccctcaaacagaatccataaaacagtcatactttccatccttagaggggtttacacctttccaagcactttcacacatctacggtgtcctaagagatgggtgactaagatgcaggagcaaaataatataaatttaccatataaaaactttcttctgtctagcacacttttctcctcgctctttactcgctcaagttttgctggtccttcagtttgcaacttagaagtcacctcttccaggtggcattccaggctggtatagggatcccccctacatgcttttattgctccctattgcctccattccctcacaaggtgtggaccatgctgctttgcaatgaccaacttggtggccacatccaagtcacagggctcaggatcacctggagtgccctgggtccaaactcaccctcaagaactgactcaccaggtaggtgagtatctgacagtcatatttacagaagctctccaggtgttctgaagcagttaatcccaagatatgatgatggaggtgtggaccatgtctgtctctacatcaccatcattgaagccacggcttctgacagtgcctgatatattgctggtgcccaataaggagctgctcctttatctactggttctttcaaaaaatatttactgagcacctcagcatgccagacttctggtgaatgacaaaatgaaccaatcatgcatcatgacgatgatacagctttcattaataagactttttgagttatctgatacctgaagcaactacaggaacccaatccacacctgtccctctgtcccctgctgggtagattagggaagacaaacaaagatttgggagcttttgtcacattctttaggtgcttccgggatgccaccagtgggttccaactgctcagctatgtttagaggtcacaggcaaacagagtgggcccattgcagactgcgaggcagggtgcctctgttcaatataaggatatagtccatgagacagaaggttattacaatgaggttgcctgggttttcctccccagttttattctgtacgccttttaggtaaattccttaatatctttcttcaaaatagttggatggcatttgtcttacctttaagggattcggctaaaatccacttgagtgctggcgcctaggcagggaacaggcagcaattcctacaggtccatctacctgatgacatgaagactagtttatggttaacaaactgtttttcactctctttagaagagaaatctctgtcaaaggtcacataaactttaccgtagtcagcaaagccccttcttataggatcctccctctatatttccaccctcatctagcactgtcttccttgcttgccatgccctagtcctgctgtatcaatagagtagagccaccagccacatgcggctcctgagcacctgaattgtggctagcccaaactgagatgtaccagaagtgtaaaatacaacccagatttcaaacacttagtacaagggaaacagaaggtgaaagaatcctattcataattttctacacagcttatatgttgaaatcatactattttagatatatcgagttttaacaacatattattaatttcttttactttttatggtgactaccggaaaaactaaaattacacaagtggcttgcatcatatttctaccgggcactgcaaccgtgtctgtattggcctcttgatttctgtactataacaagcatttcccccacttctgaggctgtgtgtttttttgtcttcacatgaatgactctctttccatgtctggcatgcctgactgctgttcacccttctaaatgcagcttgtatagcatctctggaataagacttgttgaatgtctatctgtttatgacctgcagcaaagttagccaaaatgctcaaaagggggacagaattgtctgcccagacttaaggctggggctccccgaagctgactttccagtgataataaaatgtccccacccaaatctcatcttgaattgtagctcccataattcccgtatgttatgagatggacccggtgagaggtaattgacccatgggggcagttctttcccatgctgttctcatgatagtgaataagtctaatgagatctgatggttttataaagcggagttcccctctacacaagccctcttgcctgccaccatgtaagacgttcctttgcttctcttttgccttccaccatgattatgaggcttcctcagccacgtggaactgtgagtccgttaaacctcttccctttatgatttaccaagtctcaggtttgtctttactaacagagtgagaacagactaatacaggtaataaagacttgaaggacatgaggtaggaaggaaagacaaaggtagaggaggagaaaccaagagtgttaccaagccttagcctgatgacaacaggcagttgcttgaagagagacaaacactcttgctttaagaggaataaatcaaagtggcttcggatacattaaccctagcttgtcatttgagaagacagccctttatatttagaatggctaggaaagactccttctagatgatttggtgctaatgttaagaacatcacgcaaggtgtccagttcgatggctgtcaacaccttctctaaaccttgtggcccataccatatcaacaacaaaataaagaaaccaaccaagtcaacaacaacaaaacatcgtcaacaacaacaaaacatcaccaacaacaataaaaattagaatatttaagagcctgtgcatgcttacttatgtgctgggcactgttttacacattccatatattaacttagtctttccaattaagtcttcaaggtagccaccgttattgttcccattctatagatggagactgaaacctaaaaaagtcaaggacttgcccagcatcactgagctggtaagtggacgatcaaagatttaaacataggcagtgtggatcccaagcctgtgctcttaacccttgcagcatataccactctacatcttctgtactattctctattgacagtatctatgaagctagcgcttcatggtatcaggatatgatactttcttaattattcattattttgtctatgtatgccttcttttcccagctacagcattcactgtttgaagggagagattcaaccatctccttctctggaccccacacccaacttatcctgttataggctcatggtcaacagatgactgcactgtgttactaaatgccagggaatacacagaagttgtgactgcttacatattcatggaagaaaaccccaactcctatcatccaagtttgaaactaggtcttctttcctattgggggaaatttctgcaggtgtgagtaattagaaaattaaacattaattaacaattcaagtgactgattgtgttagcaagttgcttgctaaccatacaggtaaatattgtgcccccatatgatgtttaaaaataaggtcccttgagcatattaagtagtagagatggttgactcaagattcaagagtttcctgacccctttaatatgtcacattttaagtctgtatataacaaaactattgggaaaggggattgccttactcactcaccttgccttatcatcttacaaaatatcttatattaaaagagagaaaaggatgacagctctgtatctatcacctattactcattatcctgggacaacaaacagccccagaatctttctttaatgaatataggctctcatagtacatgcttatgttcgtctcacgtttgctctctctcatttcaaaaccctatttctcttctgccctttatgtcttcaaaagagacgctgatattaattaccttgcttctctaacccctcatcgttttcagccccaaacaatcagcttcctgcttttaatcttctaccaaatctattttctcatgatctaccgaagtcaccctactaagtaagtgtttctggaaaggtattttcagtgcccatttcccttgaccaacctgtggcccttgactcactggaaaaaatcactccactcctgccctttgtaatattattctcagctggaattctagcctctgtcctgcaacctccagcttgattttacaatataaacactgctacttcctaacaagttcaccagatatacgaaataaccctgtatttcccactgaagtaaattagattgttgttcagtaaatattcactctctctttacttcttattcctgagaggagtatactgtcacattcctttgatatcagacttgatttggcttaagacatgtgaatggagcaggggcttaaaatgtcatgtgcattcctgtctttcactatgagaagcagatgtcttagttttttgctgggtcttggagggtgacagacacatggacttaactcacaccctatagtcaaaacaagccaagctggcccacagacacaagaatcagagtaaatgactcttatttcaatccaccaagtactggggacagtttggtacacatgagttttatgaaacagttaactgatgcacccatacaaatgttaaacctttgttcactggaacaaaggttggaagttttctccaacctttgttggatggaaattttctcttgttcctctacttctatggtattacctctcccatgccacttctctaacttcatgtcctgtattctctcccttattatgttttaaactcctttgaagagcaaagcatcaaaagttcttatccctagacagacacaaattaaaatttgcttattcattcattcattcattcattcagcaaatgtgtggattttagaaatgagtttctgtctcaaaggtatttaatacaacacctggctcagcttcatggactagagacacattatcactgaggtcacgttgttactgtttttgctactcctgctaactgttccaaaggggaaaaaaaaacaacatgcactttaaaagcatgatgttcttgttggcagaaattacaatagtttcttctcttggtgtttactcccccaacactttcctcagctctttatttctgatattcaattaccctttttctgcctggcttttctcactttcccagaagacttaccctgggaaactttactgttttcactggtgtacatttgcactagttggtttaattaccaagtgaatctacagcctctcagaacatttgacacgtctccctttcactggatccaagacatgaagcaatgaaaacgaatgggtgaatgttacagcaaactcaaccaaaatttattttgcctggattcaaggattaggctaacatgctagccagtttctgcccccctaaaatgtcaccctctggaatgacaaaaaccttaataagatttggaaccaaagttcctatgaccagaaactgctcaacatatatgcgtcacacacaggaaataaaggcacattttaaactagagctgctgggtcatctttaaaatagcagactgcctgtcaggagaaccaatggaataatcaatcactcaatttaaagtggggagctcctttaaaatgctagggtgatggggtatgggcacaaagtgaatagctgtgacagtacagttcctcagccaagatccacgaatgtaagcaccagtgggaagagcactagaccaagaggctcaaaaatatactgtgaccttcaactagtcacttaacaagtgctcattgtatcatttaaaaaataatacaatagaactccatgaatccaattaaatttaattccatattattcgagtgtttgtttaaaatgatatttctcaaagcaatggtcaaatgagtttggaaatcagtagattaaagaaggttaagcaggtttctgttccatgcaacttctcagtaactttaatagtctactgtgcaccgtgaagctctcagacctggtggatgtggtatggaacattccccagactaataggaatcaaagatcctgtttgtttaccatggacagccttgtagaactcctattctctataatacatggccatcaattatagaagacacagagatactaaagagaatagttttcttgggtcctggtcctgaggcctggcattctcatgaagctgagtttatgccctcccctgtgatttatgccatacctctgaatccttataatgatgtccctttttgatcttaagatggctttaactggtaactatcatttgtaagcaaaagtaccttattaaacaagaaaaacagctacgtgtgagttctgagtaaatattgctaatttatgtctatctgcaattgttacttgggctgaaacaaaagttccaggtaagtatgatagtcattttgccagaggagcctcaataatccctgagctgaaatactttcatacatcaagacgtaatcatctaatattaggaaagccattaagaaatacaattactactggaaatgaagaccttttacaggagaacagacatgatggttttccttaaaagctcttcccttttccacatccactttcttctactttaaaatgaaagtgacttcattttcaagtgaccttttataaagtccaaacatcaagtgtcgtaaatattctaagtattcagaatgaggtccagtactgtaatattaagttggatatgccagaaactcagaaaagcctatttctctttaaatagccaacttataaaattattcatattgtcttcctggattcccattatgttcctcgtgcaagaaagtgaaagtgttttatacaagccacactgtggggtaatatggccaaactaagagctttcagaaggattcttctcttattctctacttctgcttctgctgctgctgctttttttaaacaaatgagatcagaggcatactgtgattagcaatgcatgtttatgtagtgagacaccagattagaaatgattattatcatgtcacctaacagagtgataataatggtactctgagatggtacagctcagctgttgaggattcctactacaataattattttaaaattaattttgaagagaaaaaggaaagaaagaaagatgattgaaaccattaaagcaatcctgataaataagaaaaaaaaacccaaacactatgttttattcctaaggcaagcacaaaaaataaaataatcaccaaagtgagacacgactgactgaaaggtaaaaggaacattcattttccccatccaaggaaaacaataactgaaaacaatttaaggcaaaaagttaagcttctattctgagcaaaggagagttggactgtatttatgtgctaataatctatttataagaaataactgattaaataagatagataaaacttagtagacagaaatatatttttttcatagcaaacaaagcaatcaaaagagaagtgttgctgaaaatattgacaattaaaaatcattcaaggactctgaagtatatttcaggcagaaagagagcagcctaaggaggacttattacaggattgaaagcatcaccgtgaattcataatttttaatatataaactgagagatatggaaatatatatatagtatgtgtataagtacacatgcatataaatacacacgcatgtattgcctacctctactcacagagaggctgaagcaatgataccccactataaattagcatacctgatgtccagatcttggtttctaaataccattctccaaaaaataaaaataaaaaaggaaccagacctccttggagaagtggttggctccattaatgggacaggacaggaacaagatgagattagaatatcctgtggtgccacaaagttacaaatggctaaaaaaaaacaaagaaaaaccaaaattgtggggacaggtcaaaagaacacatgaaccagaatgaagggattcccctggctaaatagggacataaaataaaataaaaactgataatatcccagagactacagaattaaaaaaaatctacgattttacttcacacacacacacacacacacacacacacacacacacacacacatatatagaggggggggggaggatacaaagtaacatgtaggatgaacaagtctagagatctaatatacaatatgatgactacagtcaataaaattgaattagagttttttgttaaataagtagattttagctgctctcttcacaaaaaaagtaactctgagataacagacgttgatttgctttatgtagtaaccatcttattgtatatatgtatcccatatcatactttaaacctcaaatacacaaaataaaatttatttttaaaaaaatgggaggtgggggagaaaagcccttccttacagaatttcaagtcataaataaggagtaattaaattagaaagttaccatttaacaatcatcacaaaagtaactgtttcaggtaagaatcagtagtagtgaatgcaaaaaaagaatgggtaaaagtataagaaaaaacatactacattttctacaagtatattcctataagatacttattgattacaaaaggaaaaatagcaattttccaatggagaaacctggtagacaccacaccaaccaagtgatcaaagttaataccaagaatgggagaaaggagcatcagtgtctcctgatataatgcactaagaaggatataatactacctctgtaggattctggccaatatgcaaaatctgattctaaccatgaagaaatgccacatcagacaaactcaaattaagaaacattctgaaaagcaataggctgtgcttttcaaaaatgtcaaggtcatgaaagacaaagtctggggaattgtttgagattaaagaacactaaaagacaggacaactaaacacaatgtgtgatcctggaatggatcctggacccaaataaaagacaatggcagcatttccataaggtctgcagaccagaaatagctttatatcaaggttaatttcctggttcagtaattacactatgtttttctaagaaaatgtcttgtttaaatacactaaaggagcaaagaggcatcatgtaacttgctttcaaatatttcactaaaaattatatatacatttatacacatataacatatatggtacacacactcatatataggtgagagagagaaaatataatggaagtaagtaaagtattaatatctggggatctgagggaggagggtagagggattctttacattatgcttgcaactttttttttttgcaactctaaaattatttcagaattaaaagttaaaaaagaaaagagagggagcttgacttaatattgcagctgtaccataaagtgttcttgaacaagtgacttgtcttcattgaggctcggctccccctttgcaaaatagagacaacatgacttcacagggtgatcggggtggacaaacaagatggtgctgcaaagctccaacccaagagctggcccctgaagcacacagtaagtatagcttgtttttggtaaatccaaaatacaacaacccattagagggcgttactgtctgaaagcagtttgggggcacccgaggtgatgtgcaggccgcagagacaatgctgttctaggtcaggagcagaaacacaggctcctcacacatgcttttaaatggggctttttactttctaaaatgtgtttctacacaattgaaaacaacattactttttccagagtgggaggatgaaagcaatcgtgggtgggggcttcttgagaagaggggttattttttttacttttaaaaaggtctcagaacagttaaaaatagtttttccttaagcagcctccctctgctccctgctcccaccagctgctccttctctcagcctgcccttctctttgtcccttcaccattttcccctctctcctttttgcttccagtcactcatatgccacccactcctgagaaccctaccttctcttatttttttgtttggctttgttttgaaaaaaatattaatcccaaatgaacaaagaagatacgtgggaaggaaataaatggtgagctcttccttacttcaccacctgtcaagttttaagtttttcctccaactcacactaacctcctgcgcaaccataaacttcagtgcttgccaaagcccagaaaattctaagtaaaaagcagaaaatgaatgcagggaagggggtgcattcttattgttcatcagatctgaaaaaaataatgcccagaatgtcaaatgatattacactattaaaaaggtacagtaaagatgtgctaatgatagattttttttctactccaatatgttgtaaatattataaactatcatttactgtcattactttaatgatgtagaatgttgaaaactcaatctgggttaatttacaaataagtaattttgaaaggagaaaaaaatatcttttctatttccgtgtaatgtcccattacttgacagtcaaaatgtggatacagccaaaagaaaaataatgaaggtcaaggaggatcaaaatttacctgatagagtacctatctgttagaaatcactttcctgaaataccttctctgattttagaaaactgaaaaaacagaaaatacactacctttgacaatgcttgcgattcagggttgtgcttgtgtatgggggtgggagaacctctgctaggataggagaaagctgccagacacaagttcagatttaatagaaatagctttcaaatcaggagtctagccatcaaccagttttagatggacagtcccagtttcaagtaaataaaatatttgcatattagagcctcgtagccctacttagctgcaagtaaattttctgagatttactctgccttgcttcatttcatccaggcactgattattttttcattctttattcaccaaacatttactaagcacttctttatacaataaattctgagcaaggtactaagacatgaagaataaaacaggtctggctggagactgcacgaaattgccagtctgtctgagcctgtttgaattcataaagtccccgagaaagaagaaataggtgaggattagcaaccctgtaagagcatttacaaagaagggagtgcaaaagaagaaaatagcaccacagctcaggagggcaatggtattacttaccaagggtgcagtttgtttgatgacaaatctcaaaactgaatgcagtgattgtgttagatgcaaacacttggatgaaatagatgactgttcttgtgaccttgccaggaaagaggaggagtgaaagagagggctagagttctagtctcctttctgagttttgcattcattggcaaccatgtacctctagacatgggagtgcaggcatctatctctatcaaggtacatgacatgtaatgaaaggaagggatagagaccaggcaagagaaagcaaagagagagaaatagacagggagatggaatgaggtagacaaatcttagaggaatgcagtgcttctccaagtttggtgcaggaatgttcccattagaatcacctgagggggttatttaaaatgcagattcctgggctctgacccaggtctggtgagcctgaatgtctgtggctgggactctaagatttgcattttatatacgttttggggggtggttctgcatattaaaatttaagatcagaccactccctaaatccaagggtgctattttactgtttacttgaccaacagtataaatgggtgtcttcaaagccttgtcaccacaaccccatgcagcctgatccacttacttctctgtatcacactccctcctctcccaccaaggaaaacagagtgatcctgaagttccttaaaactcaactcaatctactgctcctcattagtaataaggttctgttcaaggaactattggctaatcattcatatcctgattgagataccagcatatcctacccaattattaactatggatggactccaaccaggaaatccaaaactatatgctgcttactgaatgacaataataaatgtaggctcttatttaattatgctgcggtttattaactatccgataataaggaaaacccctagtttattatagatctgtggggtgtgtgaatatgtgtgtgtgttttgagagatatatacaggaccctaatcagagagagtgccaggaataacagccatgcatgccaggcatcttttcctgtttctttttcagttacttgaatccacctgtgataaacttgccaaaagaaagaggaagtacaataaccacaaacgttaagtgatttttttttttgttctacaaactcgatgagttcactgcattgtctacttatctgtttttgtaatttcaacttttatttttgatttcggggtgcacatgtgggtttgttccataggtatattgcatgatgctcatgtttggggtatgattaataccatcacccaggtagtgagcatagtacccaatagctctttttcaatccttgaccccctccttccctcccactagtccccagtgtttatggctgccattttcatgtccatgtgtaccatgtttgtctgtttaactctcacttataagagagaacatgtagtatttggttttctgttcctgtgttaatttgcttaggataatgacctgcagctgcattcatggtgctgcaacagacatgatttcattctttttttatggccatgtagtattccactgtgtatgtgtaccgtatttcctttatctaatccaccattgatgggcacctaagttgatttcatgtctttgctattgtaaatagtgctacaataaacatacaggtagatgtatcagtttggtggaacagtttcttttcttttgaatatatatccagtaatggaattactgggttgaacagtagctctgttttaagttcactgaaaaacctcccaactgctttccacagaggctaaactaatttacattcccaccaacagtgtataagcatccccctttctccacggtttcaccagcatctgtgtctttttggctttttattaataactattctgaatggtgtgaaatggtctctcaccgtggtttggatttgtatttctctgatgattagtgaggttgagcattttttcatgtttgtttgctgcttgtatgtgttgttttgagaagtgtctgttcatgtattttgtccactttgtaatagggctgttttttgcttgttgaattgttgaagttccatatagattctgggtattagacctttgtcagatgcatagtttgcaaatattttctcccatcctgtaggttgtctgtttctctgttggtagtttcttttgctgtgctcaagctcttcgattaggccctacttgttaaattgtgtttatgttacattgcttttgaagactttgtcataaattatttcccaaggctgatgtccagaaagacatttcctaacttttcttctaggatttttatagtttaaggtcttacatttaaatatttagtcaattttgaggtaatttttgtatatggtgaaaggtaggggtccagtttctttcttgtgcatatagttagccagctatcccagcaataacaatagggtgtcctttttccattgcttaatttgttgactttgtcaagatcaggcagttggaggtgtgaggttttatttctgggttttttattctgttccattggtctttgtctgttttcacgccagtaccatgctgttttggttaatgtagccttatagtacagtttgaagtcagataacatgatacctctggctgtcttctttttgcttaggattgctttggctactcgggctcctttttggttccatgtgaatagtcttttctaattccgtgaaaaatgacattggtagtttgataggaataccactgaaaacctgtatattgctttgggcaacattgccatattaatgatactgattcttccaatccatgagcatactgtgcggtctttgatattgggtcctgactaggccaagaagacagagatagactggtccctcaaaccttttctctaatgtctggagagtacatattttatgcttttcagtatgtatggcctctattgcaacaactcaactctgccattacagcattaaagcagtcatatataatatataaacaaatgggtgtggctgtgttccagtgaaactttatttacaaaaacaaatagtgggccaaatttagcctgcaggctcttgtttgccaaccccagctcaaatcatcctcagacaaaatttagggagctgctaataataacaaggccatgctctgctatagtgctattaagctattgcctcagcatcaaattcaccctttggtattctcttctgtgataactggcacgtttatgtattgacaagaaagatgaccaccacatattaagtggggaaaaaatcacactttttatagcaatatcactttttttaacaaaatatgatcctctatacgtacatacataatgttgtataaggattcataagtctcagaaaggataatactgaaaggttcagaggggtaacctctggaaaatggaatcaggagtaggaagaaaagattactctgattttttgctttacattcttttgtagtctttgaatttatttagagtaagcaaatattaccattgtaagttacaacaataaaaaggaataaatcaaggtggagtcttaacagtgctgaaacacttttgttaatccatttccccagttccaacctaagctttacagaggtgctattgtcaagcaatcactcattcgttcactctacacatataataggcatccactttgggccagaccctacgctatgtgtgaggaattcatgaagtttaggatctaggtggaaaaacataattatataagctaaaattgtaattaaaacaaataatgtacatgaaggagagatggcatcacatttctttattaatatatttattgggtattatatcccattattgctggaggataaaatctatgccagggaatataaaaagatgagacagagaaaatgatacgagtaaacacgctgaggactttagactcagcatataggtgtttggttcctaccatatcatctacataatttccttaaaactgctgtgaatataaaatcacaacagctgttttaaagagactgaaattgaaattcaatgaaacaaggcatttgtaagtcttccttggctttctacattgatagtgacttttttttttctttttcacactcttagaatcagggatgggttagatgttatgatcttgctgttacttcaggcatcttctgttatcattctccctagaggccaaaggcagagaccatgtcttcttttctatatgttggaggcactgtcttttgagttatatgccaaacaccttctctggaattggtttgccacttctagggactggctccctgtcgccatgtttgtgtaatatgacaacagacttaggcaagtgatcctagctgggccagaattccttcctcacacactcaaaacaggaacaaaagagagtggtctagattttacaatgtattaactcaagggatgaagaattccttataaactagacagagacaaagatcttcagagataaaagacgggtacagacaagcagagagaagattaccaagagcagatcattctgtccaggtgcctctgattttttgaggtctaggttcttccaaaggccctactacatcctttgcttgggtttttttccatatgacatcattctacacttacattatatcttcccttttcactgaagcatctatatataaattaaagcatcactaactgatgcatgtgtatatattccaagatgtttaatattgctttcctgacagtagggatttttatctgcagtgcttcagagccaaagcaaattctaatgttatttttttcctccggaatgttctcccagaaagtttctaccagtttgctacaagttgaatgccacttgttgtcatttcagaacctcatatacagtattctttaatagccagaaacacaattataggggaggtcagaagatacatctccaaagtcttctaagtgttctctcctgtgccctacaggccaaaatggtttatatatcaaatgaccttggacaagttgtttatcttttgagtttcagttgtctcatttgtatacaggcaattctgttggctctacagtgctgctggcaggataagtgacaaactctttggaaagtccctcacacacagtcagtgtcatttaaggtggctcctcctgtgagattttgcaattagggatatgatcagtcttagtccattttttgtttttgtgaagaaatacctgaggtggtataatttataaagaaaagaggtttatttggctcatgattctgatggctggaaagttcaagattgggtatctgcatctggtgagggcctcaggcttcttcatcatctcatggcagaaggcaaatggaagccattgtatgcacaaatcacatggtgagagaggaagcaagagagagagtaaaagggtggggggatgccaggctctttttaacaaccatctcttctggaaactaatagagtgagaacttgcttaacccaaaggacaggcatcgatctattcatgaaggatctgccctcctgacccaaacacctcccccaggccccacctcccatcattggggatcaagtttcaacatgtggttttgagaagacaaacatccaaaccatagcattccactcctggattcccaaaacccatgtacttctcacatgtgaaatacaattgtttcatctcaatagtcccaaaagtcttaactcatttcaaaatcaactcaaaagtttaaagtccgaagtctcatctgtgacccaaggtaatttctttccagctatgagcctataggatcaaaaataagatgtttgttttcaacatacaatggtttcatgggcactgggtaaacagtcccattccaaaagggagaaattggccaaaagaaagagaaaacaggccctgtgcaagtctgaaacttagccgggcagacatgatatcttaaagctacaaaataatcttctttgcctccatgccctacatcctaggtactgcaaggggtgggctcctaatgcctcaggcagctctgcccctataacttcagtgggtgcagctcaagtagctgctttccttggttggagttgaatgcctgtggcttttccaggttgaggttacacactgctgctgctgctggtggctgtataatttgggagtccctttggtagctccacttccatagctccactaggaaccctgatagagattctgtggtggctgcacctctgtggaaggtctctgtctatgctttcagagatctatgagtcatctctaaaatcctctgaaatctatgagtcatcaagcctccaccacccttgcattctgggtgcctgcagacgtaacgtcatgcaaaaactgacaaggctcatggcttgcaccctccagagaaggagcctgagctatatctggggccatttgagccatggctggagccagagcagctgggatgcagggagcaacatccagaggcagcccagggcagcaatactttaggcctgtcacctgaaccattctgtccatctacacctctgggcctatgataggaggggtggttgtgaagatctttgaaatgccttaagggcctttttcccattggcttgactactagcacctggctccattttaatcatgctaatctctttagcaatttcactggactgggcaatagcattggattcctcttctgaaaatgtttcctttcccaccaaatggccaggctgcaaattttccaaacttttacactctgcttcgcttttaattataaattacacctttagatctttcctttgctgctttaattcagcataacctgttaaaagtagccatgccactaactgaggtctttgcagcctagcattttcatccaccagataccccaccctcatcacttttaagttcgaccttccacaaagccctaggacatggacacgatgcagccaagttatttgctactatgtaacaagggtgacagttcccagtaagtttttcattttcatctgagaccttgtcagcatggattttacagtctatatttctatcagcattttggtcacaaccacttagccattctctaagaagttcaacactttcccttgtctttttttcttcttctgagacctccaaactcttccgactgctgcccattacccccaaccactgggtactaattttctgtcttagttcattttgtatcgctacaaaggtgtcactgaggctgtgtaatttataaataaaaggatttatgtggatcacaattctaatggctaaaaaattcaagattgaatatctgcatctgctgagggcccctggctgcttacactcatggtggaagatgaaagggagcttatgagcttatgtatggagagatcacatgacagagaggaagcaagatgtcaacaaggtgctagtctcttttcaacaattagttcccttgggaattaacagatggagaactcatcccccaaaggcaggcattaatctattcatgacggatctgccttcatgatccgaacacctcccaccaggccccacctccaatactggggatcaaatttcaacatgtgccttgacagggacaaacaaatcaagcatgatccttagaaacaccacatggtagagtggaaagagtatttaaatgttagtcaggagacctctattctagttccctgttctcactaactagttgcacggccatgctgcttacttctttccaagaaacctgtaccttcatgcataaagtgctattccctatgcccgagtatcatcctacatcatcatgtcatggaaaccccaactctaattcatgattcatcttgagtcctgacttcttcagcaaggtctcctcagtttccacaatcagaggagaacattcctttttttgcataaataaacactgtacttggatctctcttatgggagttattaggctcaaccctactttatagatctagcactactcaattccttcttatttactttctaaagacaattcatcttccaaagttatagaaaaacaaagtttagcatttgctgcatatgtccaacaaacataattaattggataagaaacttggcaggtaattagtactaggcataccatttgcttttttatgcccagaacctagaaaagtgcctgacacatggtaggtactcaataaatatttattaaatgaaaaaatacccagacttggttaggaaagactatgtaaggcaacaatttcaagggtatatgcttttaggccaattcagtttgccaaaatctagcccttgatgttaaaaggaagctggggcttacagaaatggaggaccccaacgctaatggcaagggcagaaatcatcatttatgagacatagtctcttgtttggtggggaatgtttgacagctagctgcataattccacacggttccacaggagatgattttggatgtggagggaacactccaagcacacttcttatgaagacctataatcagaggtcttaacaaacacaagtgattaatatttgttgacttcatgacacatttattttctttagagcacttaccacagcttactctaactttattaaactttttagtatatttttgggttttttttgttgttggtggtatcctcaataaactatgagttctgtgggggaaggaaccatgattccctgtccattgttgtacatccactacacagcacagagtagatgaagctcaacaaatgttggatgaataaatatgcatatagtatgatggatggatggttgagtggataaatggacggaaagaggccagctagtcacccatacaagcttctgggttatgaacctaaataataacacaagttcaacagcaacaaaaataatcccattccattataggctggatgaaaggcttacccactgtcttacaccattagcgctgctctaacaaaatacctgacaatgggtgatttataaagaacagaaaattatttctcacagatctgggaaatccaagatcaaggtcctagcatcttgtttctgatgagggtagtcttctgcttccaaaatggtaacttgttggcagctccttcggaggaaacaagtgatcacctcccaatggcaacatctcgtaatattgttgaattggggattaagttttaacatgcaatttggaggagacacaaatattcaaaccatagaacccacttagagatgacagaataacgaatatatatgaattaaaatgaatggaacaacaacaataacaacagccatcacttatgtagtgcttactgtgttccaggcattgatctaaatgctttacatatatgaattcttaattcctaatacaaaaaagtgagtgttccttcttgatctggagccaagactgcatctatcaaaatgggaatctgatcatctctcccatctgccccccaccccacgtacatcaatggtctacatgacaatgctacaattaattccagaagtaaacttaacctctcactaagtgcccaaccaaagagactgcatggtttcccagtatgaaaatgtgaaggatcaattcacaatttgtttcctgcaaaactgtcattcctctcttcatacccatcactggagaaattacttttcagaccattctacagcttgggaatactaaataagccctaatgagttcaaaagtcggtaatgacagtactaattcagtggcctgtttggtagaaagtcagtctcccttcttcaaaagcaaaataggattatcaagtgagctgggagcattttctttacgtgattgatgggtagaaaaagtaatcacctttgaagtgccacaacatataatatatctcctgtgttctctttcttcttctgacacccacaagtaattgaagggaagggagcctcttagaatgaccaacgaagtgaaggtgacaaccctttctctgctatctaccactagagtgacatgctggggtcttgaatagttgagaactgacatgagtgtctttgatgggctgctttgatgcttggttcagagtgtacctgccaccagtcaggccacacagactttgggtgaaacatacatctaaggagacaagtgttactacttcttagaagcaaagggcctgtgcacctgtgaaagaagatctgttgtctgagctctggggtcggggtaaggtccgcaaggtggaagtgaaggaagtcaaggagcaaagcaagttgaagcaggtaagaaacactgaatatgatttcaaaacagtttctcatcatactcatccataatgaccgattaaccacaatgttcagactgacaactaggagatcattagcctcttgacctcagctcactgatgcagaagcagacagtcgtctccttggaaaaggcactgctctacagtagcttactttgtaaggggatttttgcaactacaagtaattcaactgaaacagagttgacactcaaaaaccttaagaagcagggattatcaggcaggtgaacagttttattcttaagagctcactctttctgaactctcctaaagcccatccaggcaaggacatatgagtttgttatctgaaggaagaaaaatgctttgaagaagatttataaagaggaagggtctttggtttattgacaagaaagtaaaagactttctagagttgtaagcgaaatgtcgctgttcaggttctagaacttgctggctagagaacagatggctgccacttgttggcacctggagtgacaaggagttgaggaaggaagagagtgtcatccatgtgatctggcacagaacattcttctctggagccactcttataaagaagagactggcatgtttggtgggtttactgtatgatatggtttgaatctgtgtccctgcccaaatttcacgtgggattgtaatccttaatgttggaagtggggcacggtgagaggtgatttgatcatgggggcggtttctcacgaatggtttcgcaccatccccttggtgctgttctcatgatagtaagttaccatgagatctggctgtttaaaagtgtgcggcacctcccaccttgcctttcttctcctgctcccaccacatgagatgcctcactccccctttccctttgccatgactggaagcttgctgagacctccctagaagccgaagctgctatgcttcctgtatggcatacagaactgtgagccaattaaacctcttttctttataaattacccagtctcagatatttctttacagcaatgtgagaacagacaaatacaccatagtacctccaacctgctaattaagtcaggagtctccccctggttggctgctacccacaggctccactactggtgagtcgtagaagacaaataaaggcattttaaggaatagtacgacaataatctctagatacatctgcaatcaagtaacagtaacccctctcagaagctatgccagtatgttgcagatactgaacacacatctgttaaatgaatgaaaatgaatgaaagaataaatgattatacagtgtacttgtttcataattgtaactggtttatattgatttggttatatctgcttggtaccatgtgagttttgattacataaagatctacagtctttgtatgacatggcctcagaacacaagtcaacttcttcatctggttctcaacctaagaaataatgatctgttgcaaggacaggctggccatggtagaagtacgaagcaacattttatctacatagtactttagaggtaatgtaagagattttcaaaatcatgcttttacaatgtctacattaaggtctggcttttaactaaaaagtatgtgaaacatgatagcatttctagattgattccattcagaggtgcttttatttcacacatatatctcagaccaagggtaagtatggtaagaacaagtcactaggaggccagcaagagaggattaatgaatggaagaaatggaaaggagagtgaaacactggtaaactcatcccagctccagcaagaggggccaagatatctgagctagctggaacagcacaataataaaaataataacaataatgacattcactgtgagcaaaagaactctgtaagcaaatcaaaaatatcagtgctaagggtcttaatagctgattataatgaacttcctcatgtaatctcagggagcagaaaagagaaaatagattgtgcatctgttcaaactaaacatatttcaagctggaaccagcttggtgccaaagacatctctgtcacagagaagaaaaaattccaaatggaagaaaaattccacttcatgctcaaacaccatgaacttcgacaggaaaattaggtaaccactgcctcacttacaaggcaacgcatcagtttcctatggctgcagtaacagattaacacaaacttagtggcttcaaaccacaccactttcttatcttgctcttctggaagttgggggtctgacacaggtctccaggtgtgggcagagctgacaccttgagcctgacgcaggtctaaaatcaagttgtgcgcagaggtgacttcctttccagaggcttcttttccagtttctagagtccaactacattccttggctcgtggcctcttccttcatctttaaagtcagcaataatgggacgaaaccatctcacatcacatcactctgacctgcttttctgcctcccacctccacttctaagaatccttgagattacactgagcccacctggacagtctaggataatcttcctattttaacatcagctattgagcaacctcaattccatctgcaaccttaattccccactgcatataaggtaacacagccacagtttctggggattacgacatggaggtctttggtaggaggggggtattctatccagggatccccaaccgccgtgccacacagcaggaggtgagtggcgggtgagcaagcattactgcctgaggttagcttcctatcagatcagcagcagcattcatttctcacaggagcaagaaccctactatgaactgcacatgcgaaggatttagaatgcgggctccttatgagaatttaatgcctaatgatatagggtggaacagtttcatcccgaaaccactccctccaccaccgggtctgtgggaaaattgtcttccatgaaacaaggtccctggtgtcctaaaggttggggactgctgttctatattgcctactacaggcatcaatgtttcaaatttacttaaaaatctgttcaggtccagctaccacaaatacaagtgagtgcctctcatttgtgaaaaactgtgtatgtgtaaggtgtgagaatcctatcttattttgctaggcagagctgactatatgtgctctcagagcccccagaattccagaaaaccaaaatttaaaaaaaaatattgaagattaaaaaacagagagacagtgttacccagtgaagtttctaagagaatctacccactaacagacttttccccatctcaagttctcaatcattcattttgttacatttttttatatttgacaaatgatatctaatgcatttcattgctgttagcagtttagacacttatgagaaattaaaaccccattaagtgtgaaggcatctaaacaataccagatctgccttccactgaatatattttgggatgacaggtctgcttcatctgactcctcaacaagaacagcttatgaaactcacagttttagtgacagggcccaaccggcacctatttttgtatcacctggaaaaaaaaaatgcccacataggcaatacatctgatacagaaatgaaattaaatagaacaatactgaggcatcaaccactcagatccatttcactgtttcctattctgagacaacctaattgaaggtggcattccaaggttaaatcctagctctgacagcatctcctgtcagacacctgtcaaaatgtaataagacacctgtgaaagggaagtgatgccaaagccacatcattttcccctacaccttgattcctaacttgcaggattcatgtcacccagcaaacagagtggtagctgggtgctgctggcactgtgccaccatttgcaggtgagggagggaagggaagggaacacaaggggtgggggagagagagagagagaagaagagagagagagaaggagagagggagagaaaaaaaaagacaacactgcaaaaggaagcacccaagcgttttaagtttagcaaatgattatgagcataaaaggacaactctgaacggacttgaattttaggattcatccctagagtcttgatcatgatcagaagcagggaattattttttaatatctgttttacataattaaggggtggtagctttcatgcaaatgaacgctttgaatgctcacaacaccaaatgggcttcattagcttagctgggcaattatgaagcaggaagtaaaaagctgagataaagacttatctcaaaaaggtctgaagcagggcgtgttgatagccaagaggcacaacgatgcattttgtacatttattacctcggaggcaaaacttctaggattctagatagctttgaaagcagtgcatacattccatttaacacccaaatgaaacaggtggaatgtttaaagatctgtagaaagtcttgaaatcgttcccacacattggaaggttttaccaaaccttctctatttattctaagtgctttttctattgtttttcaattgcttctctcatttccctcccgtgtacatttcagagaaaattggagagcttaaaatgcgactaaatataacccctgcactaagcaaacagtgaataaatccttaagaaattatttttgaagcatattctttctgatttgatttaaaaactgcaatatcacatgtgagtcttgctcaggagaaaggctatttgttcacaagacgaccaagcatgtagagggaaagctgagggtgaagggactgaatccggttctcagctatttcaatacagatgtttttctagataatcggcctcattgtaagttaaagaatcaaacataaatcagatctctcacaggctgagaaaaggcaaaacaacagcctgttcgttctgtaaaaggaccattctagttggcctatctggtacaaccaccttgtttaaaagacagtaaactgaatccagcaaaagtttattgacttggtccagaatattactgagccaccaccacagccaggcttacatcccagagctcctgtttcccatcctgggctgtgtatattcttccacgtcacctccccaggtggctggctttgagaagaagggaatcataaaaagaccagaaataacatatacaccttgaaggagttgacacaggattttttcttgatcactttgcaagccagggacctctggccagtgacaccctgcccaggcctcactcggccatgctacttgctataggagatggcccgcccacttagcccgctcaggccgagtctgacttgcacactagttcccaagttcttgtcctgcgccccagcagaatgaggatacactgacaatcaaagaaaaagtcagggagttttattgagtgatgaaaacagctttcagcagagtggggatgcaggggtggtccccctatctgaaggcaggaaagtccacccaatttgtctgagtctggggcttttataggctcagaataggggaggggcaggcagtaggtagtactcgaaaaagcaacattagattggttcaacggcattattcagaaagaatcaaccaagaaaggtcaggcaaacagaaacgcaagttctcactctgggtcgcaggtttcatccaggaccagcagtctggtctttcagccttcaggctgtttctgttggttcggaggtgggatttcactggggactcacctctatctgactaggtatttggctgcctcctactgtcctcagagtcatctgttcatcagtttgttttccctgtaccttcctttctcacaaacattccattggcagatttctgttttgttctgtgtgtttcctttccttctccccagttcaagctgaggcagacgcatggacaaagaaaaacaaactgctggctaaatacagagcagagagtgtcatggaatgtttacagaggaaatggttttaggaaccagagagtaggaaaagctcaggctggggaaggggcaggaggatgcaagagggaatgactttagggtataaaaggaatggaaacggccaggcacagtggcttgtgcctataatcctagcaccttgggagactggggcaggaggattccttcaggctaggagttcaaggccaacctggccaacacagtgagaccctatctctgttattattaaaaaaaaaaaaaaaaaggaatagaagaactcgagtccttaaagaattagggtctccatgtagagtaccaggtggccaggtgaaaacatacccaaatatcaagtaaggacacccattggccagcacccccaaattttagtccagttattacacccaacttggactggcaatttatcccctacaggtaactgaacatcttatggtctgggaaatctaccagcccctccaaacagaagatgaggagcttaaatggaatagtaggaagggggagctttaccccttgaccatgatgggtctaaataaaatgagctgggaatttccctaggagcccagggtagtgctacaaagaggacacactgcccctgaggtatactgtgttcatttgggagctatctagtcccagttttccaagacagactccagggaaaacaggtctaccttgaacaacatgagtttgaactgtgtgagcccacttacacatggattttctttcaccttcacaacctctgagacagcaacaccaacccctcctcttcctcctcctttacagcctacttaatgtgaagacgataaggatgaaaagtctttacaatgatccatttccacttaatagtaattataattcctctttctgattttctttttttaatcttttcttaattctaccaattaattttttcttttttttaaaattttattattattatactttaagttttagggtacatgtgcacaatgtgcaggtttgttacatatgtatacatgtgccatgttggtgtgctgcacccattaactcatcatttagcattaggtatatctcctaatgctatccctccccccgccccccaccccacaacaggccccggtgtgtgatgttccccttcctgtgtccatgtgttctcattgttcaattcccacctatgagtgagaacatgcagtgtttggtttttttgtccttgccatagtttgctgagaatgatggtttccagtttcatccatgtccctgcaaaggacatgaactgattattttttatggctgcatagtattccatggtgtatatgtgccacgttttcttaatccagtctatccttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatggtatctcattgtggttttgatttgcatttctctgatggccagtgatgatgagcattttttcatgtgttttttggctgcataaatgtcttcttttgagaaatgtctgttcatatcctttgcccactttttgatggggttgtttgtttttttcttgtaaatttgtttgagttcattgcagattctggatattagccctttgtcagatgaatagattgcaaaaattttctcccattttgtaggttgcctgttcactctgatggtagtttcttttgctgtgcagaagctctttagttcttactaatattttcttttctctagcaaactttattgtaagaaaacagtatataatacatacaacatacaaaatgtgttaactgattgtgttatcagtaaggcttctggtaaacagtagtcaaattttgggagagtcaaaagttatatgtagacttttgactgcctgggagtcagcacccctaacccctgtgatgttcaagggtcagttgtattctgttagctcaccaatgtttacctgatcttacacttgtcctaacttctaatatggaaaggataggccaatgatatagtagagtgcttagatttgactgttgaccactggctctcaaagcctctccagtataactgcctctgcctcttcaccccatctcccactgtgcctaaaacccaacactccagccaaagagtaatcatgcgctgttgcctgaacataccccatacttgtctcctactagtctttgctcatgccagtcttcctacctcaaaggctctccctttgctctgtttacctcttgataacttatccatctaccaaccaagaatttttaacatctgaaatgattcacaaatggaatgggatgggctcaaacgataaaaataataatggctaatttggtgtcaggaactgtgctaagcatgtggaatacattattctcataattacctaagagggagctataataatcctcatttcatagatgaggcccaggagggtcaaagaacatttccaaggtcactcagctgggattctgacccaatcagtaggactttagagctgggctgttaacctgtaccctctatgcctctaatggtccttctaacactgtgaccctggcattttataatgtaactgtttctccccagatccctttctgaatgcccccaatgaggtgtaagccctccttactctggaagttatctcactggcctcacccgacatatttacatacttttttcatctcaccaaatacagatggtccctaacttcaatggttcatctcaaatttttttgactttttaatggtttactgggagtattaaatgcattttaactcatgataagtttattgggacacagctccatcatatgtcatagagcatgtatactgggtaagcttcatgaaagcggaaactctggctgatttacccacaatcagactgtctgagctgcagcagatattaaagtatttttcgtgaatgaacatctttcatgcttcacacagtagaagtgctccgtaaatggttgtggtgtgtgttgaattctgttcaaacaattatcaggaacaacagtcacagtttttcacagtagcacactggaaccccctttcttcactgtgagtgctgccctgaccctgacaatcaggtcaactggacagtctgttctcaccagtctcaatataggactgaaaagctatcttctccaaccaagttgtttggatcacctgaggtcaggagttcgagaccagcctgacccccgtcaatatggtaaaaccccgtctctactaaaaataaaaaattagccaggcatggtggtggacgcctgtagtcccagctactcgggaggctgagacaagagaatcgcttgaacccgggaggtggaggttgcactgagctgagattgtgccactgtactccatcctgggcaacagagcaagactctgcctcaaaaaaaaaaattgtgattttttgaaaccattaaattcttcactggtgtcatggtacaaacaaaatcacttgctttgactcttggccaagtccagaattgtgtcattttaaaaaactggtttttaaaaatcctaagttgtttccacctgcaggcataggcagaggagccttcgtccctcactacgctgaccccgagtggttccagtcccatcattccagaaacccctctctggtcttgtatcaaaaacaccacaaatcactgggattgctctgtcatggggtagaaggggctcgaggacaaagtttagcttaaaaccagagtgaatttatttctattacatatggttaaatcatgacttcttttctaatccctaaagctaaacagtagagtcatgctggagacacaccatcatctatgtcaatcagacaaaattaaaacagagaccaacatctccttgtttcatttaattttgttctcttgttactgcatgtgtgacaccaagaaccacttgacctttggacaaaaaagtagttatatataagccatgtatggctaaggtcctgttttcacaggccaggaacatgtaacagctctaattcttgttgactctatttctgaaatagagtctgaatatgtacacttctttctgtctcaaagtctaccccctaggccagaccaccattgcttcttacctggggaacagggcagtatctgctcttaactgacctgccggcccccgctccctattctaatcctttctgtatacagccgccagaagggcttgacacaaatgtaaagcagggaaccctgaccctgtgcttcaatgacttttcaatgcatggagaataaccaagcacattacctggcctgcaaggccctgcataatgtgatgtggcactgtacagatggccatgtccacctcgggccactctccctcacacctcctgcaccctgggctcactggcttcctctcacacctgagcacttgctgctcctttgacctggagctctcttctttcagctccccaggactggctcttgctcatccgttaagtttcagctaagtgtcaccttcagaaagtcctctctacctatgctttctacaaaggtctctgccttccctcacccaccccatgctattttctattacattacgtatttttttcttcctgctcctttttacacaaactgcaatgattgtctttacgtattgacttacttatcttcaattttccctattggaatgtaattccatgagggcacagcccttgtttatcttctttggcattgtaccccctattaacctgcaacacatcacatggatgtaaacagtatctgtgcaatgaataaattaacgaatgccaagttccatcacattccaaggtctgtcattacctgggcccctgccatcctttccagccttatcaaccagcgctctcccacatggacaattacgcaaggcacactgagccacttccttcaggaataggtcactttttcttgcctctgaaattttataccagctgttgcctctcgctaggatgtctttcttcccttcctcactcaagtctaattctgctcaaggatcagtttaattgttacttcctctaggatttcaaaagaatttttgaatgcaccaaggcaaagttaaatgtggcaacaatctgtcagaaaagctgccttttggtgggtgagtcccagaagtacagaaatcatggctaaatcgtacctttatcttcaatacaatacctggcacacaataggtgttcaataagtgttaggcaaatgagtgagtttaactaaattataacttcctgagaactaacaacatctcaatcactacgctcagtatagattgaggctgagggccgccaatgttggcagcagcaaagcctgcttaaatataataactacagctgcattgcacagaagtccagttagtgcagaagcataaagttttgagggtgtgtgaaaggaacaaagacaaagttcaggtgagacatggaagcaacgagaaatgcaacatggggcgagtaagccagcactttctgctttcacttctatcactttggaaacatttagtccagaatgatctgggggttcttacttatggttctaagacagcctccacattcctcagcatgtccagtcacaatcaccatctccccaagaaggcacaaagtaagcatctgtaaatccatagttggctattttggaaaattagtgttaaataagaataaaaaaaaaaaacccttcacctttatgtgtaataaagcactgcttaacaatcaaggtcacccatgtcaataacactccccaagcaaagcttcatatctttttaattcctaggctcataaagaccattgtcacttacatcattacaggattcaagggagaataacataaagagaatgtgcaggataattttcaaaataaaagagaaaaaaatgacacatctacatatcaaaccacacaagtcccgtgtctgataaaatcacaattatagatttggtgcatttaaccagtcatacatgccatgcatttgcgaaggtgccatatgggggagttgtggaaagtcaaataattcctagactttttctttctgagcacatgtgacaatgaatattatttacccctgtagtatagaaattatgaagcttaagaccccattgcttctttttaataaaagctaacacatcacagcttactgcttgacccagctccttggtctttgcacgttctcctctctgggcagctctctctcagttttaccccctaccacaggaaaggagacagctgtgtttctagacttgacagacttgtttttacttgataaacacattgtatattgtaggggagaaaacgatcacccctattcccctccttagttcttatgtgggctctttggcccgatctaggaaccaaattgacacaacacagattaacaaagaaaggcgtacacattttattaattttacacatacatgggaatcttcacaagacagtgaagttcaaagaagtgaccaaagcaacatgcttttacacgttttagacaaaaacaaacaaacaccacgataaatttgtgaagaaatgacaggataaaaagggatctggctagggaaaataatttctatgggagtgaccaggagctatatgaatgtaaaacaagtagaaggtaaggattatttcaggaagtttatttgctcagacacattgcagcacctaatcacagtctccactgataaggaatattctcttacccttgtacggagaaggcagccctcccaaaagaatctttatggcttgctacgtgtagaaaaagactggtcagttagccctctgcaattatactttttccaacgttttcagctcgaaataatcaacataccaattcgcatattctgggatggcatgtccttcactgcttcaggaatatgttttcctttgtgctttacttggatattaagttccaaccaattttaattacatgtcgcttgtgcataatattgccacttctaaaaagcagatcactttctgagttagaaagcttatctgctttccctccttatagacacttctgaagcagaaaggaagtaattcctatgctcctatcagatatgggctcatatttctgtttcaaatttaagtctgtgacccctacatgaggccaggattttgagaagagtgaggaaggtagactctttttaaaccatgccacaggcaaaaactcagaactcattttggggaggaaaaaaagtcctatcaaaccagtatactataaattaaacaatgtagcatcaaagataacttttcctttagttgttacccctgagtggtcacgtagccataagaaaatcacctccttgtcaacacatcatcaatcaaccagtgttcattaaataccaactctgtgctagaacctgcttggtataaagaattctattttgtgttcaatgtgtgcattcagtgctttgattgtaattatctttgaaatgacccaaatcattccaaacaactataagtgactttatattcagaatagcaaaaagctgacttgaacacacaatgtaaaagtcttgaagagagagtgaattaaacttttttttttttttacaacaatcagtgggcttatagaatagaaagagaaagagggggagaggtttttatcttttagaattgcaatgcagtgaatagtgatactagaagaacaatcaccaaaagattacagatgagaacttcagatgaaaataacaatgaaacaaagcaaaattcaattaatggccttagagaaggtgagatcagaaagagaaactgaaagttttttagacttctctttaagacagataaaatttagaatttttaaaaatccataataaaaaccagaacaatgctacctcgccaaagttgagttcaaatttagtcacttcagtcaccaagaatccaggaaacttagttactatgggaacagaggtcctcctcttcagaaaggagggcagtgtttctttcaaattccaccagctaaattcaagatcaatgatggttgtttaatatcctctcttgaagctcttactgtctttagtatactttaaaataaaataaaaactcaacaataatggagctcaattaagcataatttgtgtgcttcaacctttggctgggtgactgctctgtaccgttcacacttgtactgtagagcattgcaatttttaattaagatcactcattctatttcccctgaaccaaccaatgttgaggttattgtttggatacaaaactctccaggatacggcttcacttaacaaggactttgtttctttcaagtaccaggcactcactggttctgagtataggctgcctgccctactttaaaatgcatctcaactttatttcagagacagtaagatttcattgttactctacaggacttagaaataaatgcatgcatgtactcacacacaaaatctctcgataattttgcatataatacagtttttgtgctctatgccaacaaagaacagaatgtttagtaaatcacagagaaacacttttatttcttgagactgagatatgtgtggcttctctacttttctaggaattacatttaaaatgtaagaggacaagacctcattcaaccttttatgcctactttagtgatcagggtgaaacatataagaatattgcaacaccaaagctgtgtgtcactactcagctaatggtacctataaagaaacttctcttaattagctttaccctgaactaacttcctttgctctgccatgtataattaaatatgttagcaagacagaaatgtgagatgtagcagctttcacacccaaatttccgactccaaatttataaaaagtgtggatttttttttagttgaaagcccatcatgaagtattttacttttactctaaaaactttcaaaattacattaaaagaagaaaaagaaaatgggcaggaaaattagtaatgagagatgaattttcagagaaaagaattctacagtagtccctcctgatctgcagtttcccattcagtgctttcagttacccttggttaaccatggtccaaaaatattaaatggaaaatcccagaaataaacaattcataagttttcaactgcaagcagttctgagtagtgtgatgaaatctcattgtctctcactctgtctcttctggagcgggaatctttcctttgtccagcatattctggctgtatatgccactcacctgttagatacttagtagctatctctgttaccagatcaactgttgtggtatggcagtgcttatgtttaagtaactcttctcttacttaacgatagccccacagaagagtagtgatgctgtaaatttggatatgccaaggaaaagtcccaaagtatctcttttaagtgaaaagtcaaaagttcctgatttagtaaagagaagtcatatgctaagggtggcaacacctataggaagaataaatcttctatccatgaaactgggaaaaaaagaaaaattcatgctagttttgctctcacacctcaaaccgcaaaagtttcaaccacagttcatgataagtgcttaattaagatggaaaaggcattaaatctgtgaaaggaagacatgaacagaaatgtgttcgttcctactgatggcaattaggttcggtaccatctgtgatttcaggcacccactgggggtctttgattgtatcccctgtggataagggggtactgttgtatatcaaacaaaatctgaggtgcccagccaaggacagtgctgcttcccagaagagatgagactcccctatcctttctatcttcccaaagggtgcatgtagtgtacgcccattggtctctccctttcaggagtgaatccaaaagccacaatattgatggacggcaggaaacgtccagtatctgggctctgaagaaccttgaggatagaatccagctccaatcatacagttcctctgtatggataccttaaacaaaagtgtattttatcctttttaatttggcatcccttagaaatgtgaaacttccttgtgaaaactgctctttaaggaaacgaaacttttttattgtaagccttcccattgtctgtatataattaagaaaagatcagtgatagttcacggtggttttataataggtgaattaatcagttttaaaaagctgaattttacatgcatttgacaaccaatctgggcactattttcctaggaaaaggctcatttgattaaataaattttaacctttaaaagctttaattcttttttttttttttttttttttgtacacaaaggactcttttgtgatggttggatcaacttacacatccagagcacatgtgcatagataaaactttgcagtaaactatcctgttacagatagcttttcttacacataaaaatacattctgatgagcaatctaggggaaacaaaactaaaaaaaattaaaatacagatatacaattcatattctaatcttatcagaataacctactgttaaaacacaaactgaggcaggataaaattttaaagagtttatttgatcgaacaacaattcatgcattgggcagcttctaactggaagtcattcacgagctccacagagggaacatgatgggtggacttttataggaaggtcacaaaagtaaagcaagtcagtatgtgactggttatagctctataattgccttatttgctctatcccattagaaagtcactaaatatatatacataagtttgttggctacttccaactggacaggcttaagttctgttttcctttaatataggcatttgcaaggaatagcttaagtttcacttaagctttgcaagccaagcaaggtttaggtcacttatgaggtctgatatcatctgtttctttcaggcctagtctccattttaatttactttaacactatccataagaatattaaaaacaggcagcagatatgcagatattttatcaatacaaccttttataaatacaggaaagaatagtgttgacagtctaaatttgcttccttgaggcattatctgtttgaccagatttaatcatttaatttgaaacaaagaaacaaatactactctggggttgctgtgaaaggacattcagagtggacaaaacctctttaaacttttcttcaaggtttcatcttcacatatatgttagtttggttactttgacagattggtcaacttaatccaatacagttttatgggtccggaaagtgctttgcttgactttgaccgtatgtgtcatgtcagttaagttaaaagctaattcaatgtgtccacttcggggttatttccatcataaggcattatgtttttacttgggttgtatgggggagttcctctgaattgactagacagatgggaggtttagacacagtttaatattctgtacttgcagaagcaactattgagagctttgattacaactaaattcaagctagctcaaaagttggttctcagccatttaagtcaaaaggttaggtaatgtcactccctccaggggttcattgtccagtttttctgtgtattcattttgtttttatttcatgcctatctagtacccacccctgtgtcccacctatgcctgaattcttactgtgtaaactcttttggatgggaaatgaccagctcctgctactgaccacagccctccctcttgccagagcctgaaggacaggggactcctagctcgacagatcatgctaaaattataccttgtgcttagcatttcttggcctttaatcctgtcccagttacttctctttttttttttttttgagacagagtctcgcttttgtcgtccaggcaggagtccaatggcttgacctcagctcaccacaacctccacctcctgggttcaagtgattctcctacctcagcctccccagtagctgggatcacaggtgtgcgccaccaagcccagctaattttacatttgtagtagagacggggtttctccatgttggtcaggctggtctcgtactcccgacctcaagtgatctgcccacttcaacctcccaaagtgccaggattacaggcgtgagccaccatgcccagccattccttctcttttctaagatttgagttctcattgttaatctggtaattttctttttcacaccagataagcagagctggtttctgcattgctaactgggagcttcctaactaaaagagcctcacaaacagttaattctgctctagatgctgtaaaagagggggacgggggtaggggcagggagagagagagattacagtgataaaatgaaaatgctgtttcagccaggaagttttttctcccccatctcatatattaaaatgggcctgattttctaacttcagcataaaagcccagtaagaaatattagctcttcagttaatgtcattcacacaaggaatttatcagcagagtttgtgtttgaacttttcatgtcatctcacgcatctcagagggtattaaactccataaaacacaatcccaaaagtgaaatatttcccacttttactctataagtgagtcttagggaacggaaaaaaaaattccatgtctggcttattcctaaagagagagtaaatagagatatttcttgggccaaataatgagaagaatcacaacccttagggtttatgttccaaaggcctccaaatcccaacaggtccagcaaagcagaacagagaaaggggctgaatatacatgaagagaataacagaagcaagtggttaatggtttccttaaatgcggcagaaaatggcttatgtgtacctaagtatcctatagtactgagacttaccaagaagaaaaggtgaaaatggaacttgaggcccctggaagacatgttcttagctttgcctgctggctttctgcataaatctgacctttctgcaggtgaagttcttctttacagcccagtttctcctcttagttggctactgacccacagtagcagccaaaattaaaccaatgatgtatttctcgtacttccccaaatcacttttctttaaataagttaataataatccaaacttgcatttttcagctgagtgctttgatacttgcttctcaaaaaactacttggaaggtaaaggagttttcttttcgagacctcgatcagaaatactccatgattcacgcactcagttaggcctaaattagcccaatgttatggctataaaggaaacaggaaacctgtgttccagggacaatcttcttcatcactctattcccagcgtcctctcatatgaggacacggggggttgggctacctccatagaatgataataaaagtttgcctccaaaataatttggaatttttgggttaagcatcaggacatttcatatcatgtaatatactaacattcagtataaatctctaagcagggtaagtgggctcagaataagtcacaatctctcaactcatttcaccatcttgaaaatttcttccatggagcacaaagatgaactaagtaatcaccacattcctcgcaacatttatactttctgatcaggacaaaatgattctaaggagtgattaaagcagggtaagagagtcttctcaccctaatgaatccaaagatcaccaaatagacacccagtttatggcttagtgatgtaaaacaggtgtgattcagagccaagtttacgtaagttcaaattctgtttccatctttggtagctgtgcattcttggataagttacatcacctccgagcctcagtttcttaatctgtaaaacagacatactaacatgacttcatagaggtgtttgaaatagattatctaaaataagcaccaagtgttacatataatggttatttcagttattcattgatttaattcaattaccattaaggttgagacctggtcatcattacccagttaaggaaggggtttgacataaaaaccactcaagatttcttcccactttaggactttatgattgcctttaatttttcatgtttcaattatgtaactaaaatcttctattccatatatatcagaacacaccccatctaatctctgctaagtgtttctctactctgcctgtcccatgaaacaattcccaaagcctaggagagtctcctgtgatacagataccaaaatgacgtgggtcagaagtaactcatacatccatattgtcagaggtgaactatacaaaatactgagtacactacagagtgatctgataggccaagaagaaaaaaaagtaatctgatagaccgagaagaaaaaaaaagtatatgttgtttctctactaaagaatgtcaccgcatattgatttttctagtcttttacaaagactgtgttcagaatttagatcagtgttagagaaattcacttataaattcacatatacccgtatataaggatacagtcctgtatctaaggataaagtcctagcttaaatctggaatgagtaaaaacaaagtgtaaagttaaaaatgcccctctggtaagacaaacatatgcttttcacccaaaggtgcagttaaagaataacaacaaaagttggtagtgagatccctctaaaaccactgatatataatagactcctactgacaccctagaaaaatgatgccaacccatgcagattagtttcttccagcaatgtaattacccatttctttggggctatctttccttcaatggtgatttgagaaatacctttcatttatactccattttgcacaaataaactacatttaaagctctataattagctgtcctttgctactgtaaaattcagtgtttttgtccaaaaggaacagactattgatttacaaagaagctgaaatgctgtcaaactacccactgaagaagtaagaaaaaagtggtccctatcttggctctgcctctagactagctcttgtcctacctcagctttgtatccacataccgagccttctgttaaggtttagacttgcacagccaaggcctcccaggcatctccccattgacatctaagagacacctcaaattaaacatccaactctttgcctgaaacaccgttccttaagggctttccagattagcccttttttgcctctattatttgtatctcttaaatgcttactattgcaagatgtagaaaatcccaactaaaacgggcataaaccataagagaaattattgtctcacacactaagataagtggctcagtgaagctaagtatgggattatttctctttgctcatgaaagcatcaatgtgtcagttgggttcaagtacaagaatcagaacccattctagatattttaagcaggggagatttaatacagcaaagttggtgctggagaaataacttggagggctgaaagtacaactctaggtagagccttcagtaaggactcccagaacaatatcccattgacctcatggaacttgtaaggagccactcctcctgaagctgtcttggagccatagtaaaatcaagaacttgtcaccattacaactgactctactaatgcaagaaaccatagaatgcttatctgtagctgtggtcccgagtttcagaagcctgatcatagcgctgccactgctgcttctgccatcccaaccatttcgtaaaactcagaaagctggagagtgggcagaaaaacacgactgcagggaacctggacattgccacagctacgtttaccagcagaaacagccaaaggagggctgaaatatggcctccacatggctttcaccttccacacatcacatatacacatctaattggagaagactttttttgaagctggctaaaagagaatctgagaaatgatgcttttagttttgcaacaactttaacttgaatgaggatagaatggaaactacataaattcatctagagcatacgaaaataccagcttcctgggtgagtctttacataggagcatgatggaagcaagcagcaatcaaggctgccacagcctttgatatgttctaacagtagagaagaaaaaaatctctttcctggctatggcatagaaggccttcctttactccttatggaaccactttaagccatttgctgactcacagtcgaataccactgaccatggaatgctatgggctgattggctcagatggacaatctgttgagtgtcaaccacagtgtagtctatagtgtgcctgcttacataacatctaatcattgagggctttcctgaccatccaatctcaagtagcctcttctcctgacccatgaattctgtgtctgcttaccaataggtaagtcttcatggcacttaatgcactctgaaattatcttgccaatttacttatttgcctgctccttatctcctttccctactaagacgcaagctctgtgaaggtaaggatcctgtctttttcacgtctgtatccccaacacttacagcagcatgaaacacataccaagcattcaataaattgtttaatgcataaatgaataggctataatccatgtactacagaaaccttaccaataaaatgcttatgttcttcccagttaggccagcttagcagtttatttaaaaggggatgagaaagagagagctgttcaacgtgtgtgtggccatacacagtgaatctactaactggttagtcttttgggattcagtgttacatctactatgcgccagtcactgtaccctactattagcgatgcataaatcagaaatcttggcccaaaggaggactactggtacatgaagattaagattctacgatgacagctgcattggaaaacagtatcatgaaaagtgttttggagacgggtgcacaacaatgtgaatgtacttaacacttctcaactgtacacttaaacatgatcaatgataaattttatcattgggccgggcgcggtggctcacacctgttatcccagcactttgggaggccgaggcgagcggatcacgaggtgaggagatcgagaccatcctggttaacatggtgaaaccccgtctctactaaaaatacaaaaaaattagctgggcgtggtggcgggcgcctgtagtcccagctactggggtggctgaggcaggagaatggcgtgaacccgggaggcggagcttgcagtgagccgacatcgcgccacagcactccagcctgggcaatagaacaagaccccgtctccaaaaaaaaaaaaaaaaaaaaaaaaaaaaaaaaaaatatatatatatatatatatatatatatatatatataatgttatatgtatcttaccacaattaagaaacaaaaataaaaataaaaaatacattataaaacaagcacaaccttttatgtaaattacttacttaatcctcataatcagacaaggtaaacagtatgaatattcctattttaaaaattctgacccagtaaggttaattagcttgatcaagtttatatagctacttaggagcagggctgcgactagaatttaaaaatctccaactcctaagatcatgagcacacagatacacaaataagcaatagcatcatgttttcaaacagtctggtctcttccctggctctgtctgaatgacagactctcccattgtttcttgtaaacaggcaattaattgtacacactaatacacagaaatggcccttaaaataaggaagaacaagagaaatccttttttttttttttttttttttttgagacaaggtctcagtctgtttcccaggcctgagtgaaggtgcaatctcagctcactgcactcttcacctcctggactcaagtcatcctcccgcctcagcctcctgagcagctgggactacaggttcatgccaccaagtccagctaatttttgtattttttctaaagatgaggtgtcaccgtctttgccaggctggtctcaaattcttgggctcaagcaatgcacctgtctcagcctcatgggaaatcttgcactgatgggctaaacttattcaaaaagaaaaatcttccttaaaattaaaaatgaagagtaatagcaattgttggaagtgtactgattcaagggtatccaggtcaactgacagaagagagaggccagaaaggaatcatagtatactgaaaagccgctgtctgataaaagttggcaaggcagattctaggaagaaagagctcttcaacaaacaatggctaactatttaaggaaaatatgttacattgttttctcatctcatgtcaaatattaaaattaatcacatgcttattaataaaataagagcagaaaattgagccatattatacacagaagaaacttttatctggattaaaatagattttaagtataaagatcttaaaacaaaatgacaaaggaaaaaatgaaacataacgccccagaaaattaaaactttcagctccccaaagccattatcaataaaatgaagtgaaagaatagggagaatatgtattgaaaaaagtattaaagacgaagagctaacatcttcagacagagtgctattcaaatcaatatggtacaaatcctttattagaaaactaaatttaaagcatgagtagttcacagaataagaaatatatgtggttaactaccatatgataaaatactcaacttcactatattcaattaactacgattttaaataataaaacggtaattttgttggaaaaataggcagagtattttcatttatattcaagtcttcagaggccacaggtatatgtcactataagggaaaattggcctacatatcaaaatatttattcatagcgttctggcaacttatgccaatgtaatgatcagagacccacacaaagattagttgtaaaacatttgtcacagttttatgtataaccataacaaaactgtaaaaaactaaatgagagaacaaattctgatacacaaaggtgaatacttgaaagacattaagaaatcaggttttcaatacttcataaaatgaaaaagtattgacatagtaaagtataaaaaagtagaacacaaaatgtacaaacacgaataggtattatgtgcatgtataatacatatatattataaatctacaaagacctatccatatatgcatatatgcatttagataggaattttttaaagcactggaaggaaatttactcaaatgttaatgatggttatagatgagaagttgaattaatgttaactcttctctttatttctctccatttttcaaatattctttaataaattggaagtgtattagaaaacatccaatgatgtcatgaacactcattccctagacatattaaatctgttagcgttaactatagactagtgtactatgctaaggtgttatgacaaagaaaaagaagcagtagacagatacaaagacattcctgacattaggagaacttctggagaaagagacacatgttggtacaaaggctgtaatgtaagtaaagtagaaatataaacaaaaaaagcatgagaattatattgtagttgaaagccagaaaggcttcctggaaaaggtggtgtgtaacttttatatgaaaaagctggagccccatctcatggaacagtggcacaaagtattctcgatagcgggcatcaccatttgaactcgatcctcagccttcaataaaaatcataaagcccatcttcagagcccctcttttcttgcttctccataaattatgtactttcctcttttctcacctccttgagatactgtttacctaggaatgagacaattcattttttacagcccatcatgaacaattctgaaaaagaatcccctcattcattacaagacagtatgaattaaagctcaagaatgaactcttcctggcatttctaattaaatatgtagtctacctatcctctaatggtgaaataaaaagtagccccaatattaaagcaattccaaggatcaagcaagcaggtaaggcagattggccaagaaggaagagcaaggcactgagaaatcacaccatgacgcaaatgactttctctgttgatatgaaaattttttcctgccataggtgatgttgatattctaacaattttaaaacacaaaaaaattaaggggagtaacaaaatttcccttctattttttgagttatttaccgctaacaatctcccctctagaaaaagttacggaaatattgtacaaaatgcaccatgggttaaaaaaatgatttaaatacaggaaataattgttattaaatacatcttctagggagatccactctgtcccaatccttaaattagaaagtcagcaaaaagatgaactgaatccctgatgttaattgtacaggcttactggattagaactagagataattaattgctaaattttaatatgcattggactaaatggctgataagatttccagtagttggcttgaattccagaagggaatgattatttcttccccggcctgggagccctacaagccgaagacatttaaaatgtctgtatttggaatgaaagaagttgggtaaatagtagaataggttacagaatggcaaaaacttctagaaagaaaatatggaagttcaaattgccttttcccatttgaaatttagaatataatactgtatagaaaagaggatttaaatttttttatttttattacagcttcagtgattagcattcctgtactataatgtcaatattaaatccagacagacccaaagtctattacttcctatctaaaaaaaaaaaaaaaaaaaaaaaaagacactgtttatcacctaggtaattatattttttatgttcttaagaatttaggagcttgctatggttaattgggaaaaatgtgaattatggttaagtcgtgcctttttttattaaacttgtaacaaagcaaatgatgaagaaccaacaacttgccaatgctgagggtccagatgaacagacgcgcagagaatgcagatgagctgattccattaaaaagttggctgcaagggtagatgatgaaggttaagaagatgtaggactatagaggccaccagtgaaaaggaaaaaaaaatcccctgcttcctctgtacaaccttcaggatgttcaaggaggaagaaagaccaccaactgcagggtcagtacccagatgccttaggatatccatgaggctgtcaggcaccagtgaaaatcaggtctggttgtgcatcagaatcacctgtggagtttgttaaaagatgggattctgacctccattcttgcaaaatgctgatgatccaagcggtgagtttgagaccaaggatattatttatcttttaacaaacctcacagtaatcgtgaatgtacagcaaggtgttataatgtattttgatatcttattttttagagacagggtcttgttctgttgcccaggctggagtgcagtagtgcaataatgtctcaccgtagcctccagtttctgggttcaagcgatcctcctgcttcagcctcctgagtagctaagaccagaggtgcacaccaccatatccagctcatttttaattttttttttttttttgtagagacagggtcttttccaggatggtcttgaactcctggcctcaaggaatcctcctgcctaagcctcccaaagcgctgggattatacgtgtgagccactgcacccggccctgttttaattttttaaatttaacttttaaaattcaaatataggtagcgttttggtaatctcttattttaatctgaatgatggaatatgtcaaggggtgactgacagtagggaggcataatactgtcaggagcttcctacagtgctttcttcaattactttagaatctttggtctccccagaggtaaagtgactcgcccaaggtcacacagtgaattaacaaaaataagaaacgaatgctaatattagaaagtacatacctcctataattacttgcttgggcaataaactagaagttagtaaatattaagaacttcagggtccgggcctgtaatcccagcatgttgggaggctgaggtgggggcggcgggggggggggggtggtgaatcacctgaagtcaggagtttgagaccagcctgggcaacacggcaaaactccatctctactgataatacaaaaaaaaaatagctgggcgtggtggcgggcacctgtaatcccagctactagggaggctgaggcagaagaatcacttaaacgtgggaggcggaggttgcagtgagctgagatgctgccactgcactccagcctgggcaacagaggaaggctccatctcaaaaacaaaaacaaaaaaaacntcagggtcattaccctatttcttcaatttttaatttattttttatttttgagacagagtctcactctgtcatccaggctggagtgcaatggcacaatctcagctcactgcaatctctccctcccaggttcaagtgattctcctgcctcagcctctcaagtagctgggactacaggtacctgccaccatgcccagctaattttttattttttgtagagacagggtttcaccatgttggccaggctggtctcgaactcctgacctcaagcaatctgcctgccttggcctcccaaagtgctgggattacaggcataagccatcatgcccagcctatatttctttaattttaagatgcctattttatgtttttaacataaataaatgaagatgcatcttgtaattgatatgtttaatatggaagcactcattttttccaaaatatgaaatcagtggtgtacttacaactaacagcattataaaatccaggatatatgggaggggtattgcatatttattgtttctttgaaacaaggttttctatgaattaattttgtccctgtatgggtactgtcatcgtgtcgggtaaggaaatcaagactcacctgtgctagaaacctggaaataaactgttggcatatacttgcctcctatggtcagcatctaaccactcattgagtactggtgactcaatttctacctcttcaggcttttttcccttcccagttttaaaacttcaaccgtccctccagtgtagcactaatcaaatctaccacagagctgtcacatttatcctcattaaacacatacttgattccatgacttcctttttataaaactctactggctccccagtgctttcagaatcaagcccaaataccatcaaatggcatttagggtcctgtgaaatctgtccttaccctgcctttctggtatcacagtcatcagctgcttcttccctgcttaaaaaatcagcctaatcaacattcctgaagcttacggcactgttaccacatttctaatagtttaaactttcaaggcccagcttgaacatcacaccttccaccaaccttttccagtcctctcattaaaatcaatttctcccatctcagcattcccacaatatacagcacaatgagcatgtagtcttgcctgatgtatgcctgtctgtccacccaactggacagtaaactctctggcagcagaaactgggccttaatcatttcagtttcctccacagagatcagcacagtgcctgcacgtagtagttatttgctaagcatgaaatctttaacaaagccagaattgattctgaggcagggttaaagatattataaataaaacttcactgaactgaaattcatagtcccatgcagggcacctgcatatttttattaggtttcaccatggaaggcataattttaggtattattatgctgatgaagcacaatcttcctgctccaacttggccaaacccagggaagcaatttcctatttgattaagagtacgacagcagcgaggactggagtataaaaatttactgtagggttgagaatgtaagcttaattgtggatcaaatgggaaacattctaaacagcattttttaaaggaagtatttgaacagcctattttaaaatattcaatatcatcttcagcaataggcaagttttggaaactagcaagtttcaagacaggtactcactcattctctcttctgcaggatcctaaagatggtcctggggactatcagttacttaaatgtctcaggttattaattcttactttaattatatctcagctaagtgattttttttttccaccatttgctcacatagcagcgaacaactttacactgttatcagtcttcacatagcagttcccaaattttgcctttaggtttatatcatgtgcaatgagttttaaaaggctttctccacaaaatcataagagagccttaagagtttcattctctgcctgacctcctgaaaccctcaaaagataattaaagaatcatgaaatcttcttgtgatttcatttaaaaaactttttttaaatcattgatcatgtcttcattctactaaaccatttaagaagtgggcaatttaaactacccctataatggttcactagcctcagcaatcaaggctgtaagaagacagaagcctatgtccaacattattattagtagtaattatctgttacatattaatgctactaaagtaaaatgtgatctatatataatcgataatatgactataataatgtatataacaatccaatatagtttccccctttatctgctgtttcacttttcatggtttcagttacctgcagtcaactgcagtttgaaaatacatgtgtacaggccgggcacagtggctcatccctgtaatcccaacactttgggaggcagaggtgggtggatcatttgaggtcaggaatttgagaccagcttggccaacatggtgagatcccatctctaccaaacataaaaattagccaggcgtggtggtgcgtgccagtaatcccagctgcttaggaggctgaggcaggaaaatcccttgaaccaaggaggcggaggtggcagtgagctgagatcatgccattgcactccagcctgtgagacaaagcaagactctgtctcaaaaaacaaacaaacaaacaaaacaaacacacacacacacacacacacacacacacacacacattagccctgtgcctaatgtcacagtgccatcccttggtcccactccaacaactatgtatgaaataaacctgtgatcctatcagtcatatcccttctccaagcctccctttctgaaactctatgcctctaattctatgagacatttcacaatgttgtatctacagtcaactaagaaataatatatttgggtttatttcactctttgctcaaaccaaggataatttatcaggcctgctaagtataatctgctttcctaagtattgtgagaaatatgaaacagactacacttgcaaatcttaaattgtgatagaagaaatgagagaatgcacaaaagttttcttttcttcagaagagaaattgcaactaaaaaaaaacgcctagagataataaaagagacgttagaaagcaacacacaactgtcaactcaaatgtactgctaattactctagaaagaagtgttcagcattctaataaaaacattatattagtataatgtttgtcattaacaaagagttgcttacaaccacatcaacagataagatcctatgatacgtgttgtctggggcaaagcagggaattgtgggaaatgtaaaacaaatttgtgttgaatcccggccctcagggaacatttgagttcatgaaataaaactaggaatcagaaagactgggcaagatttgttttgctaggaattcaggatacatgaatccatgaggaaacatgaacgtcttggaactcgaacaggaggtggtggtaaaaatctaggagttaggtaaacagtgtctagccacaagaacagaggaggggtttaaacctctaagagatcattttatgggaaaaagcagcccctcctgaaaacattcaattcaggacacgaaggacagatagacactcagagcctcagagaaaaaagtatctggtgaaatctcttctagaaactttggctggggagagtttggaatgttgacttaaagacccacagtgaagtctagaaaaagatagaggcagcttgttacaatttacaccaacaggaaaccatttagaagggaagaataaatgttagttaaactttaaagattaaattacaaatttactcaagtgattttaacttttactgcacaagtagcaattttaagtcataagggatctgaaatgtttccagagttttaaaatggactgttttacacaagtgaaaaaaagattttggcttctagtgctgagcacagagcaatcctatgccttgtaatgggctggtataattgtgcagtttcattaaaataattttattactgacttcctagttttctgttaattatcatttcagagtaagaaaaactattacttttaaagcctatattaaagtaggcttaagcaagcacggaaaagaaagccagtgagagaaaatataaaaagaagctattaatattaacagttacagttggacacttgttcatttcataaatctttgcagtattagcaagattgatgagaagtagtacaaatgagaagcacatgagataagcgatcatttgttatcattactgaaatataaagtatgattcagtgtttcataatggatgttaaacttgatttaacatatggttggctcatttgctgaaaactatccttaaagacataaactcattctaaagtcaaagacattgtcttaataacagtctctgaattatctttctataagagactgagtaacctcaataaatacaaacttagggagaagttgtgaaaaggctgttccttaaggagaaaaaaagcaaatgtgttatatactctgattcattaaacatattatagagaattctaaaatatcgttgaaagagtaaagaattaatgtgttttaataccaacacagagtcttttgaattgattttcaaatgatgagtagagaaacccaatcactgctgtcagtgcttcagcagctacctaagaaatcctcctttgtcaacttcatttctctaatcatgagagaacgccagtgcccactttaagtttagtggattaagcagaccactgcaagtgctgctaaaataatttataatctatcattatacttcagtagtgatagtatactactgaatgagaatacactggattctcattcaacctggaatgagacacttaaaaatatttgttacatgagtatattcctatccacgacttagttttgtctgaattctcacttccattaacagaaatgcactaaaaatatatatatatatatatatatatatatatatatatatatatagagagagagagagagagagagagagagagagagagagagagagagacagagagagagagagatacaaagtctcactctgttgcccagactggagtgcagtggcatgatcatggctcattgtagctttgaactcctgggttcaagtgatcctcctgcctcaccctcctaaagcactgggattacaggcatgaaccactgcacctggcctacattttttttaaaacaacaatttatgtacctcctagagacaccagaccagtttgaagactagccgtcttcaacagtccctgtagcaattatgctcagaaaggcttatttcttgagctagcaagtatctgccctaaaaccaggttcattaataaaatgtctatctttcaaaaaaaaatacttgaatcttctgttttccctgatgtttgtgtctttcttcatccttggatacctattcttataacacagcccatgctcatctgaaataagtgacttcaagtcagctccattatcctgcatcctgcctgcaaaaatgatctagatatggggagtagtgcttccccttgttctatacactatatcaatataagttgttagactgcatcttctttaatcaaagtgtcatctaattcacatttagccatcagaagcatgtctaccaaagagcaatgcagccaaataagctttatgcacccatccttaggttatactccttagctaatgttactcttatttggcattgatttgatttattgacaacaaaaatacccatgtttgacaccaactagccttgatgtgccactattactgactctctcgactttgctcccccaatttgtaaaatgagaagtccaagctttcagtgattcatgaaagcagagtccactgtcagcctggccacacaactagcccctgaggatcttgctaggggtcaaaacccacatattagatctgatggggccctccaaattctctattttagtaagttcccaaatgcttctcacgcatgtctcttacagaatagatatagctgaaacaatctacaatattatatactgaactcattcaaccattagctcaaaggaaatgcatgctaaaccagctgcacaatccactctgtggagaaatccagcagccactccaagaagctgacctccaaaggtcatggagcaagatggagatgaagagccagccagggtctagagttcccactttgctctcttaccagctgtacaactttggacaagtctgttaacctctcagagattaggatatcttttctgtaaaatggtggtaataaagcctaccttagagggaaattgtgcaaattaatttttaaaatacacatgtaggccaggcgtagtggcttacgcctgtaattccagcactttgggaggctgaggcggtcggatcgcctgaggtcaggagtttgagaccagcctggccaacatggtgaaaccccatctctactaaaaatacagaaataagccaggtgtggtggtgcatgcctgtaatcccagctactcagcaggctgaggcaggagcatcacttgaacccgggaggcggaggttgcagtgagccaagatcatgccattgcgacagaacaagacactgtctcaaaaaaaaaaaaaagtgtatatatacatatgtgtgtatgtgtttgtgtatatatatgtgtgtgcgtgtgtacatatatatatgtacacacacacgtatgtatatgtaatgtacttacaaaatgggaggagtagagacactcgggaggactgcatttggctttattcattgttccttctggtatagcagctaacacacagtgagtacactaaaaaaacaatgctttgaagaaacaatctaatccaactacccatgacacgtgttattcattcagaacagtttattgagaggcctctttgtgtgaaacactgtgacagtccatttgctccttcaaatctcttcctccccttctttctctgttctgtgctgcagaaggctgatctatgtggactacactgacaggccccttggtgttctggcttctcctgcaagttggccagtgagggcttcataaggataccaaatgagaggaaaaacaagaacttggtctgatctagcagaaagatcagaccaaggccccaatcacagagatctcctgtttctcccaaagtactctgttttcccaaacatctctcctactgtgttgcagtaccactccctcaccttatccctttgggcttgagtctttaaaactccactgcttaccatccccaggttcctgtactaaccttgtggttcctctaaaccccaccagtgcctctctatatcgtccctttataaagaagttctctggagcgcagcctcagttgagtgtaccctctcttccagttggaagtctgatataaacaatgtgtttgaagttagggaatacagtaacaaacaaacaagtcatgatctctcatggaattctaactactaccactgtcataacaaacagctaccgtttattggacacatatcccatacaagctctatagaagttgtatacctgaggttgctatcatcatctctgtttttcaaatcaaaaaaccaaaccttggaaatataaaacccacatgagtatcaaccaacagaatttgattcacaacagaactcagattcaagccagagtcaacccaatccacagcacacgctcataaatgctgaagtattaccacatttacctcaacaatgtccctgccaaatggatcttcaatgtgagtcataagaaattttccccaatccttctccccatgccagatctggggattttcagaaagcctagtgtgaaaattcaggagacctgaaatgtgccctcttatcatatctactcaccaactggcttgtgagtttcctcctctttgagctaatacctgcagggaggtgcgcgcttccgtaactagtggcctttgttctaaccaccatctctgccatttttcctgtgaaatttcaagataaatgcaggcaagcaagggagagagcccttggacactcttctctagtattctaggacttttcaggcctgcctggtgagatcaggtaccttatcactagcttctacttgtgcaatctcccaattacacaagcgatcccatctagatttacaagtggccatcctctctgacccacaggccagagaactcagcccacgcaatgtttttaaaatagaccccaacccaggggaggctgacaggcacacagctgcaccaactttattaatgagtacccagacctttagataattgatttccactttgatcccagcctacgcatttctatctctgatatctaaatagcaaatcatgttatcttacaattaagtgataatcttcatggcagaaaagttgacaggtctataaatggcttctgcaagtgattaaaataacttcctccccctttccacccagccctggaaatgttctacaacttcacaaggctattacttgttaataaactccccatgatatgaacctcattcatattcaacaagtttacatactaagttactctccagaaatgatatacatcttattttttatgcttaaataagaacattttatttattttttatatctatttttttggagaaagggtctcactctgtcaccctggctggagtgcagtagcatgatctaggcccactgtagcctccaccttccaggctcaaggatcctcccacctcagcctcctgagtagctagcactattggcgtgctcctccatgtcagctaatatatatatttgtatatatccatggcagccaatatgtatacatttgtagagatgaggccttactatgttgcccagtctggtctcaaactcctgggctcaagtgatcctccagctttggcctctccaagtgctgggattacagtcatgagccatctcatgcagcctgcaagtacattttattagccttagtaagttacacaaagtcagcaaaacctttgactttaatattcaagtaatattaagattgttaaattttgcatgtatatgcatggatatgaagtatatacaagtgcagagtaacttgaagatcagtgttgaaacaacattgagtatttaatatgaaatgagaataaatgactaaaagaagataagttttacttcaataagtgaattgaatattgaaccctgatatggtttggctgtgttcccactgaaatctcatcttgaattgtagttcccataatccccacatgtggtgggaaagacttagtgggaggtaactgaatcatggtggctgttccctcatgctattcttgtgatagtaagttctcacaagacctcatgttttaagggacttgacctttcacttggctctcattcttctccttcctgccatcacgtgaagaaggacatgtttgctttcccttctaccatgactataagtttcctgaggcctctccagccatgctgaactgtgagtcaattaaaactctttcctttataaattgtccagtctcggatatgtctattagcagcatgaaaatggactaatacaaacccttactatgcactgaattctggggcaagtacccaagatattacagcaaacaatacccaccaatctgcttctatggcagaactgggccacatgcccagaaggcaagtaagaattactctgcaaccaactgatcaccatagtaactgagcatcaggtagaaagagtgctgggattgattagcagagtctgtgatttggattggacatagaaatgatatagtccattccatgtatgctcaatgaacactgcacaggtgaacagataaggctgtgacctcctctgaggcaagctccctggttattccatctccatatacctcaagactcctaacacagttctttgcacataatagacattcattttgcaggacagataccaagatgaattgcttcagtttgtttttaacaacgtaattctatttccaatttagataattcattgatttcacacctttccttcctggttactctatacttaattttcccttttcttctttccttttttgtttgtttttttttttttttttgaaacagagtcttgctccattgcccagactggagtgcagtggcgcaatcttggctcactgcaacctccgcctcccgggttcaaacaattcttctgcctcagcctcccaagtagctgggactacaggtgagtgccaccacatccagctaatttttgtctttttagtagaggtggggtttcaccatgttggcagggatggtctttatctcctgaactcatgatccgacctctcaaagtgctgggattacaggcatgagccactgtgcctggcctcttctttctctttctaaaagcacatcaatttacatttctacatctgcttcctacaaagaatttcctctgaatgaattcaacaagtgtcctgtacatgtaaatatatgtatgaatcttttgtacctatccatgtcaaagggtttttgaagccaaactgaaaactttcctagactacatgttgatgttctgaatatccacatttcgaggctcttaacaaagctgtatcaaactccttttcttctgagtaatatattatgtacgtaaagtcctaggagatgccctaagtctactataagtgaatttactttttgttttctgctttgcttcattcatcctgctttgctttttttctcatcccaaatataaacatctgttttgttatcaagttaaagttaaggagatataaaaccctctcagattaatgtacagcccattattgaattctggatcttagtgatatccaatatattatcatgaattttatagaatatactgaacttttaattcttatctgatttatcttcttaatgatgcttagatttccattcaaaaatcctgtctcttctcaccctttccacactgtgtctgtttttgtgcccttttctagagttttacatttctctttaggattatctctctctttctctcgctcacctacatacacacaccacacactccatgtccaaattcacagtctaagcattttggtgatatgccattcctcttctacctttgttagaagttcctctttcccatggaatcaattctaccggaaaaaagtgaaaaggaaccttagagagcaatcattaaaggtgcaaagggaaaggtccccatgtctgggagtgtctctaaccagctgtgtgatacgtgccatgtaatatctggctttggttttctcatctctaaaactggagggtaaaacaagactatgtcttgaaacctttctaattctgaaatgttcactattatcagttaacatttattgtgcttttctgcatggcaggcctcaggctaacggctggctataactagcactatccatgctcacaacaactccataaggaaggtgccacggttatcctcattatgtcactgagaaaactgaggttctgagaggtaaagtcatttcacacctgatgggatatggatgtaagactggaactcagacggcatgactctcaggttacagattctgcatcacatgctcatatcaactgatctgtatttttatacaacttcaaaaatgaaaacactgggcatgtgacctataaataatgaaatcatatacaaaaataaagaaacaccccacattgttgaaaaattatttcctttccaaaaattacttgaaagggcatcagtaagccctggcatatttgttcaaaatacagtcttactgaataggggtgtgtgtgtgtgtgtgtgtttgtgtgtgtgtgtgtgtggtgtgtatatacacacatatatatgtgtgtatgtgtgtataggtgtgtacatacatacacatacatgtgtatacatgtatatagacacgtatacatgtatatacacacatacacatatatacacatatatgtatacatacatatatgtttatatatatacatatgtgacaataaaccagtagaaaggtatatatatacacatatatacacatatatacatatgtgtatatatacacatatatacatatgtgtatatatacacatatatacatacatacacatgtatgtatgtatacacatatatacacatatatacacacaaacccacagtcatcccttggattggtttcaagacccctgcatatacaaaaattagcagttgctcaattccctgatatgaatggtatagtatttgcatataaccttcccacctcctcccattaactttaaatcatctctagattacttataatacctaacacaatgtaatgctatatagttattctaacatattgtttttatttgcattatttttattgttgtattactttttatggtttttttcccaaatattcttgatccacagtggatgaaattcacacacgcagagcccatggatacagaggtccaactccatttttaaccaatactcatattcgcacagattcatataatctcacactttcaagtaacgtaagcactatatgatcccattatattatcagcttgtcaagaaaactgcctatgctctgtgtcctttataaaacaatgttcctacctaataagggcagctacagcctttccccccagttctccctgctataaggtggcacccacagatatgtctccttctcttttgcctaagaaggcccttttgatttctctttcaatcctgtccccaagcctgaactcatcagtatcccctactgctgccagtctaggagagactccaatcatcttcccctactgctgagacagcagccttctacctggtagcctctgccctcctcagtccattctccacactgcttgctttcctatctcttctcaaagccaatcacataggtcccttcctcacttaaaacccctttatgactcctcattgcatcagaaataaaatctgaactcccttccactgtttcagaggcccactctcaagctctccacatctataaagtgccaactagtctttgccagttgtcaaacagactgagcttagctttctctcaacccagaacctttacataccctggctccttgatttggagtgctctctctccatctgccttctacagtcggaccttcacatctttcaggctgagacagaaccctcctccagagagctttccatgtcccccttatttagtctgacccaagcccattattctctcttcactcttcatttgtttccttcataataattctgattgatcattgtgttatccatctccacgtgtgtgtgtgaactatattctctcactatcacacaagcctccggaggatggaaagcagctggccttgctgatagatacatcccatgcatttaactcagagcttggctcaggttagatggtcactagttatgtatttgttaaacgaatgaacatatgacctcagatctttttgccttaagagaaagaaaagtaaaccatttgaaaaggggggaaaaattataaggctagcaaaagttaatggtattggcaaacattactacaggcccttgatagatgttaaaagaatggagaaagccctttaacatatttaatatatcatccctagttggaagatacttttagaattgtgcctatgcccaaaagttaataaatgggtgaggatattctgtgtgactaagaggggctaatgaattgataagtatttctgtgagatttactggatggttgaaaaatctctgtacattttcccctgattgtctctacctttctgctggcttattgtcatgctgatttttatggatctacattcaacagctaaggtaaataaggtaaaatgccagagaataatccaccataatatagtagaaaacttttttaaaatcaaaattcctgttgctaaacccaccatctaacaccttttatcacatttgagtgatctttaaaagaacatcacacttaaattcgcttttgagttagattactgaagacaaatgacatactgaaatagcatctaaaagcgttaatatacaaacatctacccaatacagatttaaatatagcagtgactgtacacctaccgaaacatgaaagactaccaggagacagggatttaatgtggattgatactaaaaagctaatggaaatccggtggtctttatgattgagatggaacatctttcacggctcttaaaaccttaggctggacagtgaagacatgggctggtgctgatgaaggagggctataccccaagcctgggaatctggaaatctgatgtgttcggccagagaaactccaaagttctccgtgtttctgcctttctctacccccacaaacttcaattcttcccttgctaataaaatactggaaactgagtaataaaaggcaaatttcatttcaatcctttgggctcaaagccagctccctgccaaaacttctcctgcctggaggggtagagcagggaatgagttggggcaagcacagatgtcctgcttctactctagagggagagatctgcaaagggtatggctcagcatcttgtctaccagctaatgtgattcataaataaatcacacagggagaagtgtgggaggcccctgtggttcaattctttatctctttttctcttccccagtgtggaagattgtcctgagagtgtggggaccagggggcagagtcacctacatggtctgctgtacagcagctctggcagcttagcacaacccattcacatactgggcagagcccttccaatgttaacctctgccagagctcctcctgacttttttttttttaatcctaaaagaggaagcatttcaaatgacctaaatctaaaaatagagtacttcatgctcatgactattttaaatagcatctaaaataaagaattaaaaaaaaaaacatgtttccatttttgtgacagtttccccttcccttgaaaaaaagaaaatactgtagagcttgtcattcaatctaaaatcagacttcgtgccagctggaatcctaggtttatttattactgtgcacagttcttacattaactgtttgttaaagactgattttaccaccactgagacacaatgtaagtgaaggtctttccatgttttaccaaaaagagtgattcaagcatgacccgtccaggagaaatgatattaaagaaaagggacagaagtactactcagtcactgatccaactatatttctggagaaatcaagtttaaacataagtaattgcctaatggagttgggccaaggtggagataggaaaatatccatgacacttccagtatttgcaaaacaggttcaaaaataaaattgcaacattttatggtctgtaacatacttagtcacttagtcgcagagacatctggaaaaagataatccaatggggcaggtttttattctctactttagaaaattgttcacatttattccctatcatagtttcaagtagaatggttataattcatccaataagcttttttaaaaagcagggaatcacagtttctgggcgtggggcccacaggcctttacaaaacttcataggtttatacctacataggtcatagattgtgaatgacacacaacatgatgactatgttcatgaacacacatgctcatatacatatatacatgcagtcaagctcaacctagattcacaaatcttacaaggttttacttccacaataatgggctcctgttcagtctctcttgccagccaatcctccaagagagacaccgacaaatgtagacacgtaaacatgctcctccaaacatggaatagctatcacttatttcaagtcatcaaacgtatgagtcagctgtatcttgatacaattagttgaggttctctttcaatgtactccttagacactctgtggtgtcaagctgtggtactatggctctttcactagctcattaccacctccagcagagtctgccttggtatagcctcagaggcacagagcaagcactcaataaatatggagtagaggaaagagaaaggtggacaggaaaaaaggggggagggaggaaaggagatgaaaaaggatagaagagaaagggaagccagtgagggagtgaatatctagctgagaatggaggaggaatctcaaataaaaagggcaaagtcagaggacactcagaaaaacagaagtggatggacaacagtgccacaggaactcaaaggtgcaatgttttcaaaagatagatagattccaaagatggcacccactgatgaagcttttctattaccagggtcacatacaaacaaatcaattcggcacccagggctgaggtggtacagcgtcacgtccttaaaatgccttcagggaccaggcaaatagcataaatataagattataggcgagaaaatgcttaagtttcaagcacagcatctgtttcaagcagaaaaactgtgcagatcaaacagctcagcccagactctatccctacaccctggagctaacaaatcaatttgattcaaatatttgtggaatacctacaatggggttttaatcacaaaactttacttgaacagctgcaacctctagcctctccaggcttctttcctcatcatggggagaaaaacacaaacatttcaacatttgttgagaggagaagaggttctacatgaagtaacccgactgacttatttgtactgagaaaggaaaagcaactaaccctgacctaccagaacttctcacctcgggcagtggcagtgagcagaggtctcagcagcaggagcctgcacaaccccaaaggacatagcagagactccaataccatgtctgaagcaacttctttgaaatcaaaatgctgatcttctcacatgctgattacagacacttccattatcaaacagaagaatttggggcaaaatggattcttaatggtgtctgtttcctacattttcttatcagtagagtggctcaaaatctaaatccacctaaactgtccatcatcgccccctccccaccaacaatgctctcattttatcctgtatgtgtttttataaaacgtctcaccatctgtaacaatatatgtatttgagtaattgctggtttactgtccattgcctccactaaactgtaaactccatgaggtcaagtacagagtctagacttgctcatgactaaatcacctgcatctggcacatagtcagcatgggatatatatttatctgttggcccaacaaatatgactcttgctgctatctgattttacacaagcacacctccactggcacaacacaaggagaggagaagagggaggcatctggagagctcaatgtcaaggttacttcccagctgccattccttgtgtttcctgaatgcaagtgtaactagtaactgtactaacagagccaagggctatatattcttcttcatcccataaacagaaaaataaacagttctgtggaactgtgcaaacccaacttaaatttcagattccagacccattatctggcaccctttgctcagaaatactttactaccactagaagacaatctaacccctggtctcacataccacataatgctgaaattcttccccattctgtctcaaacctgcccacaactccgtttcatgagggctgagccactatccaatttctatccttataggggttcggttttagactatgctcacaaatcccaaattcccagtgagttcaggaatgatgcttccttaccttaccttacataggaccttgaagatttctattacccgcagatgtaacatgcagttgttaagaccgcacattgcatcagcccacgaaatgagttgggggctatccagcctggcccctctcacgaggccatgtaccttgtgggggagctgtgtctccacaaaaggagtatctttttctattttatacaaacatgccctatggattagtaacagtctgatactagaaaaaaggaagctcaaaacttcacaggacatggcaaataaaacccagtgacctgataagaggtacaatatctccttggtttaatatttcacctcttctaattagaataaaatattcactaggaaaaatttttatgatagtgtccttttggcattagcatgaatacctccaaggagccgtattattcaaacaattttctatttcaaaatacacaggtagtaagaactaacaaatcattacatttccaccaaatgcacggaaacaacaaacttaactaagaaaatactgaagcagcttttcccaacggtacctcgcctccctagagcggaatggttttcttttaaggaatccctattgatgccagaaccaccttggaagaataattaatgacattttgaaaactgaacttccttctcactgcctttcataatgcaaagtgaaggggaggcggggtgagagtcccccaggaacacacaatgcatttttacaagagcttctaaagcccctcagtgagacagaaacacactttctcatttaagcaaaactttagaaaactaacaattaaaatgtgagttaaactgaggaaacatcttacatctgtgattctccctccagaataatatgactaggtagctagctgccagacactcttgtttcagcaatcatgtgactatgtgatgagggctggcttcatgattcaggtggaactgatcagggcactgacactgatggagacaaagcttgtcaggcatgatgtccttgtaggcaacaatacctgaaactctgttaggaaatctgaggtctttggatagaaggaaggaaataagccaaaggctagagtcacacagtcagtatcacttcagacaagtcagcactggatcaacctcttcacctgtaaaatgagggtaagaatatccactcaataagtatatgataaaaagaaagtgacaacacaaagtgtaaatgaatatttaagcaacatctacacataagagaccctaaatgaatatccgttgaaataaaagcaatggttacatgcttctcatatcctgtggcccactgacctcattagtcattatcttgaccagctccacttgcacagcattatgaattacatgtgtgcagggctattcaattgtctagtttgatgttcttaaccttgtgaggcagtaaatatccattttaaagatgagaagactgaagtttacttcacaatcttagtggctccaatcgaagatcgtccactgtaaaattcagttatctgcctcatgatttcacggcttatggctctatggaagttctattcttaacatgacgcaaaggaagtcagaagttgcaaaactctgagttagataattaagccatgaaaagtgattgatgctaagcatctgtacacaacatgtgaaccaagggaatgagtgactagaacccaaagagagtttggagttatttggctgtgactgagaaatgatgggctaggaatccaggtaacaacaacaacaaaagtaaatacacattgtctctcctctttgagaagatgaaagaaaacatctttttcagttcaatgatgcttcctgtagacagaaattttctcattgaatggacaaaactagcaagtgcacaagttaataataaccttttacccaaggttccatagcaagttccacatgctatgctatcatctaggctccctgcctgcctcttctcattgcatcctcatgacaacctcataagttgtcatgctatctccaagttttggatagagactgagtctcagtagaggtaagtttgtttttcaggcagggttgagcttttcgaagtacagagagaactggggaatggggtgcttcaaagtcactgaaagagctgaagctgtgggctctagaaagacatccaggatgaccacgaggagtaccactacttctgccaccatcagaaaggcagagactcaggaagtcaccaacagaatcattattagaagtagactgtctgaattatgaacatggatcagaaagctgctgtcaccaacacagcctttgactttataggaaagccacactagcaacaaaataaacgctctatccactgcttctcagtggcccttcactgagtggccaggtactgaaagatgagtgcccaaaagcccgatgtctcctccaatgttctagccagcaaagatcacagagaatacagaaagttggcttcagtctcaattctgtcttccaaaactcaaacaagtgcatctaactggcaaacaaggaatcagatccagggccttagctgtaaagcatctggaaatgtaatgtttgaccttcccgcctttcagtacaggaaggcacgtgatgaggaggctagcaaggttcctgagagctcaatcactgtgtctacttcatcagatttgccatcccatagctgattcctaattaaagggagtgagaaccaaaaagggggcaaagccaagtatatgagtaaatgcacagaaacatgacagactaatttaaccagagaactaaaaagggtttagcacccactaagtgaagagtgcatttggaaacaaggtggaggatatagctggagaggcaagaaaaggccagatgatgaaaagtctatcaccccagcttagaagctttctcagcctaagctaggatatcccttctgaacttcttagaagccttgcacaatcctcagctactcattgatcacacagaattgtaaccattcatgttcttgcctgctttactgttccccctgactatgagggtgggaggtcaagggaaaggaggggctattccactttgtatttctagaacatagcacagtgcctggcccataaacgaaagctccagaaatacgtgttgtatggaattacgtcccgaggttccttccactatcaatcatctacttaaaaaggagaaaatgctctctttaccttaagtacctttcattattaaaaaaaaaaaatggttaactatggccacgcaatggctctcacctgtaatcttagcactttgggaggccaaggtgggtggatcatgaggtcaggagttcacgaccagcctggccaagatggtgaaaccctgtctctactaaaaatacaaaaattagccgggcatggtgacacatgcctataatcccagctactcaggaggctgaggcagagaattgcttaaacctgagagacagagtttgcagtgagcagagatcgtaccactgcacaacagcctgggcaacatagtgagattccatctcgaaaaaaaaaaaattggttaattgtagattacagattgataattgtaagaatatattcctatagacatatttttgtacatttatgtacagtagtagacaaatgttgtttctgttaactgaaccaccattctcccattctgatgatagtgcctcaattttcctgtaggaaaccacagctactcccctcacatgaagaaattcacatgaggggtatgacctcagccctggggtttcagtttggcacatgacatggctggatcaatgaaagttctccgtgggattcttgatatgagcaacttggcagtgagggggaaaaagttgctctcttatgctgagattgctactagtggcaagatagtaacattgtatggccaatgaccaccacatgagacaaggtgtccaaagaaggcaacatggaggaatcagagcccatggagggaaagacacagactctattttttttttttttttttttgagacagagtttcgctattgttgtccaggctgtagtgcaatggcgtgatctcagctcaccgcaacctccacctcccaggttcaagcaattctcctgcctcagcctcccaaatagctgggactacaggtatgcaccaccacgcccagctaattttgtatttttagtagatacagggtttctccatgttgatcaggctggtttcgaactcccaacctcagatgatccacctgcctcggccttccaaagtgctgggattacaggcgtgagccaatgcgcccagccgggagagacacagactcttaacaacactgagtactcggatctagggtgtcaaagctgtcatcggtcagtaaatttctttttctttttcttagaaggtctaggatggtttcagtctggtaacaccaaaagaaattcaaagttttaagtttaccatacataaactattagttgaagaaatggcaatgactaaatagcagaagaatgaaactcagctttgggggacatcaatctgtcagtcatctactgtgcagccatttcgaggggggataactggaagagatgaggctatcacctggacattcttaagagaattaaaacataataagccctctccctgtctaaatgcacagataattgattaacagaaaatgatcattactaaaatggcttcagagtttttcagggttgtgggaattacaattgttctgaaagaaaactgattacttacagtttcctcctaagattgtagttgtgcagtaatgatattgagacagcatgatgcccattaaaaaaaaaaaaaaaacactgaagactttacaaataactgagccaaatgagatattgaaaaatcaaagcgagaaagtcccatcactaaaagtatacaaatacatgagaatcagccagtaaaacaggaagtcactctcatctaaaatggcctttgcttgtcatcaaactcatatagaattcctaaaatctgtcagtgtagtagcttctaagtgatatgtcaacaaatatattcactgagaatacttattctgcctagagccaatgtttttagaaaaacatcctaaagagtcaactgttaaatcactaaaatgaatgttttgagcaggtgtttggaattgtgctgatttatccatattttccagtttaatttccacgtttaccaacaaacttcagcaagaaaacataaaatgtacctggaaggattatgttcatcataaatacaaggacagttgcgctaaacatatctgtactggtaacagtgattcataaaccatattcattaacctaaatccttaaagttttctgtttaaactgtagtgattggaacgccaagtgtcagagtttaaaatggtatttttaagctattagcagttgacattttaattaggcatatttatgacagacatggggggataaaaaagaaggtaagcaaggaataaaaggtgcatcaaggacacaagaaaagagaaaagaattaccatccattcctgttatccttttcttttagcatatcaataggaaagcagtataactaactggtcaagaatgtaagatctaaagccagcctttatcagctcaaatcatgactctgatatttaccagctgtgagaccctgaacaagttacataaactgcatctgtttccacagggataatgccagcacgtagctcataaggttgctgtgggaactgaattgggtactgctcaaaaaatatgttgcacagggcccaagaggaaagaagtattcaataaatgctaactactactatattatttgtaaccttacttaccgggtcaagggctaatagtggtagtaaattgttgcttaaaattttatttatatatttcttcttgaaccagaaaagatgccaggctatttattttttaattttttgttgttgttattgttttacaaagggtttctcagtctgttgtccaggctgcagtgcagcagcacgatcatggctcactatagcctcaaactcctgggttcacagagtgatcctcctgcctcagccacccaagtagctgggactataggtgcacaccactatgcccggctaacatttttgcgtttctttttttttttctttttttttttaagagatgggatttcactatgttgcccaggctggtctcaaactcctggcctcaaatgatcctcctagatcagccactcaagtcactaggatcacaggctcagccactgtgcccagcatgcaagacaatttaagaggcatacaaaagacaaaaatataactcaacttaagaacagattaagaattaacaagataagaatatttaagaataggttaagtaaacaaatgtcatagacaaaactagagtcaggaacaagacaaaggataagaatcacttagatatggctgctctaagcagctactagtttgtcttcagctttctggcatccaacacaagaaagaaaactgggtctgcggcacaattttcaatattcgtgagattaaaatatactaaatgcccagaaagagagagtacagtgattttgttagaggccgagaacataaggaactaaggccatgcagcaaatcttcagaggggcacatcatagccacggtagatagcattgccaaactcaatttcttagccctccttgtatccacacctgtatatggcctctggggccacacgtatttccccacctcttcagtcaaagcttggtcctaggacttccttaggccctgatatatggggagaagtgacagtgcatcttcactcagttctcaccctctgccttaaaaggtcttaagcatttctgcttgccttgctgcatctccactacagccatagaagtaagtgacatagttggtgtggttgctagtctaagggagatgaaaaacacaaagcagtatggagcagagccatccactgagcccagcctagatctgctaaaccccagatgattcactaagacacaagcaaaaataaatgattattgttttaaacttcagagttttgggataatttgttatgcagcaatggaaaacaaattcagtaacaaaatgatgacactttttaaagcagtatttctattgccaactataagtcaaacagtatgccttctaaatggcttaccataacctatcttcataactttgatttctaaacttattaaccttgttactgtaatttcagagaccctcaacaattaatataaattaaatttgtcactcaccctactaaatgaaagtactctggaatacagtcaccaaaattaaataaaggttgaggtcataggcctccaaatacaggccatacagcataagcaaaattaactgggaggtggggtagggaggcaagcagtaggtcataccttaaagagagaccaacggcttccaaagtaacaacactaggcatgaaagtagcccatgtgtggccctcaggagagctgccatgtgtatgaagacacactggactgagaaatcagtctcttcaaatgtgtgctttattcaaaagatatcagggcagatgtcccacaggatttgtgttgatttgagttgcttctcacatgagcaaagctatccagcatccatacggcagaagttgttatggggacttattcatttacacatggataatgaaactcatgagcaaggctggggagaccaactaacaactctaataacaacagtaatagctgaatcccattgatatggatggtgctagtcactgtgttaagcactaagcatcaattatttcattcaattcattgaacactcataataacccaaggaggtagttatttttattcatttctccaaccaactttgccttttgcttttacaggcaagtattctggagcttggagagactgagggacctggctatagttacaaaggcaccaccttgtttgacaggggctctcaggcaaaattagaacaggtaaacttgattagtatttgctttaggtaagtcttgaacattttctcagttaactgaagattttttttaatgtttatgtattttttaatgaatacattataattgtacataatatttacggggtacaatttgatgtttcaatacatatccgtgttgtgtaatgatccaatcagggtagttagtatatccatcacctcatgcacttatttggtgaaaaccttcaatagcctcttttctagttattttgtaataaacaatattttactgttaatcatagtcaccctaccatgcaataaaataccagaatgtatttctcctatctggctgttgattgtagttttaattcttttcttaaatatgaagcttctgtaacttcaactggtctgtgaaaatattatgccaaatagaaagcactttttgtaaataaagggcgtgtgatgcactatgaacacctcccaaatgatttggaggaaaaaaacatcaattccagtgatattgtttcagattatcccaatggtctaggtttattccaaagactttgacctaaatccctcagtattccccttcaactaactctcaacccatttgaaatcttattcatatgttctcactgttagattgtccacctacaatttttttttgtcctttgaattactttctactgaaaataatacacagacctcggtgttattggaaattgcattgtgaatacacaaggttttttgtctaaattttaggtagttttctctttctgttgctacctcaaagagataacagattctgcagtcacattatatgtaaattatgtacaagcttcaccacttgggcttgtacattattctactgattttctacagtggcgtggggggcacataatagccagcaacaaattattagaaattaaattcaaacccagtgtatgctggatatgagcatttccaatgcattttgcctccaatttagttcagatgactaaaaacagacctgtgggactgtttaaaggcactaaatctccacagaatcatgcagtgctatgacataggcattctgttctcaaatattcatcatttatcagcaacggaaacaaacataggattcacatgtgcaaagtaacaaaatagatggtcctagctgacataccagtttgactcaactgactattacccttacaatgagcagcttcttaaaccacacttatcctggtcccctttatctatgttagagaaacaagaccatctctactattaattctgtctcaaaacttcaggttacctagttttttccctcaaagattattcatcttcgacagtcaccactgcttcacaaaacagattttattgttttctttgccaattaagggctccccaagaacagtgaataatctgtcaggttgttataaaccatcaaaagttctagaaatgtcacattacctccttcaaatattttttaacatgcaacagggacatacagctttgtcatcaaaagctgtattggtttcctcatattttctaatctacaccataaagggaagatgtttatcataatggcaaaataaataatttagccagtccaaatctcttacaattgcatgtggcaaaccaaagtcaaactgaaggagaggagggtggaatagaggttaatttgctcacatgacaagaagccttgtgactttatttaggataggtctaggcagtgaggctggtaaacatttaacaatatactcatttaaaaaaaaaaagggcagggggtaggagggggctgacttgcagccaatttcaagctaccaacacgctgtcaaccagctcacagaattcctgaacatttaacaataggctattgtatgctgggatgagccatccccagcatgatactagatccagctatcaaacaatatcataaacaccccatcctctcttctctttttcctgctttacttcatctgatttcattctcaaacagatttactcaaagatgactgcagaggaatgttctcagagggctctaaataggttggctttggatctgccctcttaaaactaaacattaccacagaggaatgaagtattctgatcacccagtttgggagctagagagaatgggggtagctacgttcaaaccatttggatgaggcaggactcgcctgaaatggggtaagtgtagccctcctaagaaagaagcactgtgcggatgaacatcatgaacaccatccaagtttcaacatgtctgagattaaatctgcagcaaaagtttactccatttctgggtgtgtaaagcagctaaaacttcctaccatgcgtccgctatccatggaaatccggaacaaaagcttaagatccaagaaaataaaatgtgttttgaagaaaaatatgctcttgcaacataaagaagctgtcttcagttacaaatagatataaaatgtgaagatatataattgctgcataaatttattaatagaagtgctaatgccataaatcgtacatctccattttgacacgcaatcctttattttcctttcactgaggaagaaaaataaaggagcggaactggtaatattgcttgcaactaaattggattttccaccagagaaagctgtttagaaaaagctattctaaaaaagcaaaatagtactcacaaaagggtattaatgaatccaaccaggaggaaaaagcctccaacaatacaaagctttccaaaacctctttcaggactgaaagccaaaaggatgctttgaactctctgtctttgcagaaaccatctcacctacaaaccgagtatgagatagagttcaaattttagaataagaactcttaattcaaactacaagtcttaactgacgattcaagaggagagactgcagcagctctgggtttcgaaggaaaccgatacatcctgccctcaaactgtgaggcactataggagcaagatgtaaaggatgcagtgcctttgcgctcccacctccgccaccgtgggtgtcataatacagaggtgaaagttcaacatgcgacaggtagggatgcagcagactctgtggctttatactgcataggtctttcactgcttggtcacagaatttctttgaatcctatttgtttatacactgatatttatgtaataacaaaagagtaagtaaagagcaaggaaacagccaagaaaccctgagcaaatttttttccccctaagaataaaggagttgagttaggctatcttcccggagcttctctttatcgctagatgcagtcagctggaaacatatgcctgctaattgctgaatgtgtgcctcatggagcaacggtgcagttgtcgaacgacctcggggaaacaagtctaggcctatttgtgcatttctttctttcaccatgggactcaagtgcttcgccaggccactattaggacagtggaaaatcaaggtggaaggctctgatgaaatcaattatcactaagttattttcactggtgaaggggtttcctcacaggggtttaatagtaaattattctttccatgggatgtgctagattaatggaggaaacaaagcaaacaaatgttgcctggtaagactaagaggagggtcccaaaatactaatatttactgcccatgaagagatagccacattcacaagaaaataaatgtaaacctacaattccagaggcgaaaaggaaaaagaaatgctaaatggcagttatttcctcagtgttatacattacacatatcaataaaccctagagtcccatactatacatgccatatggatagataaatggcatatgtggtaatagtctttcaaactggatgatagtactttgcacaagtcagggatgcagcaattgtttgaaaatagggaaaataaccattttctagcattacctagtgaaatgtaagtgtgggtacagtttgggagaatctgtatagtatttatttttatcctagcaaactatactttacctttctggtagaattttaactttggatattttacaaatatcatatatagtcttggtaacatcttttatttaaaatcacaaatattagttggatagatgtgttaagggagatttaccagactgcatacacaaaggaggccatcagacatgggcatctgaattgatataggttacaccacaccgtagttaaagaccaaatatctgccagtgttcccaataaggaaagataactaagataaaagaatgtctcttgcagaattaagaccttgggattcttttaaagcctgggtttacatcctttgctcagaagagaaagacacattatttcaatatattttcattcattcttaggcattaactgtcttaataaaggcagtgcttctcacttaaaaaataaatttagctttaacaaagtaagtgtaaacgtgaccctaattttcactctgctgtcctttcttccctgttgtgcttattagctgctgctctttgaccttgaacagtaatcctttgagcatgcctccttccaccatcaagaggaggttccctacggtctggtagtatttctatcatagttgttgacatgccagggaaaataatttcctttggacactataacccttctcgaaaccagctccttcaaacaactcacctaattgaacgtgaaagacatgaaaccactggtgtcagaaattaaatataggtgtttctttgttttctttggcatttcttctatttactttctgtcatctatgccataggatttagaaaggaaagctatggaaataggcaccatcaactagaactcaaagagagaattttgtatgaggaacacagtccaccagcagaaatagaatagtgttggatatactcttcaacatgcttttttttttttcaggatcaatgttgatggactgtattgaaaacaaaagggtaattcttctatggagttgtcttgcaaaattctattctagggttttgtctttgtcctttgtaagcacaaagcaaatgagaaaacaagtatatggtattttgatcaaaatatatctgccattaaacctaaggttccggagctccatggtatctggaagatgctttagagggtaggtagcctgaaggtgctgcggtgccatcaaagggcaatgaacatctgttgccccatagcccctttcctcctcctccagcaacaaccctgacatcatttgggaattcaatcatctcctcctctcagtctataaggtcgcagtagaattccatccttagacatgaagaatgtgcctcaggccaagctaagaggcacatcttactcccctatgcccctacccccctacccccctacccatagagatttgctgtgggatagacacatgacctaatccattctaatcagggtgactctcaggatgtctacaggagctataatgaaagagttgtaatgtctacagcagaaataatgtcttctgctggagcttctgcagccatcctgccaccactggttaggctggataaaaggcaaacctttaagccttttttttttttttttttttttttggtgaccaagttttgctacttgttgcccaggctggagtgcagtggcgcaatctcagctcactgcaacctctgcctctggggttcaagtgattctcctgcctcagccttcctgagtagctaggattacaggcatgcgccccccacgcccggctcattttgtatttttagtagagatggggtttctccatattggtcaggctggtctcgagctcctgacctcaggtggtccacccaccttggcctcccaaagtgctgggattacaggcatgagccactgtgcccggcctgcctttaagcatttaatgggatgttaggaatacggtactgtaatttctccttgggtataaaatatattggagtcaatcactgttgcccctaccctagtggggatatggcaatgatctcaccccataaggcaaacactagaaatttatgcttcagaattccatctggctttggttactttttgatacttatgattattatttttatttgaaacagaggctcactatgttttccaggctggacttgcattctttagtctcaggtgattctcccacctcagtctcgaaagtcgctgagactataggtgtgcaccttaattattttaagaaaagaatgtaatggctgggtgcagtcgctcacacctgcaatcccagaactttaggaggctgaggcgggcagaccgcctgagctcaggagttcgagaccagcctggccaacatggtgaaaccccttctctattaaaaagataaaaacttagccaagcatggtggcgcatgcctgtagtcccagctacttgggaggctgaggtaggagaattgcttgaacccaggaggcagaggttgcagtgagccgagattgtgccactgcactacagcctgggtgacagagctagactccgcctcaaaaaaaaaaaaaggatttaatttttaaaaatcagcatgaactgaaatttacttcacaatggaattaaagacccccaacaagtcataatatgcttatatggcaatatcacattgtttgtgtgagttataaagttggatggatttgcactggcatcttttcacggttttagtgagagaatcatgcatcatccaaggaactctgatgtaaaagactggacatgagaattattacagctttgaaattctgtcaatttcctacccatttagtcagatttaagaacagtatgaacctatcttacccaaaaaaataggttctaaagtcagtacataaattatataatcatgtgatatgactttatcatatcagtttacattcctgaatataatatggtccaatatcttcaaaacatatcaagactctgatcacttcttaccattcacaccattatcatcaagttgaaaccaccatcacctgttttctgagttacttccaaagcctcctaatcagtccaaacttagtcccatgcaatgtattcttcaaagaaccagtaaattcttttaaaaaataaataaacagatgagatcacagcactacttaacacctctaacgtcctcccattgcaaaatctgtaccgtgacttacaaggtcttctcgatttgatttgccccatccctatccatctaatcccaattcctaccactctccctctctctcacaaagcttcagccccactgtctttcttgctgttccttcaacattccaagatctttctctcctcgggggctttaaaccttcctacctctgcctgcaattgttttcctcttaatacttccaaggtctcccttttgaatccattcagtttactgcaccaatctcatatcttcaaaaagtttttcctagacctcctaacaaaaataaggcccctttcctaatactcactatccccttattttcctcctagcacctgcaactatataatttccctgttgacatgctgattatccatcttatccactgaaatataatccctatgggcacaagtacttttgtttatttgctgctgaatcatagcatcaagcatagagcctggcacctataaattgctctataaatttctggtgaataaatgaatcaatcaataaatgaatcttccaacaacatgatgcaacacagaccaacgttcagatcctacaaggtctaataatgtggctaaaggggcacctgttcttggttccctttggtgaaaacctgataatcaatgaatggcaagcatatttacatatttaaaagtttgcctgcaaggtaatcttaccttgaggctgtgtaataggagtaagtatctattagctcgtaggaagcacatgcacacatgtatgtacacacataaactactctgatctctcatgtcttcaacaacttgactacatttttacctgaaaaaattattgtagctattactaatgtgatgcactaaccagagagcagaaacaaattgagttgtttgtttctccaggagggaaagcaggccgcagctacttccagaaggtcaagagatcagggtatgaatacctaagacatgtgtgtgtatatttctgccacagggagttttcacacaatacacaaatggaggatcaactaacaggctgccagtcaaggggagattcaagaagtttcaaagaaatgctctgaaccccaaaataacaaaggaaaacatgttttgaaaagtacacaaagacagttctcttaaaaatctgccaggactccttgccaaaatggcatgttacacatccccttctctataacctataccatctgggctttccgtaccccaccagcagggtgtaagaatgcctattcatttgcacccctgcccatataagttattataactttttaaaaatcattcccaaacctgtaggttaaaacatgatgtctccctgctttaatttggaggtctctaagttgcttacggtacaacctcaggatccattcatgctcattttgtagctacaaaagaaaaagctctaaaggaaggccaagtgaaatcctggacatgcagtgtgatgaagaaataagggctgctgcttaaccaagagtcaactcaagcagtctctgtgaagttctttctcactgcctctgtttattttcctcctcagccaacacacgactaacagcagcatcttgaatttgcgttacaatttaccaagcacctttattttcctcaatgatcttcataaaaattctgtactatggataagatgactctgttttccagatgcagatccagaaaatggactttccctcagtgtctccagttattaagtagtaaaacccagactagaacctgtgttttctcatggcctcttcaaagttctttctacgatggcatagttccttaagataaaccgagtgaaagaaaggtaactttcactcacaattcaccagaaaaaaaaaaaaaaaaaaaaaagaggaggtgggggagaaagaggtgctacactcagctgagcccacctgtttggtttctgttagctttgaccaaagtgccagtcattacactaaaattctattttgaggtttatcatgaatattggtttctacaaaattcttcattaattaatgctagaaaacacagctctcagtcaattgccatggggcacaatacccaggcactgcttttctttgttcttcccagtcttagggacaccaatccagatagaattacgtccaaaagtagcctaaggccacgtttatgaaataaaaacaccaaggacacaggctgattttagggcaaattttaggtctggcattttatcattctgctctagatctaggggttaaactctactgaaataactatggttgcttttggtggaaacccccttccccaggcccttccagccctggccaggattcaatcatccattcaacagctattcactacacattcacattgtgctaggtgctgggcatacaatgaagaacaagatagacactgcttttgttctttagagatgacatactagtaagagagacacactaaaaacaagtaaacaaacaaagttatgattgactataagtgtaatactctaaaggaaacaaacaggggcactaatggagaataacgaaggcaccttctttgtttagggtggccaagcaaggcctccctggaaagtaagttagtaacagaactgccattaacccacttaggcctagtgttccattactggaatgccaagcatgtgggagttatccatatcctactgctcaaagtcatcgccaaggtctgatttttcactcatgcaaaaattcaaaaaattacaacctccggcatatatgagtcaataagcattccttccttgacctacacatgcttcaatccatattattttccttagtaggtggctgatgaacaggtcaaaaaccaaacaggccatggtagggatggcatcaggcataccgaaaaattctgctttagaaatcagtcatgaaaggtcattccagtttaaattacaatcaacatatagaagctagaaactccaatcagggcaaaaatggcctctttatatcccatcaaggaatcatttatctaagatgacaagaggtatattgccaacaaatccacaattctgtttccaattaatgcaaacttataatattccaagctgttattagatttcaattaataacctgtgatgcctcattaatgcaaatatgctcttcgtggtgctaaaccttcattagtgaaatgggtccaatgacatgacggtttcatatgataatggaactatgattaaaaggcacaattaatcattttcttctactacataatctctgtgacagtttacttatgcctatatgaagcatttgtttcttgcaaacagtcaatttatatttaaactattcaatagcagaaagaaaagcagaaatatcatactaaattatctctaatagttgcaaagaatcccagcaccaagttaggttgttcaagaataaggaccaggcacgatggctcacatacacctgtaatccgagcatcttgggaggccaaggtgagaggatcacttgagcctaagagtttgagaccactctgggcaacatagtgagatcccagttttacaaaaaaaaattagccaggcatgcacctgtactctcagctactcgggagactgaggtgggaggaccacctgagcccaggaggtcgaggctgcataagccatgatcatgccactgcactacagcctgggtgacagagtcaaaaaaaaaaaaaaaaaagtcacagagctggtgccattctccattaagagcataaagtgtgaaacagaaaatctcagtcacacggctgtcagtgctttttctttctcttgtctgtgtactttccattctttgaaccctgaattgctccaccagcaggttcaagccagcaacagatcctgaaccaaacacagcaaaaacaggacactattcccacccctcattttctccccaactaccccacgcagcaaagtctgacttgaagcgaagctgcctggaacagtccattactactacctgcccagtgtccttccccaattctgacaataacactgttttgcctttgcagaactgcccatctctcatatccatgtgggcctggttgggtggtcaattgcaactcttccctcaagcagccagagagagggtcagaagcaaggctgggccatcaaataccccaatactcagcacagtgattgatccaggaatgggctcctgaatccagcagtctcctgggttttttttctgacattcatttactgctaataaagaataccacgttgactccatgcgttagctttgtttgctgtttgtgatttgtggagaatcgcagaagtgaaaagtaacaaacacatgtcaagggccatccaccccactccaacctccacctcaaccgtcacccaagtaaagtccagctcctttagactccctctctctcagtccccagtgttacttattgccaagagacataaagcgtgcaaaagccacacacttctccttctaaagtaaatatagttttaaaaatctattgagatttcattttaattgttgcttagtaaccattgcaagattggaactgtttcctagcttaaaaaataacactataaaaaagatcatttagggccgggtgtgggggctcatgcctgtaatcccagcactttgggaggcccaggctggaggatcatgacgtcaggagttggagaccagcccgaccaacatggtgaaaccccttctctactaaaaatacaaaaattagcagggcgtggtgatgctcctgtaatcccagctactcaggaggctgaggcaggagagttgcttgaacccgggaggcagaggttgcagtgagccgagattgtgccactgcactccagcctgggtgacagagtgagactctgtctcaaaaaaaaaaaaaaattagatatttaaaattaagctgtctaattgttttaaaactcagatgttatagtagctttgcatcggagatacaatcctaaaaaatttaaaacaaaacaaaatgactgggtgcagcggttcacacctggaatcccagcactttgggaggccaaggcggaagaatcactagagcccaggagttcaagaacaacctaggcaacatagtgagatcttgtctctataaaaatttttttttaaattagccggccataatggtgagcacctgtagtcccatctactcaggaggctgaggtgagaggattacttgagcctaagaagttgaggctgcagtgagccatgattgcaccactgactttcacctgggcaatggagtgagaccctgtctcaaaaataaataagtataaagcaaaatgtttgaggattttatttcaataatgccaatctattcctcttcaacgttttgatctaatgtatgaattgtgactctgtcctcttggcaacaaaagtaatgctgggtcttaatcaatgtgcattagtatgctagcaaaatgatacttcttccatatgtagttatatattaaatatatataaaatagaagtgttagatacgactcttatgattaagatatatctttatttaaataactatcccttactggaaaataaatatggatttatacatttttgattaataaatcaatactcatttataatctgatttataaatattttttatttataaacatttattgatttattaagtgcacatgatgtaataatggtttcagtgcctctgccaacaatcactggctgctaagagttgctagagtaatggattgaaaaatgcaaaagggcctgaaagcatggtacgaaagaccacagtgaatgatcggttatgtcggccaaggatgtgggactcagaaatggtagcaggcacatcaagagctttttttaaatctaccgcaacgtggaaaagtccagttgttctaccagtaggtgcttcacctttgtgaagtcacaattctctggctggctgtctactcatctttaaaatgagagttttgattagatgacctcttatgtcccttctagtttgaatattctatgatattctgaaaaaaaataataataatagctcttgtattagcatcccaagcagtctggtgtgggactagctaaatacaggcagcagtgagcttcgaggtgaaagctctgaggaaaaggcagagtagaagaagcaaactttcactgagctgtttagcctggagaatgatacctaaaaagcaaattaccctgtaagaggacttgggaggaaagtgcacagtgaataagtccatcatcttctcccatatattttcaaaaattattcctggaattatgttgcaaaggagtctcaggatgtttgcagccacaggaactggaaactatttcacaaaataggaagtgtagagatcgggcagattcagtgacctcacaatgttatgggtgaccccagatcttctgagctttttgctttagtgaccttgtgaagactttgtcttcaggctagttccctgaatggtgatgagatggctgcatgtagcaattggtgctctttgcttccttgttcggttcctgaaagagactagttgttcttccttagaagcatgagcaaagttctccttaccactatgtggtccaaattggttcctaccagctcatctttgaatctttggcaagacagatggaagtattctgataaggaacaaaagaagaaaaaagcaaacccttgacatctggaaactactcaacacatatagctgggcctcactgttagaaactaacctggcactcatagccaggccacattattatcctgctgggcataaacaatgtcacagaacataaacagctcaagaaaacccactctgagaccatgataaagtaagacaaaacaagactatttcataatttctctctcttttttttttttgagacagaatctctgcccagtctggagtgcaatggcgcaatctctgtgcactgcaacctccgcttccagggttcaaacaattctcctgcctcagcctcctgagtaactaggattacaggcacctgccaccaggcctagctaatttttgtatttttagtagagatggggtttcaccatgttggccaggctggtctcaaactcctgacctcagatgatccgcccgcctctgccttgcaaagtgctgggattacaggcgtaagccaccgcgcccggcctcatactttctctaagcgcagacaaagaaaaggtcactgcacaactcctgagataccaaacatccccgtccattagctactaagagtgactgctacttcattatgaaaaacaggtttagcctcactttagactgtcttccctttagagatgtgagatatccaatcataaaattatccccactttgtgacagcaccctatgcagaatgaatctccctcccttccttagactctcccccaaatcacccaaatgaactccaaattcgttctaacaccctcttactgagatatgctatggttctctgtggtatgtgttctccctcactgcaatgagcaaagaacccaacttcacctccaagtgtgttcctggaggtctctagctagagggcattaattctgattttatactaatgtttgctaacctttttcattattaccccccaaggagcctctttagacttttttttctaatcatcccccaccatttaattccacagatatactgtatatgtttgaggggagggggtttgaaagagggtctcactttgttgcccaggcgggagtgcagtaacccgatcatggctctctgcagcctcaacctcctgggctcagatgatcctcctgcctcagccctccaactagctgagactacaggtgcctgccaccacacccagctaatttttgtatttttagcagagacagggttttgccatgttacccaggctggtctcaaactcctaggctcaaaggatccacccaccttggtctcccaaagtgctggaattataggtgtgggccataatgcccagccgatgtgtgttttttatatagaaagggtaagattctctcccccatacatatcctcacaagccaattttcgtatggtttaaattaaattataagggggtagaaaggaagttgaagagtctaccacaatacgttaaaaagcacacaccttcttagcaatctacctttttagtacagtaatagtaacactcaatgctttttagcactttccacacaccaggcattgcttttatacatctattaattttacacagattaaataattttatccatccaaaaaatctacatggtagatgctagaattatccccagttcaaagctgaggaaactgaaggacaaatgagccaagtgtcatgccccaagtcactaggttaataaatggtggagacaccaaataactgccctctaactccagggaacatgctcataaccatgaggacacattgcctcacactcaacagcggctccagaaacactccgctcaatgcgtgcacaaatgagcaaacgagagtcataatttgcatgatactacactgccttgttccaaatacaaacaaggcagtaaaaattacggacataggataagacttaaaactaagatgtctgctatacagagaaacatattgacggaaatctttcggggcaaatttttaaagtctgtgctgcatgactcaaatgtttcagaaaactaatcccattctgtgcttatgtgtgtgtgtgtgtgtgtctgtgtgtctgtgtgtctgtgtgtgtatgtttacaaggtggaaaatgccttggttaagaaagggaggaagagagggaagaggaaaaggtagtatgttttcccctaaaaattagagattccgaagtgatgatgacatcctccaaccgctagatggaacgcagttctcccacaccatggccatgactgctcatttgaacttgctgcttcatggtcataaggccaggacttcctggcttcctcatgagccaccacattttccatatttttagagcattcttcctacagaagaaacctattttgcattgtttttacaactatcttttttgttgttgttctaatgttgccaaggaatcaagaacctcaaaacctatcttcttctgaggtcaagccatccactcacaggacttctcaagctggagcccttagttgagctgattttacacaatcgagtagagaaagaaaatggctttttgtggtgagcatctgctgttttgttaaaaatgtggttaaagacattaacaaaagtgacattaccagctgttgtaatgtcaagcagcttagctaaactgttttttatcaaatgacaacatatgacacccaaatcaattccaaaccaataacacattgttacttgtaaaacagagctgaatgagagtgagaatgagagcatgtgtgtgagtgtgacagagagagagagagagagagaggttaattaaaatacaaattcaaatttctcctgaagtaggaacaacagacaatatgatcctgataattttcattaagaaatttttaactttatcccagacaaagcaaaaaaaaaagacgattatgcaatccatattcttacacaagaaacagtgtatttcttttgtaaaattcttgtaatagcaaaaagatatgacggagtttctggccacttaaaatctgacttggcttctgtccttcagccatatacctcctaacgagtatgacaataacagaagaactgacttgtgtggctatgtttggtctctctatttttatctgcccatcatgtttaattatcaggctattaaaaggtggcaaatcggtagcattgccaactgcgttgtccctatggctgaaaagcctgtggcagttgaaacaaccaaacccttcccatgggcatcacgaagcttgtaaaagcaaaacggcacaacgtctgcctgcctgccatagtcatggccaatcctgaataaatgtttaatttccacaactgtgatgagggtagggcctgatttgtgccagtgcttaggaatctccgggtatttcatgtgcacaattattaatagtgtaattcacaaatgccaagtctacccttaaggcctgagctcagtcctgctctgctagagttggtgtgacttagtcatcaagaaagaagacactttcaagggcatgattcctcctggaagaaaaacaaaggagtgtgcttaggggataggacgcttgccaggaacagaaggtatgctgcacatggagagtgtttcgaggtaggtaactcaggagggacctgcatttgggggaaaaaaaaacccagaaccaacagaagcagcagaaataaacaagcaggtgtgtgcctctatgtctactacatgaaaggaaaacagggctgaaagtcacaatcagcatatggagacacacaaagaggggcacctgggaaaatcaatgtgcatcaggctcgatggtgcctgcttcctccaggagctcactgcattatcacaggtggataaagtcaccccttcaatgggcacaagtagatcactcttctctgctgagattggattaaaggcgacactgatgctaacagcaagaagaaggtaaaccggacgttggaaagaattttcaacagcaaagccacagtacaggacagatcaccaggagaaatgtatggggaaatgttagaaaagtatggaaagccctagaaatttcaaaagtccagctctgtgaggagacagaggaaggggcagaatgacctgaaaggccattctagtgctattactatacataggaaagcttccttgagggcattacgttttaggtttccaataaaggagagaccattttcaatattttttaaaattttgttgtgtcattttataataacttccaatgtagatcttttaattttactcttgcaataaacctgtacattttctatagtcacctgcctatttaagtcctttattacagaagaggtagaatataggccaaatgccagaagtaagggtcggttacaaattctcaagtgcttgtttatttctggattactttattgactcatttatgtaaccaatgagatcgtgcagtccagcctcagtttccctaaatatttagaaaacaggttgaccatgggatcatagtagtggggcatctggttttcttctgatagtgctatttgttaaatattctgtattatcagatgccctactgtgtgcctgtatatagacttcatcttattctaatgctaactttatgaaatgcatttcatttttaccttctttatagatgagaaactcgctagcaatcacaattaatatgaggagaagttaaaattggaacccatgactgatttcagagccaacattttttagtcactacgctatactcctacctataaacttctaaaaacactgttcacaagtacatcattcccctatggcttccctggatattgagagacctggattataattggaatttttgactaaggtaaacatttcaaccacaagacctgatagaatctttcctatgagaattggtctcaggcttacaacaaaactagcaagttcttccagagtacagagcacccctgtttgaggcaagacccagaactttaaaaaattctaacaaaggtcctagtttctcacacagagctcttggttttggataagacgactttagcctaggctggactgaagacatgaggggaagttctgcaaaagacattgtgcacacattatctctttcactgccctatggcccgtaagatgttcctaacctggaaactgagaactgcacaggtcaagtaaggtgtccaaactcacccaggtcctaagaaacagagcacagattcaagcccagttgtatctgcctccaaaatgagtgctcttttctgttacaatacatgctactatgtcacctccaaaggtaggtaggtactacctttacccacacgcgtgttcttgaactccccttacatctcacctaatgtgaaaagcctgcatgaccccctgggacatataaggccctgggtagtccacaaccaccacccctccacgtacacatcagccccctttcttcctgttaactgccacagaagcctccttctgttcctccaaggccccctgtgctttcctttgtacatgtggttcccctgtcaagaaaactgttccctacccatctctgccaccttgctgactcctgctcacccttcagacctccctggaggaagcctctccagcatccctggccaggccagatttctatggtttacagcagagtttctcaccctcaacactgttcacatttggggccgggtgattctttgttgtggggtctgcaccgagcatcatggaaagtttagcagcattcactagatgctggtagcacctacccctcagttctgacaaccagaaatgcctccagacgttgccagaagtccctagaggacaaaatcactcctagttgggaaacactgatctattgctctttagaatcactttccttatcttcagagcactggctccagagcacaggatgtgcttctgtcattctttgaccatctcctccacgtgaaaatgagtttcttaaaggcagagacagtgctggcttctgctcaccctcaaatgtccagtgttcaggggcatgcctggctcaaagcaggattccaacaaaaacattttttttggaatttctccctaaaaaaggtttggtgggagatcataaacttaagtaggtagctagtggaagactgctgaagcttttttgaataaaaaataatgccagcagagttcaggtcaggggaaatgaatccctggcaggatggacattaaccaaacacctaacacatcagcagaactttctgccaaaggtgttgagaggttatcagcagcccccacagcacaaacaggtgtcagaatgacatcccaccaaaatggcagcagggccctaattaaaagaagaggctgttctttcaagtattgccatgcagccatggcactgctgggatgtgtcaaatcacacccatctaaaaacacacaccacgacctgacatctttgcccagctgcaccatcccacgtttccgtgatggatattagaaaataatgtaacctcaactgacaagtttattaagacacagaagacattacagaggcccttttgacattccaatctctaacgcagtcagggggagatgctgacttgccatcattattgaaagtaattggtcaaaaaaaaaaaataaaagaggtgagagagaaggagagcaatcctataaagctgtcaggttaattatttggcctacaggtgtgctcagtgctcttgatctgcctaccactgggcttgccagtgctttgccagtgttttctccaccctcactcctagtttgggatagttcaatctaaagctaagagagtacatttaaagcagaattttaccttggccaagttatttccttgcctaattatacctacgtaccagtccaaatctccattcttccctatggctctgtcctgttggcataccaaactccaattttccaggacagataacccagttagaaacaaccgacttgtgtgaaatgccacagagagtcacaacgcaaaaacaagttttattcagattgaatttaatttcctaggcagtttagatcacagatccgaaacccagacattttcacaagccaggcaaataacctgaatgagtccagtgagtcagatgggagccaaaaggaagtgatgaggatgatgacaaacaggaacagcaggctgtgagctcagtgttagcagagaaaacccaccgtgccagggaagctgctgatgctactccctggctctaggtccaccacacgcagagtagatgctcaattaatattcagtgaatgaatgaatgcctgcccaagcattcaccctgttgtttccatgtctgttatttccaccagaagaatgttttgtaggcttaaatctccagtgccttcagcgcaactgtcatttggaaagtggtgaactttaggaattaaagaatggaaacaaagagtacatgggagtcactaatgcatgtgggagatactattcatgccacttccaagaatggggaatccgtacagctcattgtcataagtgatgttatttccaacttgttatgggtgagcattatttagaatagcttggaagaccacaatattttgcaatagacatggtagcctgtcagggatacaaaatgaagactaagactaagaatgtcaaatgagattataaagatacctatctttgctcaaataagcaaagggaaaaagtacaccctctgcctcttctcctctccttaaattccttttccccttactctctcaaggagtaaatatatatgctcatatataccaacataaaaaggacattggtagaagcaaacaatacagaagagtataacgggaaaaatacaggtcccactactgagaggtgtcctcggtgaacaatttcagggctgtgtgtgtatatttacgtgtgaaacataaataggatcgtgataccttacagcaacttctgtttttttcaccggacatctatggcatttttttatacttacaaaaatgcctcctttgctctttttatctactgttccataaaaactcactttataaacacaaaaggccaatttttctcacattcatcaaggaaaggctcctgtaatattgtgctcttttttctacctccaatattatgtttaagcaaatcatgagaatcaattaaaaagtggctaacattggcttgtttctactgtaaggactgtttttccataatttgggcttgaaaaaaaatagggttgtcaaagcatgaggtaagtagaagagaagcattaaccaggggtgttaggaacaggaaatgtatttttgaggaaggttttggaagaggagttatgcatccaaagggttcagaattatgggccaactattcctatgtacaaattgaagacattatataaacactacaagaactgaatgcatactcatctttggctgctatttcaaacttccagggacaaatatttgtccttattataaacatacatccaatatgtgttaagtgctcagaacatgtcaagcagtgtgctaagcagtacccatgtactatctcacttaattctcagattcaccctgaaagtaaggtactattattatctccagtggaaagatgaaggaattcaggcttaaggctacacaaagattagtgagacagcaaagatgaatcccagcaatctatctccagaacttggaccctatgaccttcacattatacgtttaaaaatgtcacagacagatggacacataaaactgtgttgctttcatgtcctgggtttctcttctaaaagcaaagcatatttttgttttctctttccctaactagatttccattttctttggtgagcttaagggagtgccctgccaccttaataccaaatattatatctagggtgagaaggagagaataggaagagcaagcagcaagggccttcagaaactatttgtacttgcctcccaagatagggcagcttgaccttatccatgtggctgacagtccagttgctctagtcatgcacctgtgagactactttctgctccctaaatatgccaaacacacaccatgctttgcatgggaactctcccacccctcgacactacccagttattcacatgaaggagtcttcactttcatcagatttctgctcaaagactgtctttcccccctttctaagagttctgcctcattaacctcttatcctataatctgttttgtgttatttttggtacttgtggaaataaagtgccatacacagtcaagtgttttgtgaatgtcaccatcactttaagcctcatagatatcccacttctggaacaatagaagtatgatgcttgataactatttgttgactaaaataatacattgcatactacttgaaacacacctcttattctagtaggaattatctaatcaaagtttgtgcatgtatgtaaatatatccatatatacacatgcatatgtgtacacacacacacatatttgcattttgcagtttagactcttaattaccaatagaggaaactcagtaagtagcatgatagaaatgcaactagtataaaccaactgaattacaaacacaggacttagaggataactgggcattgcaataattgtgaaggaagatgcttagtgaatgattagagggcaactatgttctgatatctgtgaatgaactgcacagtcttcattaatttcacagaaaattcatttttgtcctgttgcctatcctgccatgaaagtggagaattgctcagaatctagctttagataataacatttgtaaaaaattaaaatttgtggcagggcgtagtggctcatgcctgtaatcccagcactttgggaggctaaggcagatcagttgagctcaggaatttgaaaccagcctgggcatcacagtgagacctcacctctacagacaaaaagcaaaattagccaggtgtagtggtatgcgcctgtagtcccagctttttggagggggaagatgggctgagcctgagaggttgagaactcagtgagccgtgatcacaccagtgcactccagcctgggtaagagagtgagaccctgtctcaataagtaagtaaataataaacaaatttgttatcaacttgtcctgagttgatcaagttgctatagttaactatgaatttatttctgattttgatgttcatagttgcagaaactccaaaaactcctagtcagtacacagacggaggcctggcaataaacacttgaaagaattgcctgttggatgaatgaatgaaacaagagaccgacagacttcatccctccagagagatatcttctactgcttctctatgattgttaggccgatgtaattaatctaacacatggagcagattttacccttcattttcaagtacattgtctattaacagcgtccatgagccctctgattatgcaaggttcctgttaatggatctctgccaataccaaccatcaagctaatgatctgagcttgccagctccaaggtgaaggaccactcttgggcatatctctccaggactcaaagaagaatcccctctccaaatgatcttggagaagcaggtgtccactctgcctgccagaggctctgccagcacagggtgggggcatcaagggaggagaaaataaaacccagtaattcatatgggttgagattattgacttcactttcaaagaagataaagtgaaaaaggaagaaccgtgtttttgaaaggtaagacaggggacattatcctgcgtttcatcaagtcagctttttcatgtcaggcgatggtatatctcctgtaacttgtcaatggcaccacacagtgaagctaaaaggttgaagattatttttgtaacgattgatactctttctgccacagcagtcaagcatctgaagattcttcctttctctcctctgctctggtgaatccttttaaagttcttgggtgaaagagctgcaaaccccagcagatatcaaacctgaaacactaacttgacatatcgggatgtgtgctgctatattcactgcttggcttcaggccccttccagagcacttgaaatacagttggaggattctttgaatatggggtaaaagtacgtggatgacctagattgtcaaaggattctcttcaaccaaataagaaagtaagtttgggtcagcacatgctatcagctagaaagactgctcaaaattgtgtgtgccaaaataatgaaagaacgtgccaatacgtcaatccacgtttgtttcctgcccccgttcctgccacttcacagctctaaatagaaacacacgaagagaaattccaatgaaacaaaaggaatatctgaaggatctcacagctttcaggggtactgtaataccctgaaaacagtgtggttattccgggctccacaaactaggtagaaataaacatccatcattgcatagggcaggaagaacagcaaaagcatgttggctaatttataaatgtcacatacagtgttctttgtttcattgcatagggaggcaacgtaatgaaaacattaaaaaccatcttttggtgataattgttgttttaaactgacaaattatataagtcaaagtgaaataatctttgcaactccatagagaaacagaaaactattaaggcccttagaaacatcacaacccatgttcccctttcaaaggttagaataatcctgagtatattttgggaaagtaatatcctaagtcagtaaaaggtcagtgacagggaagattcttccacatcttcaggagacaaaaagtcccctggagaagagaaaccaggttccctggtgacattccgcagaaatctccagctgttagaagaacttggatctccgaggccacccaaacttcaacttaagaatgcaacaaagtggggatgaaacagttcccgggagggaggaggtagaataaaaatggaagcaaagctaccctacagcactaatctgtaaacctgcttcaattggcaagaaaaagaggaagtactacacatgcctgaaatgacaatgtagcacatggaatggacctctgctgttttcgatgatccagcattcctcctgattttcctttgggagaatcatttttcacctactcacagttcacatgattggagaaggcgccttctgggtacaggcatataactaaactgaataatccattccctgacttcatctttcctgtgcgagttggtccaaggacttttgttgaaaccactggaagagagtggctttcttgacagcaggttaataagatggatggaggtaatcaggttggcaagtggctgggcaactgtccttatcaccatacaaaggaaatcttccagagaacaaaggaatcacagaaggaagtggatgtgaaagacagccagagattcccaacaatatatgattctgtaaatccaaccatgaatgaagcttggtatccccactatttgagccaataactcctcctgttggctgaagttactttgacatgcattcttatcacttgcaactgataatccatcccacgtgagtataaatgtgaagaaatcattctaagtacatccaccttaccaaatggaccatgttttgctcaccagtgtgaccccagcacttaggacaagagatgatgtgagaagacttcaaattattgttcaataatttttttaatgattatttgttaactcatgaattatcttccatattcatatcttttaaaaatgaaagaaaatcaaagcaggtttctcctttctgtctaaatcctagcaagatcaaacactggggaaaaaaataacattctcccatatctatctgaccccagaaaaattattacttccaaatagtatttagtttttggcagttatttatgaacaggtaatctatataatttaatagataaacctatttaattatctattttttctcccacaaacaggaagaccagtgtcaaaatattgagcaactctcctaagaacaaggcatgcaatctcaaattcctggttttcagaaaaggttaattggacaagcaaaaacaaggagccaacttattggggagaactggaggcctaggaaaaagaaaaggcccaactttctatccccaacagacactttgggaactgataaaattaaacatttttcaaagaccctccatttcctattaccacaagaaagtcaaaatatttctatcttttaatttaactttatcttgcttttctttttgaaattttaatttagggcaatatttctgagggatgctatttttttttaaataccttctttccttcagctaatgtaaaacaaatagttactcctggaaattactttttactattggttccaaagctacaatttgcagcaaataaaaggactcttcccttctacagaaacattcagacaactacatattgagaggaaggtttatgtgtacttggagcctttgggtgatgttctctttggccatatgatgtggtactcccatcagcctgccatttagtgactcctatcaaagcaaacctctctaaaaacagacacttcaaagaagatgactaattgtgggtgccaactggatgctgaattgctgaatttctgaatggtttccatctcattttccaaagaaaatgtaaaatttcagagtaaaattgccacttttcttttttcacgatgtagtatttggtggcttttaaattcacagccttctattcttggaattttttaaattttaaattaactttccttccttcattccacattcatgcattcatttagtcattcattcattcgtttttttggagacaggatcctgtcctgtatacagcccaggctggaatgcagaggcatcattacagttcactgtagcctcgaacttctgggctcaagcaatcctcttgcctcagcctcccaaatagttaggattataaccatgtgccaccctgcccagctattttttttttataaatgggatctcactatgttgcccagatttgtatcatactactggcctcagtgatccctcttgacccctcagatcattaaacatttattaaatgcctttcacgtatcaggtagtgaaccaatgctgagaacataatcatgaacaaaaatccaaacagccccagtttttacagaatatccagattagtaggggagacaggtattattcaaacaagcacataagtttcttaatacaacaaaaggcgcatggctcttcaaatacaagtaacagaggaatgaaactgagctcaggaagtcaggagagctagttaagggagtgaaaatacgagttgagagccaggtagtaaataggcctagaagaagtatgggttttttgtttgtttgtttgtttgtttgctttgagatggactttcattcttgttgcccaggctgcagtgcaatggcacaatctcagctcactgcaacctccatctcccaggtttgagtgattctcctgcctcagcaccccgagtagctgggattacaggcatgcaccaccacgcctggctaattttgtattttttttttttttttagtagacatggagtttctccatgttagtcaggctggtctcgaactcccaacctcaggtgatccgcctgccttggcctcccaaagtgctgggattaaaggcgtgagccactgcaccaggactgaagtgtgttttgttagaataagagaaagaaagacgtgggataggggcagaaaaaatgttgggaaaacggaaagaacagcaggaacagagaccctgtagtggaaaaaacttagtatatgtgaggaactaaaaggcagccagggtggctggatactgagacaaggttggtgtgagatgggcagaggctcctccaagcaggactgtccaggctgttgcaggaaagaggtcttctgtctactagtaatagaaatgatccaatttactccattaaagaaacaaaactggatatattcaacacattttctctgtatctaacatttcagtagaagtgatataaagattgctaccacatattctgcttgcttcacctacatcttactgtatgatatgggtaacgaataaaacacattccccctatctccattctgtatgtatataccattattttatttcatcatggtatctgaaaagcaattataaatcatgattacagcagctgaaatttgctgaagacttactatgagcacggcattggaccaactactttctgtccatttccacactaaaatcagctacaaccttaaacagactgtcccatccaaagctagcctctcaggttgaaagatcatgatggattatgcagcagggacccaccattcccagactggtatcttagggtccagattccatccatcaggcacacctgggaagaaggcaacctcacttggccttctattcaccagtgaatctcaagtatctctaatgatacttgtggtagtgcagttttctgagtcagccaccctggtatgaattagactgggtaaagtgaatgttcatccatggatgcagctttccattttttagtggcttataaccaaggcatactgctcttaggagtttatttcagagaaaaaaagtatgaacagccaccatccttaaatgtacaaccttttctctgcaacagcttgtccttaaatccaggacacaggatgacaaatgggtttccctgccaggtcctgagaggtctgtgggaaggtgaggcctaggcaggagtggagatcaacgaagcatgaaatggtggatgtttccggggctgcagaattttggagaattcctcacgctgtctgctcaactggtctcagttctcagtggactctgtggggtcaggaggagccctttctctgggttttccctctttctccctcagcagagaaaatcgagaaaaggacattaaattcagtgcagtcactgtgggtgctaaaatattttcaggatcaatggtggtgctaaactatctccatgtttctaatatatatatatatatatatatatatatatatgtttttttttttttttgagatcgagtctcactctgtcgctaggctggagtgcagtggcgcgatcttggttcactgcaacctccgcctcctgggttcaagtgattctcctgcttcagcctcccgagtagctgggattgcaggcatctgccaccacgcccagctaatttttgtatttttagtagagacagtttcaccatgttggccaggatggtctccatctcttgacctcctgatccgcccgcctcagcctcccgaagtgctgggattacaggcgtgagccaccgtgcctggcctgtttctaatatttttaagactgaagtgctttttaaaaagaaaaaaaaatcttatggctacaccacaaaaatgcagtgtccttgggtaagggacccacccaagccccttggccttttactttccaggtatcatttttccctttgatagtactcttgtgtctgcaaaaaatgctctgtcttgatatgctcctggactgtaagattttgattgttttgttttatattttgtttatgtttatatgcatcttatatttccctgaaaactaattaacactgttggcctttctaactggaaaaaaagtctattatttttatactagtgttacaaaacagaagttcagagagaaaatataatttggccaaaatcacatggctaatgagaagtcaagttggaacctgattataaatctatttgctttcaaggtccatgcttttttttttcaagctcagataaatttcacataatataaaattaaccatttaaaataaaccactcagtggcatttattaatatcaattcataatattgcacaattatgtctatctagttccaaagcattttcatcatcctaaaataaaacgccatgcccactcagcagttatttcttattttctttttccccagcccctagaaatgaccaacgtgctttctgtctctatggatttacttattctggatatctcatataaatgcaatcatacatttgagtcactacagcagttaacacagtgcctggcacgtagtgaattttaaaaaatataggttgactgtgtgaacgaaaggataggggtggataatgattaaaccaccataaaatcctgagatattgttctaatatccactgcatgctctccacaaatgctccttcgaattttatcttctgtgacgatgacactatgtcaacctatccacagagcccagcagtgttaatgccgcatgttaataaaacacccctctttccccacagagctggatttttataaaatgaagctttagaatctagataaccaggacacagtacactgaatgtctactcctaatatgtttgcacaaagctaaactacacatattgctacctaaaatataaaactaatgtgagtgcctacagaggaaaatgtggaatgctgaatagggtgaaccccctgctattagcctggaaatgatgactctgttgtgaatctgtcctacagggtatctcagggtctgagataatagcataattatatatgctaactcttcctagttataatatcttggaagacaaaagatatagggtaggagggaagaaaagttaagccaaacaaaaagaaaagactaaattatttttactcaacataatgactctttgggaagtctaaatggcaatacgagcaaagttacaatgcatacttcagaaaggagaggtaagatagaagataaaagctgtgcacatttatacacatattctacaatggacaataaaatgagaaatgcacagtttttcagaagggcaacaagaacacctctacctcctctaaaaattaggatatcaccaacaaatcgttcaccaagttagaagctgaagcattttaaaactcaatgctattaacagcatacttgatataagcagaagacagtgggtttcattactgttaactaccctagtacaacccatagaaaccatgactcagtctgaagtagcacactctaatagaacttcctgtgataatagaactgttccagatctgttctgtccaatatggtggccactaaccacatatatttactgagcatttgaaacggggctaatgtagctgaaagacgagttttaaatatcattgagttaattaaactcaaagttaaatttaaatagccacatgtggccaggtgtggtggctcacgcctgtaatgtcagcactttgggaggccaaggaaggtggatcacctgagtcaggagttagagaccagcctggccaacatggcgaaaccccgtctctactaaaaatacaaaaattagccgggcatgttggtatgtgcctgtaatcccagctactcaggaggctgaggcaggagaattgcttgaacccaggaggcaaaggttgcagagagctgagctcgtaccactgcactccagcctgggtgacagagtgagactccatctcaaaacaacaacaacaacaacaaaagccacatactagtagctactatattagagcaactctatcagatattaattagtaaagaatatagaaatactctctagcatagtttacctgcatttcataagggcaatcaaaatagctttaagcatgtgtagtacaggcatacttctcaaactttaaggctgtgtgatatataaacaaacacctggcaactgccatatggaaacggacaaacacctaggtaggtggggtagagatggaacaaagtggaaaaacacaagtcaggtaagtaaaaaagctcatcgagggctgaaatgtcccaaagacttggagagtcaggccttcctaggagctttccatcttacaaagctgagtattggcaaatgttaccagagagatttagcacgaggaggaagctggtttaatgaaaagagctgcgtcaatcatgagccgatggaagtcctgctctagcctttggctatcgagccataaaatccgttgcttggaaatatgaaacccttttggctacttaatgttttctccaattcctctaactcagggaaaaggatcatggaaagaaaccaaggagggcaaagcaaggagaaaggccagaaatccaaagaggaagaccagaaacaggaagaaaaaatacaacataaaattgtgggagaaaaaaaaatgctcatagggagactggatgctcccagggtgaaaatgatgaaaaatctgtgcgaaagagcatgcccaagcagttagcaaagacctttgtgaatttatgtacaaaaccacaaattacacacatgcttcccaggaacaacaaatgctgcccataaaaataaatacctgccattaaaataaataataaggaggggaaggagagagagggtcagggaaataatacaataagccaaggttaaaaaaaaaaaaaagctagaagaagttgaacttgacctagaatttgatagtcagttacttaatccagaaaaaatgaaactgccaggcaaaagtactagcacaactggctatgaaaaaaactaaaggcattcacaaaggtattggtaactcgtcttatgatcagtttctccctaacactaaagtttccaattaaaaataaaaaacaagtgaggtaaaaggaatgattctaactatagtcccttcgcatagaagtaggtcaaaacagaagaggcttactgggatggggaaacagacaaattccattttgtaatacaccatggagaaaggtgtttattgaaagtggcagctttagcaccattgttttgcactctgagattagtgatttttgaatcacctcctatggtattacttttactgtgcatttagcaatgtcagctgagatataattatgccaaacctagtgatatgatcatctacctttcaggttcagctaaagagttctcactccatcaagacttctttttctctgaaaaggattcccactaaaatactgtcatttcctttgctttgtcacaatcacattttggtataggctggactgggtcagtgctgtgaatctgagaggagataatgtacttcaagtcccaaagtattttgagttgctggtatgccacataggattacaatcacaaaagaaagttaatagtgtgactcaatgctgagagtcctagctacgggaaagtgagacaagattggtttcatacctggcagcactagaatttaacgttaatatgaagtgtcctgattagctattatataaaacactgaaagaagaaatttctgttcaggaggtattcagaagaactgaggaggatagctggctatttagtgccagagagccaagtcaacttccaatccccatgggcttcttcagtgcacatgacctatggccaagccccatctttttatttcacaaatgttaacttcccaaatgggttagcaagggaaaactatcattattataaagaagcgcagataaggcagacacaatggctcacacctgtaatcccagcactttgggaggctgaggcgggcggatcacctcaggtcgggagttcgagaccagcctggccaacatggtgaaccctttctgtaataaaaatacaaaaattacctgggtgttgtggcgcacacctgtagtcccagctactcaggagactgaggcagcagaatcacttgaaccctggaggcagaggttgcagtgagccaagatcataccactgcactccagcctggacgacacagcaagactctgttggtggcggtggggggagggagaaagaaaaagcacagatatgtcaagtcagattcacttcatcaactctaagatttaaataatactaacactttactcactatttaaactacgttgtttttcgtccattagctcttcctcagcaatctgatcccatgtgatatatattgaagaaagactttcacagatcaaataaggtagggaaattctgaaaactaaactgtattcctagaaatataccatggtatgagcatattaaagaccctgagaagttctgcagtaaagaaatctgatattgccctctgtattctcctaaagcgttttagcttggggacgattttccctttgttctttatataaaatacgtattaccatctcatattcagagccctataaaatatacttcaagaaatactgaggggccccttaattacactataagactcttaacatacagtaggtttgtaaaaagatagtaaaaaggattaaagattcctcagaattagcttttcatgggcagcaaaagaagtgagaaaagaatggtatttattgctacctaccacgtggccgcattccattaggcgcatttcagtctcagtaaatcaccgcaacaattctctagtaggtatcattattctcttttatgcagaagagaaaaccaaagttcatagatgccacacagcccactcacggtcccagagttaagagacggcagggcagggatttgaaaggcctgtgccctttcccctatatcacagtggtgtaatcttttcacactatgcatacttctataaagcaaaaccattttgaaatatctgtcctgtgtgacatcacaatattgttaatggtttccttctgtttccagttgtctgcttagtataatgaaattaaaccattaaaatggaaatggaacttgttccgtgaccttccctttgtgagaatatgccaaattaaatcaacatgggatttttggaggatgtgccatttttttttaagaacagggtctttctgccaagacaggaaaacttataagaaattcaactacctagctacaggacctcaaatattaggttataatacatgtttctgtaggttgtaagtgtgtaaaaaaaaaaataggttccttcaggtttaagaaatccaaggtcatgaaaacaggcatctggccccagctagaaccctggtctagaacactaaggaaaagctaggccatctttcatttcttcctgacatcttggtctctctaaacgggttctcttcgttctgcatgctacatgaaaggaaacagctaccattaattccccagtattgctctctcctcatatgtgaggtcaaatagattcaagatggaatctgaatgacaattctaaattctctgaggaattagagcccaaccttggaggcaatcctccacggggactatatgtaatatatttatgtaatgtaaatatggccaatggaaattacacagctgtaaccacacaaactgggacaagcagcctctggagagcatggagagcagtggtgtttaggccaccaaaacagcttatacaaagacttgacaaaaagcacacaagctcgtcaatggaaaatttatgagataatgctgaagtgatttttaactaggaagatcacgggcagcaaagtgagtcaagttttaaatgaaaagtagaaaaaatataccgtgctgttgcaacaaaaataacccaacttgtgcttatgctgaagttataaaaaggagaaagagaaaaacttcacacctgcaacagcatcattaaaacataacaggatggtttgggtttgtcagaattaagggccacctgctgttccacacttcaccctcatcccaatcccagtccctgaaagaaatgaaaagaaagctgaaggaattttcatggagacaaaatcgagcagagactggatctgccaaagactatttttctagtcttcaagaaatatcctgaagtactgtttctaacagcttcattttaaaaaatattttagctctttgtttgtcttaggcattcagaatataaaatgtacattttatattttaattctctgttagaaaaacagggcatatgttgtaaaaacgtatggaggtcttcctttataatttgacgttgatgctttttcacagataagcatttatctttcagaatctaaataaaatgccatatttaaattttggaattttaatctgtatctggaagaaccaaacagaattttcaccatctctaaattactggattgcaagattaaagaatcaagtactttgatcttatttaacttgtacagtactcacaaaatttaaaacactgcacatattttaaacaaactaagtaagcatttacttatatttgataatctggatatttttaaattttctattttaaaatgaaggtgagtaggaaaaattacagtctctttaaagtaccatgagttaaactgccacattgatggtaccatttaccaaccagctatgagaagtaacaaaataaagttgcaccaggaatattactattactctctacaatcattacacagattacaaatttttttaatttttttttttttttttttgagactgagtctcactctgtcaccaggctggagtgcagtggtacaatcttggctcactacaacctctgcctcctgggttcaagcgattctcccacctcagcctcccaagtagctgggattacaggtgcccaccaccacatctggctagtttttatgtttttagtagatacggtgttccaccatgttggccaggctggtctcgaactcctgacctcaagtgatctgcccacctcggcctcccaaagtgctgggattacaggtgtgagccacagtgcctgaccccagattacagattatcctcattttacagatgggaacatctaggttcaaaaaggtaaaggaatttcccaaggatatatagctataggctaggattcatggcctggtctaatgtcagaagcaccccctattaccactggcatcaacagaagaccagagtagagtttaggttgttagtaaagacatgtttaataagcacaaagcctcttggtaataattaaaattgaaaatcttcatacagatttgtgatctggtctcacaaagtgaaaagctcaatgcatttcttttgcatttattgactttaattttcatttccatagctctttatagccttcaagatattgtcacattatctcattctgacagttatatccttcatattttagcatttattaagttgttacatgtctgactccaaaagaaatggaggtacaccctcctatatatatctctacctgtgatacatcatagcaatcaccttatgcatgatgctctgaaaaacaaatccgaaatatgcaacagcctagataaatgggatcacaaaatccctggtggggacttttaattatatgctaagtaagaggcaggttatgcagaactttctgaaaaaggggcagagggttttcagaacgatatgagataacttctaggctgttgccatggcacttgtaaactgtcctggcgccaatgggagtgtctttatgctaatgagcaatgaaggcaactagaggttgctttcctccccacctggtagttttggctggcttcttcactgcatctgaaaacgggattgactaaatcctgcttctattagtgggaccatgacctgaaaacaaatcctacaggcctcctacctcaacaaggcagcatcaactgttctcacaataaaccaaatatcaatgattccatgatttggtgagagcactgcctattagcatctttaagtagcacaaaacatggcagcagacgctctccttcatattaggttgcatctagtcactaggcaaaatcttggttagtttcctttcattttaaattttgctcagaggcccagtgggcacagtggctgacacctgtaatcctagcactttgggaggctgaggcaggcagacagcttgagccccagagttttgagaccagcctgggcaacatggcaagttcctgtctctacaaaaaaatataacaacaaaaaagtcaggcacagcagcacaaacctgtagtcccagctacttgggaggctgaggtaggaggatcacttgagcctgggagcttgacactgcagtgagctatgatggcaccactgcactgcagcctgggtgacagagtgagaccctgtcttgatcaatcaatcaatcaatcaatacttgtccaaatgagttgttagttcctccttttattctctataaatgctgccagtcgggggcagtgtgtaaaaagcagaaaaacaaagtcaaaaaataatggagggttaaaaaaaaaaaaagaaaaaaaagaaaaaacaatggagggttccactcctttaaaagatattctgtccatgacaactccccctctgcccatttcctgaaagaataaaaaggatatgtagttctttctctctgacatcttctgaataaagtatcaccttcaattcaaacaggtaaaatatcttgaaaaagtggtcagaggagctggccaggcacggtggctcacacctgcaatcccagcactttgggaggccgaggcgtgcacatcacttgaggtcaggagtttgagaacatcctagccgacatggtgaaaatccatctctactaaaaatacaaaaattagctaggtgtggtggtgcatgcctgtaatcccagctacttgggaggcttaggcaggagaatcacttgaacccaggaggcagaggttgcagtgagctgaaatcacaccagtgcactcaaatctgggcaacagagtgagactctgtctcaaacaaagaaacaaataaacaaacaaacaaaaaaataaaagtggtatgatggaggattgttttgaaagtgttttgttcaatttgaagtcaacaccgtgactaacaagtttgactgacagtgtccctcaatcagacacacttagaagctccacagacttgaccagaggttccacagacattctgggtacttcaaaaaatcacaccacaggctcaagtgtgccatgtcacactcttttcaaaacttgacaatgccaagtcaatcaaggaaactgattaagtgatgccgacaccctcttgcctccccagaatccctttaaaaccaagaccaactgtgtccaatctctattagggccagtaacttttactaagaaaaaatatttcctactgtggcccagatcctgatgacagtcaacagcgttaacgtttttactttttaattttagactagttttaaatctacagaaaaattataaagagttcagagttcccatatatgccacacctagtttccactattattagcaacttccatatatgatagagttgttacaatcactgaactagcattcataaattattatttatattaatttatttttcgtttttttttttgagtcagggtctttgccactcaagctggagtacagtgacgtgatcagagctcactgcagcctcaaactcctgggctcaagtgattctcctgcctcagcctcctgagtaactcggattaccgggcattatcacacctaatttgttttttattttttggtagagaccaactcttactatgcttcccagactggtctcagactcttggtgtgagctaccatgcctggcctctgagacattactattaacaaaagcctctattttattgggatttccttagttttcaatctaatatgctttttctactccaggaccccatccaagataccatattaacataacttatgttgcttaagacttttcttagttgtgacagtttatgagacctttactgtttcttatgaccttaatagtactgaggcaagtatgttgctgaagtccctcagttaaggtttgtctgatgtctttctcatgattgcactatgtctatggttttttgggaggaacaccacaaagataaagtgccatactcatcacatcatagcaacgtccatattatcaacatgacttatcaccgatgatgttaaccttgatcactggttgaagtattgtttattcaatttttgcattctgaagttactcttttttcctcctttttaagctgtacactttggacaagaaaccacgtgtggccgacatttaagatgtgagagctaggctccagctccttgcagtatttatgagaactatccggaattctgctaaacagatttttcaattctacctcatttatttgtttattcaatcatttatttccatccctatttattcaaatctttttttatattttgggttataattcaatagtgtttattctgctgttcgaagcgacccatctttggcgcttgggaactccttgagttggctcctatgtccctttaacacactcccattattgtgatttattttgttgtgttttctgagcactgtcttacttcttggcactataacgtgctccaggctcatcatgtatatttcttgctgaagtcccagaatttgccatttctccaaagaaccttggtttcttttattgggaaatggaattagaaacaaagatctgggtgttaggtgtatttgttgctcccacggtttattcgtgaagcagaaatgtaccctggttttagtaaatgcagaatgtcaggtatccaccatttacagcgtcaaattgaatagtttcatggtgtggggaaaaaaaaaaatcgcatgtttcacctattaaacctcaccccagaaccttcagtaacaatgatttgtttaccatctccatggttttgtctttaccagaaagttaataaagttgcatcatgcagtagatagccttttcagactagcttctttccttagcaatatacatttactattcatccatgtttctatgtatagttcattcctttttattgctgagtaatgttccattctacagatgtaacagagcttgtttattcattcacttattgaaggacattttggttgtttccagtttggggaattatgaataaagctgagacaaacattccagtgcagggttttctaatttcataagttttcatatcagttgggtaaatacctaggtatatgactgctggattgtatggtaaaactatgtttaactttgtaggaaactgcaaaactgtctttcaaagcgcctgtgctattttacattctcataagcaatgtatgagagtccttgttgctctacatcctccctattaatggtattgtcagtttttggtatttggtatttgctctacatcctccctattaatggtattgtcacacaccagtggctgtgtgatagtatcatcttgtactaatttgcaactctctaccaacatgtgacgttgaacatcttttcatatgtacgttttccatctgcacatctttagtgagctatgtattcagatcttttgatcatttttaaaattagcttgttttgttttcttactgttgagttgtaagggttctttctatattatggatacaagtcctttatcagatttgtattttgtgttctcccagactctggcttggcttttttcttcatagtgtcttttgcatagcttaagttttcattttaattaagtgtaacttacgatttttttcatgcattatgtttttggtggtgtatatacctactaacacattaccaaatacaagatcccagatttttttctagattttatacttttgcatttcacatttaggtctattattcatttgagtttttttgtgacatatgcaaggtctttgcttaagttcatatttttacagtggatgttcaactgttctaccaccatttgttgaaaagttatcctttctccatgtagtcacttttgtgcccttgtcaaaggttgactgaatttgtgtgagttagtcaactgtttttcaaaaaggctcagcattttcgaaaatccaagaaaacaggaaggtttaacttgaagccaagagcaacttgacagtggcagggcaatgtcatcactactgtgtatgtaggtcaaaccaagaatgttacacagtcataacggaggtgggctgcgtacagaacaccctgcatctcctaaatggtttataatcactgattaatcctctgtgagtatagacgggcctcattagctctagtaacaaggaaagacagtgttagattgataaagctaaggttgggaaagagaaattagagcagaagagctgtaaaaaggatggaaagtgccatgcccgcaaactttgtagatggatgtttttattgtatttgtttttttttttaacaaataccaccatcttttcattttcttcctatgttctacactccctcaaattaggaggcataagatatttaaattcaaatgggagctttctactctagctcccactgatgtgtatttcttattaaagctttgtgattattttgtattttaccagttcatgcccgtagagtgttgaggcctattttatcaaaactgaaatagctcgtgattagagcttacttaaaatatgcaaaccaagacaaggtcaaagcaacctttctttcagagggtcctgtgggggatcaaatggtatacattgtgattcattttcattcttcttctgtgtgtttacccatgatggccagggaacacaaaatacaagcctctcactggagtcagcgtgcaaaatgtgaaaccccctaatgtcaaactgcaatcaacacatcacaagcctgtcattaaattggcttcacaaaataaaagtgagaaaaaagacaaatgaagttaccacacgtaatacagaattgaagtggatgaggctgaagtttagaagagaagttgtcctctgaggaccgaagtataaatgcagtttttaaattaggccatggagggaaactcttggattgttccattgctggtgccctcggaagccttcacgggtttcctgtgaaacacgcaatgtaaagcagtgaatgcagaatatttgatcctatctttgtgttaatgagtcttcaatctagagagtgggtgatcacttacaaaaatggccttctgctgactcaccagccctgcctattacattcaccctgctcctgcacaaagccagaaaaactgaacaacaagcagcaaataaatttcaataaacagatttattgtcctatttcaatacaaatcacagtctattaagaataatgcactctagtccaggttctgacagtcaaagatgctgatttaagaagagaattgtgctcctaatttaattcattcatttgcatctctctcttctaagtatgatataattcagccttactgatcatagctggtaatcactcctctgttttatggttaaaattgtgcttttaaaaaattacaattctacctatttatgtggggatttttatatattatggttctaggatgaatggttattagatgacaataatgaaaaaggcaaggtttatcaaagtgacctctgaaattaccccatacattttcaaaatgatgcacctgtattacacagagcatcatagattccaagcacattttccataactaatgatatgacttggaccatctacaccttttgtcagcactgttttctgatttcaacatagtacaatccattgaatgtcagactctaacaggtgtctatgaactcagggatcttgacagtttctttcttttttttttttttttttttaccattattacattaaaggcaaacagaattcagttccttcaaaattagacattttcaacttatgtcccagctttctgttattccacctcacttttgtacttggtaaaataaatagatcacaccgtagatgctgacatgcttctatcacatattatgatattttggctttattttttagttgaaaaagtgactgtattttgtaaaattatacacaaccaagagtttaaattggattcaatgtgtgtatgctttccgctgaatgattcctttttctctgggtcttgcctcaaacaagaaaccattaatgagtagtgaaagctttggacacagattttgtgaagtttcatatgagttaaggagtgccttcatttcatccttcaaattttgacagtaactatttttataaagaaattaattcagcttttccaaacttctttacattgcatcataatatatatcacaccatgatgacaaacattgaatctatttctattaaagacaaacatgcacaatttccatctcaagtgaaatcttgagcaaggatggaaacttctcaaagaaagaaaaaatagtaagccaccttgtattcttaagaatgcagaatttcaaaatgagacatttctgagctgcctctcacaaagcaattttttttttagccgcagggcaccccagtagaagttaaaaatagattacacttctattcatctaaaagaaggacactaatatgagcactgtagctttctgcacttcagtaaaaatcagaaatgatctgcagcccggtgaataaagttgattcacttagagaacaccagcatttctctcctcacctagcttttgaaagcaagcatgagacagcccctgcctacaaaattgcagaggaattactctcaattacaggcttctgtctgttaaaaagtagagctggtgatcagtctgaccttttttctctgacaagtcaaataaatgaaagggaaaaaaaaatctgacaggtgttcaatttagaagctgggggtgggggggaaagaggagaaagaaaagaaaagcttgtattctctaactagatctccggatttttttgtattattcatcctattttaaaagttccttttcagtgaataaattgcatgtggcaatgtaattttcttaaagtcactcacctaatgttttaatttgagtatcatttactgaaatcttcccacaatcaatcattcaggcttttagtttcatactttagatactttagggcaattctgctgaatgctacaactccgccctacccccattcttccttccttcttataagtagattacaaatgaccacagaagaatgacttttctggttccctgcatttgctatatttattgcaagacatggcttgtaaacaccagcctccacattttacctgataatgcgatcattacagaattcactagaatttggtcggcattggtattatttgaatgtgaatgttttagtaatgacatgaatcgtttttcagctctctgacatttacccacgttttttcatttcaaaagagttaactactttgctaaggactgaaaaagttgttctgatgaaagttaaattctaaaacattctgtattcttcggagttggttggttaggttcttgataatccagcacttgttcagcaaaactactaattagaggtggaagccatgtatgcattgaacagttacctcttcaagtttcaaagagagaagaaggaccaaaggatgctctttcccttaggaacccatctgacctgcatttaggccagttaatgatgacttccattcagctttgaaacatgtttcttttaagtcagctacttttcagtagggaaaaactattttgagaattaatcattctcaaacatcatacagaagccaaccagttaaaataccacaatcttaaacagacctgcaaacaacatttggaaagttgaattgtgattgactgatgacatcacagaaccaaaataacgtcccacattcacttcttgctctgttatttttgtttgcttcataacagtcagaactgcttttctgagatggctgagacagttttctcagaaatgacgcagtgaaatggctaatggccagagagtgggagtgagatgagaccagaaaaaaaaaaaagaaaaactaaaagaaaaaaggtggaaaagaacaaaggtgatgtacacatacccctaaaagctggccaaaagatagttatagtaaaaattctaagggagggctgggcacggtggctcacacctgtaatcccagcactttaggagtccaaagcaggcagatcacctgaggtcaggagtttgagaccagcctggccaacatggtgaaaccgtgtctctactaaaaatacaacatcactggggactgttgtggggtgggggagcagggagggatagcattaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaatacaaaaattagctgggcatggtagtgcacacgtgtagtcccagctacttggggaactgaggcatgagaatcccttgaatccgggaggtggaggttgcagtgagccgagattgcacccttgcactccagcctgagcaacagagtgagactccatctcaaaaaaaaactaagggagattttgaagttgtgtctttttcctgtgactgggaggccctgggaagctaagaaaattttattgaacatctgctttgcttccaggagataaagtcttcctgatacttccttctaatttaagtgaggcagtatcccacaattaaaaaaataaaataaaataaaaaaacaatggttcctttctccaaagagtcagccagcaatgatcaagaaaacagcacagtggtgtatactatacagctttggtaccaatgccaacaacccaaagtgataaaaaattaagaacagaatttatacaaaaataatgcttaaacacatgttttattaaaagctatagaaaaagggatacatttgaaataaaaatagcagtattttctgctttaataaccaactgttgactagtctcgtacttagaaaacggcaggttgtcacctagtgaactactcaaaaatctctctaactagcaagataaaaagcagtatttcaagtccactgaactgaaatgaacataccatacgaacataatggcagtgtacattgctcacatacaaaaccacatcataaagccgtagtgattagaagggcatagtgaccaaagcatgatcctctcctccagaaacagactcaaacacacagaaaagtagtatttttttatatgacattgcaaattcatgaggccagatgaattaatcaacaaatgttattttgggaaagtgaggacattgaaaagaatgtgaaccctacctcacaccttatcccaaataaattggagacagattaaagattaaaaattttaaaaataaaaatgtttcatttaaaacataaagcattgaaaacagcaaaatgatttaaaatacttttaaaaagtcatttttaaacatttttacagtgggagaaacccaaaagaaaagactaacaaagccaattacagaaaatgaaaagttcagataatacaaaccaaacagaaaacaaaccaaaacacctacaatcaaaaaaataaaggtaaaaggctgggtgtggtggctcacacctgtaatcccagcactgaggattggagactgaggcgggtggattacttgagaccaggagttcgagaccagcctagcaaacatggcgaaaccctgtctctaccaaaaatataaaaattaccaaagcatggtggtgggtgcctgtaatcccagctactcaggaggcggaggcaagagaatcgctcgagcccgggaggcggaggttgcagtgagctgagttcacgtcactgcactccagcctgggcaacagagcaacactatgtctcaaaaaaaaaaaaaaaaaagttaaaggatagacaggcaaaagttcaatggcctttgaaaaaggtaaactgagggctgctgaaagccctaaagcaaggagacaaatgcagatgtaggtttaggactcagcatgaatgctgtggctggagacatggggtatggcagatgcctttcatgaaagccaacagagactcatctccctacctcccaaatggctgtggaggagtttccgttctgtgactctacctctcctgtatgggtggacacgtaaccagaggtaagcatctgatctatgaacaatcaacacagagattgagttgagccatgctctctacagggcattcagaagtaaatgggatttccaagttcaattagcagagttgcctgcatctcatatttgacacctttaccctacatgctgcttacctgcccaggatctgaacttctggatatgtatctttatttcaccccacactctgagtcctaactttctaccctctaaaatgattccaccaccatccgtgaaagcagaactgataactacaggctgcgtgactcatgtttggttttgacttttcgtaaccacgatccacattaagagctttttcaaataattgtttataggttatatgaacttcataattttgaatgacacaagtttctactgaagtgattggtctgccacttccactgccagtgaaagaatattctctctgtgttcttaaaatcattcattctaaatgacactggggtaagatgaccgaaaactaaagggatgacattttgcttaaaaggtagaattgtaaacaccagactgcactcagaaaaatggagatttctcaaaatttaaaatcctcaaccatgagaaggataattaacaaaatacacttcagaaatatgaacacttagaatgcacttagtcactttacgagaactactgtaatcgtgcccaagcctaaatgcggatgtgagtataatcactgaccagttgcagcaacactgctgctgagaatggacctgcatcagaagacatgccgagggacagagctggtctcagcacccttaggtttcaatgcatgtaagagccagtgttcaggctgcaaaggtctgggcatttgtctttccaggctaacagaggaggagacaatgagactctacatcaatttcccagtatattctgcaaagtgataatgaatttctaaaagaaaactaaataaaaatatcatttagttggctaaagagcttccagaagaaaggcctcagaccatttcaaaaagaaaatggacaactctcaaacacagggacatagatgaggcagaaaagaagaaatatgcatacctataaccatggccttgacaagtcattttatagaaaggtaagatccaagtcttgaggcacttgctcaagcattcaaatatttctggggccaatcaagtgctggctgtggagatgccacatcctgaccctgcaaacagtttagtgggggacacaggctttcacatatatgactgtagcacagtgtgatatgtccaatgtcaggggccagtaatgagaacatgggggcaggaaaggaaggagagagtcctcacacctcagccaaagtggttcaggaaaacatcccaggaaaagaggtgtttgatatgggtgttaaaaaatgggctcgctttccaatctaaagaacttgaaagtatcatagacgacacaaatgtgaagacatccaatgatcatggattggaagaatatcatgaaaatgatcataatctgattatccaaagcaatctacagagtcaatgcaattcctatcaaaaaaccatttttttcacagaaatagaaaactcaatcctaaagttcgcatatggaaccaaaaagagcccaaatagccaaagaaatcctaaacggaacaaatctagaggcaacacattgcctgacttcaaattatactacaaagcaatagtaaccaagacagcatggtactagtataaaagtagatttataggccaatggaacagaatagggaacctagaaataaagctaaatacttaggaccaagtgatctgaaacaaagcattaaaaaacataaactggggaaaggacactctatttaataaatggtactgggaaacctggatagccccatgtagaagaattaaacgggatccttatctctcatcatatacaaaaatcaactcaagagggattaaagacctaaatctaagacatgaaaccataaaaatcttagaagaaaacctaggaaaaactcttctggatattggcctaggcaaacaatctatgactaagactccaaagcaaatgaaacaaaaacaaaaatgaataaatgatacctaattaaactaaaaagcttctgcacagcaaaagaaacaatcatcacagtaaaaagcccacagaatgggtgaaaatatttgcaaactatgcatctgacaaaggactaatatccagaatctgctaggaactcaaacaaatcagcaaggataaaaaacaaataatcccattaaaaaatgggcaaaggacatgaacagacatttctcaaaagaagatatacaagtggccaccaaacatgaaaaaaatgctcaacatcactcatcatcagggaaatgcaaattaaaaccacagtgagggctgggtgcggtggctcacacctgtaatcccagcaccttaggaggccgaggagggtggatcacctgaagtcaggagttctagaccagcctggccaacatggagaaacgctgtaacaactaaaaatacaaacattagccaggcatagcggcagggagctgtaatcccagctactcagggggctgaggcaggagaatcacttgaacccagaaggcggacgttgcagttagccaagatcgcgccattccactccagcctgggggacaagaatgagactttgtctcaaaaaaacaaaaacaaacaaccaaaaaaaaccacagtaagacaccattttaccccctccagaatggtcattattaaaaagtccagaaacaatagatgttgacatggatgtggtaaaaaagggaacatttatacacttctggtggaaatgaaattagtacaacctttatggaaaataatatcgtgatttctcaaagatctaaaagttgacctaccattctatcttgcgatcccaatactgggtttctaccgaaaggaaagtaagtcatgagatcaaaaaagacacctgcacacatatatttattgcaacacagttcacaattgaaaagacgtggaaccaacctaagtgaccataaaccaataagcggataaggaaaatgtgatatatatatatatttatatttatataattatatttatatttatatataattatatatatgtatatataattatatatattaatatacatataaacatgatatatatacacacatatatatatgtataccatggaatactactcaaccataaacaagaaaaaaataatgtcttttgcagcaactttcatggaactggaggccattattctaagtgacgtaactcaggaaagaaaaaccaaataccacgtgttctcacatacacagaggagctaagctatggatatgcaaaggcatacagaatgttataatggacactggagactcagaagggagggtgggaggggcgtgggggattttaaaaaactacatattgggtaccatgtgcacaactcaggtgatgcatgccctaaaatttcaggcttgactgctatacaattcatcacataaccaaaacctacttgtacccctaaagctattgaaatttgtttaaacgaaaaaaacttgaaagtgatacagttttaatcaaccagttactgaggatggacatattagtttattattgccgctgtcacaaattaccacatacttagggcttgaaacaacacatatttatcctatcgttttggaagtcagaagtctgaaatggctgtcactggggtaaaaccaaaaagtaagcagggctgtgttccttctgggggctctagttcagaatccattcccttactttgtccagcttctagaggaagcccacattcctcacctcatggtgccttcccacatcttcaaagccagcaacatcaggtcaagtcctgctcacaccacaacactcagacctctgcatccctcatcacaccttctctcactctgactcgcttgcctccctctttcatttataaggacccttgtgaatacattggacctacctgaataataccagataatccccctatcccaaaatttttaacctaatcacatctgcaaagcccatttggtcatgtaaggtaacattcacaggtgttggggattagaattaatacctctttgggggatcattattccacctaccaaagtgggttagggaccacacacccgccctaagtgcagacggaagcagcaatggcctaggatgtgtaacatacatacatacatataaacatatatacagacatacatatataacatatattacacatatatacatgcacacacatatccattacatagatgatatcatacatatatacaatatatacatactatgatagtaaatgttttatttgtaaaaaaaaaaatcaagcaggattatattagtctcatttcttatactttgctatgcttttgtgtgggcaaaaagccgtatggatcatgtactggggaccacaggtaagtacatacagccatgcagacaccccatgcatataaactccatccaacatgtagattactgcaccccaaatagatagatacatatatacgtagacagataaaagaactgcttttcaagtcggtgttccccatagtgtggtacatattccatttactaattcaaactttaaaattcgaaaagcagcatacttaacatgcatttaaaaatatataaccatcatgtcagtcatgatttcataaatgccacagcttggaactattctgcccatagtagtccctagccacatgtggctcttgtcaatgtaaactgtgactagtccaaactgagatgtgctataagtgtaaaatacacacaagatttcatagcattaaaaaaaaagaaatctcatttaaaatttcttattgatttgcatgttgaaataataggatacagtgggttaaataaaatgtaaaattaatttctcctgcttctgtaatatggcaactcaaaaatctcatgtgccttgcattatatttattttaacagtactggattaaaacaatgccaaagcagttgtgaagtgaaaacaaaatgagttgagctaaagtaaatattagtaaagttagcataaaggtattacaaatatcttgaaatttcaaagctaataacctatgtttggtaacactatacaacatccctggaaaatggaatccagcttttgaatattttctggaaagggtatcttagtacttccgaggttgttcaatgtagtggtagagggggtcaaatgaaaaacatttcttctttgtattgactggaaatctgaaaaacctttgtacatttctctccaatgcccttagttctggcttataaagcacagcacaaacctacccactactatccataactagctggttctggccttttgaacctttagtttcaaggctcccatgaaaccaacacagcagctttgtaacttcacaaacttgaaagaccacattgttggaggaagattcttactgcaggccctggcattccccattgatgagctgaaatcagttattatgaggttctgtatacaccttctgatgatggataaaacaaatgcatatgcctcacaggcacagcaggaattaaaaatacattagttcatcgcaacttcagatctgggattgaggaacgtttggatgacttttttttcttttcaaataaagtttagatgaggcaggaatttcactacagagtagagttctgagactctccaggtccagttcagcacttggagagaaatcaaatacatcttatcttaggtatggcactaactttcatcaaaaaattatcatatgctcagtcacaaatggttattgtaaaatctttactaacctaagtgcatataaaaattgtgaattcctaatacaaagcagtatttgacttttaaatttcattttaagcttggcccgttcacttggaatgtgattacagagtaaattaaaaagtaatcacatgtgaattacatttcctcatgaatgtaatgacttcaggaggctgattaatgttaagcagtgcctgtcctactgcatgcataccttcccaggtgagatatgcaagatagctgtcgtgagttgtttaattttcttttactggtattccagggagactgcctgaacacataataggctcagcacattcattaggactgaggatgttcttccctttggtatgctcaagtcccacgtgcaaaataccatcaccgtcaacttatggttatgagaaaagcccaagggaggcggtgcagctctggtaccattttctacctagccaagtttcaatttctcaatctctctttctatctttttggcaaattcttcatatttgaatggaataattccagagaatcactgaaaaatgcatttgcaccagtgtaaaggtaacgaattgtctcacaaggaatgaaggcttattaataatctacaacagtattactgcagagaacaaaatttaaactaagtggagcacaggatcattaacatatttcctctcaggtaatggggaatgtagcagtctaaaatatttactcctttctgtagtcaggttaaggcattgttttctaaaggagttgtcagaggaatcacgctattgttagaagtggaaaaggcttggtgcttcattatttctgtgcaaaagaagagcaaatacagtggatttagtagccagccaaggaaagccaggtactaaaaattaccttgggacaaaagttggtcttttattcctgtgattccccattccactgggaggaacaatgaactagtagagcagcctgagaacatgttacatcataatctagaacatatagacagctgatgtcatgaaactgtcatactatatgtgatgctctctgacatcatctattatataaaattttgtttttcttttttaagtttggtgagacaggctaaattgaattcaaaatccatcagtgactcatgaccatcagttagaaacattctggattgggagcctttggaatcacaggagttgagagactgccagctcacttcattgtcatttaactgtgggtcctcaaaggggaatgttccaaatgtcatgtcttcccagctttgtgtgggtggtgggaaaatgaagaggggtaatagcgagagaattaatgtcaggagaataagacagaaaaggcctacaattctgtagtttctcctaagactggcttcaggattcctttgagtttaatatttctgttatgtttttatcctgagatatttaaatttccagaacattcaaggtcaatgataagactattagaaagatttttatttaaacataaactcaaaagcactcaaggataaagaagaaacctatgagaactctgagtaggtaacctacaattcttctgtgttaaggagagagtagagagaattactcttgtgtttcaaactgggggtgtcaaacataggggactaaaaatgtgaaatataccagtatacaatataactccattgccttaactgagatgacagacactaatattcttttgttgtactagggtttttattctgcatttgttgtaccttataacatttttaaggcctttactaacccactgtgtgattcagaagagggtgatcaagaaagtgagtgacctagagaacacaccacgggataaccaatcaacatagacaaggtaagacttggacactagggatgggattaggaacagggtgtctccatccagaggacagtactgggtccaggctataaaggcagagacactggattgtgggtgctccctgacgtgctaatgagagttctgttaccaacaggactgggataatcaatttcccttctctgcatcccctttccacattttagggcctgatgtttgacagccatctaatgagctaaatgaattctacgaattctgctctaccatgttggatttgctcttgtggataatactcagcagaccactacaatttctagtgggtcacaatctacttttgacctcccccttctctaggacatatccctggcattttcctatacatgaccaaaattacttttagagaatgtaattttgtataaaatgggaaaaattaattaaatcattaaaatatgaaaaggatcctcttctaacaaggtctttcctctacagggcatccatgctttgaactctagggacagcattaaactgaagcaccagtgtctttcttctggaatcagaatccctttgttgcttttgggggaaaaaaaaaaaaggctgtcattgaacttttaattaggttccaaaaatgtgacctgaggcaataatagaatgatttattttaatgctacactgctcttgatgatattcggttaaaaatgggccagcctttgaaacaccctgacaccacacactggcatctacaatgttgaggctactgattcagttttatttcccaagatgtctttctttactcctttgttcaaccacccatccttctgtccattcatccattcaacaaacatcaacatttattgccaggcattaaggacagacaagcaacaaaaataaaatggtccctgtctccaacagaacttactaaagttcagctgggaagacaaccacttacccaacttaaaatagaacaacgtgggtggaaagtactcagtccaatttaaagagaccataatatctaagttttggtctttactgctccctctagcctgggttttatgtttggtttagccatttaaccaccactatgtataacaacacgtatgttccactgctgattttaccaacagaggccagtctcacggtgggaaacgtggctcccaatggtatcttatataccaaatgatcgtctatggtagatttcaatcatcattctaaattctacattgtgggtttgtatttctgagtgccaatacaaaccacaatactatctattttttaagagatggggtctcactatactgcccaggctggccttgaactcctaggctcaagtgatcctcccacttcagcctcccaagtagaatatcttaaagtccagggccattcagaggaagagagatgctacactgggtagataatcagaagaaaagaatcatttaacaaccaccctaccccccaaaaaaccctttctctctgcaaaatggaagggccatctagaaagaaacagaatcattcatacatatttattttaaaaccaataattaaccacctattgcagtactgaagttcatggcctacatgggatttattatactgattagtccacttctgtgtatatttaacctatctcataactttttttaaacagtcaatactaataaatagctgagttcatctaaaatatattggatctaagactacccaaattttcctcaaacatcctaactagaccccagttaaacttcttttggagtctcagggagaaaaaaaaaaaaatagaatgctttagaaattcttgattgaattttgttacattagctcagcataagcattacagccaccaaaaccactcttaccagtaagttctccatagcaagagatggctgcctgtcccaggattgcccacatatgtcttcttaggatactccaggaacaaagaggagaaaaataatcttggaaattctgtagactgttttgactttttaacccattcattcaatccataaaaatgaacaaagtgctataatgttacagtggaaagagcatcttttcagaggaagatagctggaattttagtcaagacttcgtcactaattatcattgtgcctttaaagcatatcacttcacttttctggaccacatttacttacaagaaaaatgaggaagttggaccaatgacctagtagcactcgtttctgattctcagtctgaagtcaatggatgctattaacatggaagtattttgaagctgcatttcctgcaggggcaaagcaatgcttcctccacattttcctgactcctttcaagttctcctagagagctcctaagacaattcataaagagaaagggggtactgctgcccaagcacacatcctttgtcacggtgtgtggtcaggcactagttggcattaatttacttgttcacagttgtacatgagacattattggtagagtagttatggttgcctgattgtggatgtgtaactaattctggaaaaggatgctataaagttacaatccaaacaatctcagcaggtgtcactgtagtcaggagaacatatcttcacaaatactcattatttatttatccttaagtaagagaaggtccctaccagccagcctaaaagtactgagctctgtttcccatcataaggccaagaatcatcaactttgtaagatcaaaagggggttttatgtatgctctgtcttcgtgcaggtctaagtggagccatgacaacctgaggcacatttgtagatattttttcaaggttataggcagaatggcactccatagcatcagtcagaaagctactcccatgccctactttgtctatgacctcagctttatctacttttatttatgagtgtggagcttaggatttcagtgacagaataatttgtttgacacattacagttaaaaaaaaaaccccaatagaagtacatagacatacacacacacgtgtctgtaaaattggtaaaatctgactaaactctgtggattgtaccaatgttaattttctagttcttacatgagactatagttactacagttaagcaagatgctaactatagagagtttgcatgaagtgtgtgtgagtctttgcatttttgcaactcctgtgaatgttgaattatttcaaaacacaaagttaaaaaaaaatgacaaccaccaaataattaagaaacctataccttcaaaagcaagatttaaaaagtaattgtaaaagttcaggaatagtgtaatgacacggttcatcatcagtgaacacctctccttcaaaaaatatttgtatgataataaatatccctcaacaaaggcatgtaagtcaccagtattcattcccaggaaataaggactgtctctttcaaaaatatttagaggacctgagatgacccttttcccctaggtcacaccaagagtttttatcactgaaagctcctttttgcaattcatagttttgacaaaaaagattttagtgatgtgtctgtgtctccagatgcactgctctgtgcaactatataataactattacctggtcaacctatgtcagcccattggaactgatctttaagaacacaaaaacatatatgtacacactggtatgaacagcaaatcattcttaaaatatttgatttagaaaaaaatgcaagagagatgatagttaatatccacaaaaggcaacacaatttcacaaatagacaagaaggggacaaagaaaaactaaaagaaaaaaatgggggcaaagacaggaacaggaagacaaacttcgcatgttctcacttattagtgggagctaaaaatcagaacaattgaacttgtgaagacagagtagaaggatggttaacagaggctgggaagggtcatggggaggggggtgaatagttagtgagtataaaaaatagaaagaatgaagaataagagctagtgtttgatagcacaacaaggtgattatagtaaataatttaattgtacattttaaaataaaagagtataattggattgcttctaacacaaaggaaaaatgcttagggagatggatactgcatttacattggtgggattattactcattgcatgcctgtatcaaaatagctcatgtactccattaatatatatacctactatgtacccgtgaaaatgagaaattaaaaaatgggcaaatatatggagaggtattttatttattttattattttatttgagacaaggtctcagtctgtcacccaggctggagtacagtagcgtgatntcagctcacctcagcctccaccccctgggctcaagcgatcctcccacctcagccttctgagtagctgggattacaagcacgcatcaccatgcccagctaatattctggtttttttttttttgttttgtttttttagtagagatggagtttcaccatgttgcccggactggtcttgaactcccgggctcaagcaatcttcctgcctcggcctcccaaagtgctgggattacaggggtgagccacccttcccagcctgaaaaggtatttttaaggtgggacaatataaaaagccaataaaaatgaaaagatgctcaaatttaatagaagtcagaaaatgttagagaaaacaatgagatgtcatttagacctaatgcactaatacaaatgaaaataaggggaaatacctgctctggatttagataaatggatattctgatacatggtagattaaaatatcacttttaaggctttatgaaatgtaatgtaacaatacctatcaatatttaaaaagtacattttcttaaatctagtactttcatggctgacaatctatcccattaaaagtaggttattagtgagaccccatttctaccaaaaaaaacaaaaaaatctggccaggcatggtggcatgcaccagtagtgtcagctactcaggaggctgaggtgggaagatagcttgagcctgggaggcagaggttacagcgagccaatatcgcgccactgctctccagcttgggtgacaatgagaccctgcctcaaaaaaaaaaaaaaaattatatgagctttttgtacagtgataagacaaaacaaaaccacacaaaggctggatcccaccagcagaaaatgttttaaaattatgttaccgccactggacataatgaattagatttatacagtagccttgaagggatttcctcaaagaattattgaaagataaaagaatgagtaatattccatttttgtaaaacaatgactgaaaaatctctccagatatgtatatataaatacacgtatgtattaacatattagcaggttgacaaatacacaagtataatcataggtcagaacgtcccaaattctgcatcttggcacaagtataagataataacttttatctaacactggggtggaaagataaaggttgttcatcaccagaaatgatgagccaaaggatagagccacctaaaaagcagtatttgagcaaaggagttggggagttcaaaaggaagttgttgcctgaggaggattctgggagcactccaggaagagggaggatagagcatggtggatgaggtgggtcatgtgtacgggaatgggatagtaccgagtgaaaacatgggaacaaaatgacgcaaagttcagaaatacacatacatacatttacatatatgaatacgtatgtgtattcttgaatttcatggtcatatttatgcattttcggtgaaattgtgtttttaaaacttactttatgtcttaaaaataacacttaaggctgggcgcggtggctcacgcctgtaatcccagcattttgggaggccgaggggggcagatcatgaggtcaggtgattgagaccatcctggctaacacggtgaaaccccgtctctactaaaaatacaaaaataaaaaaaaataaaaaaataaaaaaattagccgggcgtggttgcaggcacctatagtcccagctactgggaaggctgaggcaggagaatggcgtgaacccgggaggcggagcttgcagtgagccgagattgagccactgcactccagcctgggcgacacagcgagactccgtctcaaaaaaaaaaaaaaataaataataataataataataataattataacacttaaaaatgagcccaggtagatgatcttccagtaatttctcccttgattttcttgttcttgctgctattaaaatcaagagggcaccatatttctccctttgctcttctaagatccagtacttatgataagaaaaccatagtccaacacaccctatgtaagttattctgtgtatctgagcttcagatgtaaaggagctctttcagacttcagggttatgagagtttctgaatagccacctggcaaatctgggtagatgttgactttcccagcaggccacgatttattgccaaaagcacaatttttttcttttgttttgacttaacatgccagaaaaaaaacacaagactataagaattaaacctaatgcatcacagctaagctctctaaggcatgaaagaggcaagggctgcaccaaaacgaatttatcaatcacggaatgcaggaccccttgtatgattagcttaattatttaaagaatgcaaaagaggtggacggttctaccattaaattatcctgtttaaagaaaatgccaactcggtaagcatttctaagtggacaggctatttcaatagagtacattgctgaatgtgtgtgtgtgtaataataaaagaggctgccctttaaaaatccccacaccacgtacttttattaatttaatttggtgtccactgtactttttagttcgctccagttgcaattactattctagtttaatttcacatatatttgcattgtttcatggaaacccttacctcggtaaagagtaaaaatagatacctcccactagacccacctcaaaaggatatatgtgtgtgaaaacatacatacacaactaagtgggatgaaagtgatctttagagatatgggataaaggaaaaaccatttgaaaaaagtctcagaacactcctaggaagaccatatgtacttcctcatccagcaaagtgctatttcaaatgtgttaaataagtagggagtgtgtcagtgtgcgtgtgtgtgtgtgtgtctctgtaccaataaacatccagaaaaaaagaggggaaaaagtcaatataaaaatttagaaattagaatatttacttttagttaagaaaatttctagaaagttttattttgatatacaaaatataagacagccatctcaacaatcgtgtccagtcattcagcaatcagccaccactgacaacctacacctttccttcctttcaataatggccttccaacagacctcgaaaggcttctatatgggtcacttttcttactatatctgtattttttttccaaacctaatcctgtttgttctgaattatactgagtttctgataaactttaaaatgtttttcttagatccagctgcactaagagtataaagcgaatttagaatcaccaccccacagtccccccgccgacaaatcatactatttaatatggcggtgatgagaacaacgtatgtgactaccgtgacactcaataaaaatgctatgatttgctttttaaaaagtcagaaacctatagaattcgtatgtgagttccactcattgtttctataaaaaggtcattctgatatgttttagggcattgtcatgagaatgtgtgaaaaatctataggcttacaaaacatgaaaactcaagatactggttggtaaggacatggtaggggtaatgtattcttagaagagaggctgcatcatttctgcagataaatttgaaattttcttcatgcaatttggaatgtaatctcttactagattaaattttacagctcaggaaggtgaggagctggtaagagcaaactgcatgagacaagagtatagatatccaacaaacaatgaggcaaccaacctgattcacttagtacttgacagcaatgcttttattagaaacactttacttatgacctattaccagtggttcctctactattgggatacatttaaatctgtcattttaaatgtgtttacactttttctgtgtacaagaactgctgacaaaggcaagcgtgatatgtcatactgatgacgtgttaagctgaggaaatttccactgccacaggcaacactttaaccttatgaaacattttaatcacatttttattgaagaagcttattaaaagatgcaggctttcagaactcgacaaattttcttgatcctttgccaaatcagaggtaggcaaagtgtactctgaaatcacctccccccaaattgtaaattcattttctgaaattagatattgacatttaagcatcatataaaagtcaaacttttctaggatggctgagaagttgaaaatcctaaatgcccacattatgagaaaagaagttaaggcaaaggccaatatggtgagtaattttaaatttacacttagcatttagccccttttctgcattagtcccatgttaggaaccaactcattctttcatatccaacatatgtattttcagtatttgctaagaaataatcctcatttcaaagcattggttattattttctacaaaagcttggtttctcaatagtataattctgtgtttgcagactataaaagtatagctctgagaatatgaaagaaaataatcaccaggacaggcaatcgatttctgtgtgggcaaaaattttagaccttttttgtaggtgaatgacatcagagagccatttagctctaagtttccatgactacctgtaaaatggagatatcattcattcactcattcatttgataaatatcaagagaacatccacaatatttcaggtacagaactaggtggcattggggtgacagagaacacactggttttgcctttaaggacatttatagtctacttgctttctgtccacttcgactcagacataaagaatatttatcaaatataccggaagtcccagaataagggtactctaaatacatcattcaaatttcaaaatagaacctaaaaaacaaatgccaaaacatttacccaatgtattcaggccttatgaacctagtgattaacatatttttaatatgttatttcagctatactgtaactatatggtgaaacacaacaaaccaaactacttggtttatttagtttagtataaagccacatttagtagtattccaactcagtgctcttcggcaagtatgtgcacagctatattacgtctaggcactgtaacagtggctagggagatgatgacatgatgacatgatgatctgttagaaccctgtgaccttaagaagcttatggtccagaaagacatacaaatgtgtcattcactatgtgatactcctctcaatctcttcctctcaccatctcaccatctttcttacattcctactcctgatttggtccagacaatccacccatcttccagagccaagaactctgttgagccaatagtaaaaatctcattccctctgcaaaggatttgtttgtttaggaaagttgtgtgacccagtttcagccaacaaggaaagtgagtgaaaaaccattcaatagggcttttgaaaaagacatggaaccaatctaaatgcccatcaatgatgaactggatcaagaaaatgtggtacatatacaccatggaatagtacacagccataaaaaggaatgagatcatgtcatttgcagggacatggatgaagctggaagccatcatcctcagcaaactaacacaggaacagaacaccaaataccgcatgttctcactcataagggggagttgaacaatgagaacacaaggacacagggaggggaacaacacacaacagggcctgttgggggtggagggtgtgtggggagggaacctagaggatgggtcaataggtgcagcaaaccaccatggcacacgtatacctatgtaacaaacctgcacgttctgcgcatgtatcccagaacttaaaataaaaaattaagtatcaatccaaaaaacacaaaaacaaaaaccaaaaaaaagtttcttcactctttccaaaaagaggtaaaagataaacccaagtgaatggagaatttggtatatgataaatatgctatccttaaatcactggggagaagatggagttttgatatgaactgttgggataagtggatagtcacatgaagaaaggtaaaatcagatccattccttagactttaaaccaggataaattccaaatggatcaactatttaactatgaaaactaaaattaaggactagaaaaaaacatggtaatatgtcatctcaataacctaggaatggggaaaacttttctaacaattatttaaaatcccaaagtaataaggaaaaacatggataccagtgattacataaaagattccagaaacaaattgggagaacacattggtaagcttcactagagataaaaatccccaatatacaccagggctgcaaaatcaggaaaaaaacagcccaaaatcacactgaaaaatgagtgagaaatatgaactgattagctcataaataaatgcaaatgggccttaaacataagaaaatacactggactgtgctgttaatatgacaaatgcaatcgaaaacaatactaatataacattcctcacctatctgacaggaaagtcttaaagttcaacaatatagtatgttggccagacttagggaactaggaattcttatatagttgtggtataaatacaaagagacatatgcaaaccctatggataagtgttcatcaatacctagcaaaattacatatgtatttatcctttgacacagaattgcacttctgggagtctatccaaaagacacactagcaaagataaaatatatgtttgcacaaagcaattcactgcagcattatttaaaataacaagagattgaaaataaaaatgtttataaataggggatggagtgagaaaaaaacatggtacatcccccatgatggagtactataaaaccgtaaaaaaaaaaaaaaaaaaagaagaggaggaagaggaaaaagaagaaaagaaatcattctagaaagtgcaactaaatgctctccaggctatttttctaaagaacgaaagaaagttgaagaaaaatgtatagagtatatataacttttcaaagaaaggatggaacacaaatataaatgtatttatatacatacatgtatgtatatccacatacaaacacatatatgcaaccttatgtatatattgtatttgtatttaataaacagagtaagtattaaaaatttgggggaggaagaaacagagtataagggagatatagaagttatactactttgaacatactggttttatagattgattctgaaatcataaatattctacataattataatgcaaaattaaatctaaaaaagcaatctctataaattgaaagtaaaataaacctaatttcatatccagttgctatcataagcactcacagaggtgctatttctagcgattttatttaagatacataacaatttaaaggaaaactctaaactgctcatggtaattaaattatttgtagtaggactggtatcgatattctgagactcttgtgcatgtactgtgaataaatcaaagaattatgatggtatcattaagtgctgaggttttgttggggaaggagagtatggttgaaatgaaataaggatgtgagatcaatggggtaaggcattctgactggggaaaaccactctcccaaagatgagcctacaagttgccttagctggttctccaggcttctgtttctaaagttattgtcatgacatctttttaatgttcgcttttcatatgatgaggccaatatatacatattaaagtacatttacatgcatatacacacgtaaacttatttggatagcatgttctcatgcatcgatcacatttctgatttgagataatagtacactaggttaaattcttcctaattgactgtggccaagtctgctcacgcccagcatcggacctcacattctttcctacctacttgttttaagctgctggctccttgcagtcacttggcagaaaacacttctcctcaaacttgcattgtatttctagctttcactcatcaatatgaattttaaggctcccagtgaaaaccaatttaaggtatggagcctgtttaaaacaaggactggctccagtcacacccttattttcagaaaataagcctctgaggcactcccaacatagggacatgcagccaggacgccaagtggtatgctttggtagaaagaattaaaaacaacttagtataaaaacgttagggtatttgttggatttaaaaagtttagctaatgtacatgacagcagacctcaaagcaccagaagactcccttgtctgtaatagagcttcagatagaacacacctcttgaaataatactaatatctattttgggataatataaggtattttctccaaaacacatatctctttcacataacgggagacatataagtaaacagaaatatctctgaagacaactaagtgttgtttaagcactaaaataacaatctaatgaattagtaagataagaaaaaatctatggggagaggaatattatttagtttgggaaaataaatatggtttgcaaggcatatgaaatatcactgggacagaggacaggaaataatactgggcctgggacaggatatgagaaaaacaagatgaaatggaagatgtgagaattcagaatagacaaagaaaaaggacatggcggagcaatcctgggcgctaatgattttctaagaaaccagcaaatccgggtttgttcctgaggatgttccaagtggagcagctgtctatctcagggattttgctaactccagaagccatcagcctagtgcccagtgaatgtttaatactgagatgctttcatgccacctgaaagaaaagcaagagagggatctgtgtccctctcaaagtacctagtactttatggtagcttcattggtttattgcgttgattattcaagattccttggctgacgatgacaagaacacaaatcaaactagcctcaactagaaagagaattaattggcttatataactaggtattccaatgatagagagaacatgagacaaatctggatcaaggcacataccctttcttgctctctctccccccatctgcttctttccgtctcccaattctgtttgtctctgatcagcttttggcctcatattcttcttccatgagcagactctgaaatcccaaacccacagcttttttgtgtcaagtcgtctctctacatagatcagatttcaccgaagcaatcttactgacagctacatgggagatgcttcagcttcctggaacaatcgctggggcatattcctgtgattcagacattggacagacccaagtcaagctcccacaggccactacactggccatttccaccacaaccatacaggatggggaaggagcagttttccaatgaatcccaacaacagatttttcccactatccttccaataagactatttttcctccaagggcatggcctctcaaatatttttggccttctccacactttaccataacatctcctaaatatatgccccataattaaacagatggaaaccagaatttttattgtagacatcatcagtgaattattttcacagattgcaaatacattccttcaatattccattacctgattgtgatcacctaattagcagatgaaaactattcagagtatcaggagcataagaggaacaaggacatgtcaatttgaaaatgatatccttagaaagcatgcctatctacatctcctatctctaagtcataaatggaaagcatttaacatacttactgaagatttttatatgtgaaaaatgggatggttcaggtagcctacagatcctgcaaccgtggtgtgtggaacataggtgtcatgcagaataatctcatgtaataagaggttcagagggtggtcgtgactagcgcaatgggaagctaagtagatacgattccaggccctaccctcactacaaacagaaggtccaagatttcatcctctttcttatttgagagtttcatatttttcatttttttgaaaaagcaattgtactgccaaactaaaaaacttacaaacaagcaacaaattgtattagtctaatcacctcattatactaaagatgaaatagtttctaaatacagatcctaaacttgctgtcatttaaatttcaacacagctatccttttacttcaccaggctgcctttcttaatttgattttacaaaggaaagctttttaaaaaaaactaaaactaaaaaagcatagtattctatgcttgagttcttagactacacataaatatttaggccgtgcttatcagaattttagaattctgaagagcctccctgaactgtcaaaacctctaaaagccacaccatgctggtgaggcgacagagtaaagggaacacttacatactgctggtaggaatgtaaattagttcactcactgtggaaagcagtgtggaaatttctcaaagatcttaataacagaattaccatttaaaccagcaatcccactactgggtatataaccaaaggaaaataaatctttctgccaaaaagacatgtacactcctatgttcattgcagtactattcacaatagcaaagacacggaatcaaccaagatgcccatcaacagtgaactggataaagaaaatgtggtacatatataccacagaatactatgcagctgtaaaaaaaagaatgaaattatgtcctttgcagcaacgtggatgcagctggaggccattatcctaagcaaactaacacaggaacaggaaaccaaatacaacaccctctcacttataagtgggagctaaacattgaatacatatagacacaaagatgggaacaagagacactgaggactgcttgaggagggagatgaggaggggcacatggattcaaagcctgccaatcatgtacgatactcactacctgggtgacaggatcattcatccaccaagcttcagcgacactcagtttacccgtgtaacaagcctggatgcacacccctggaatctaaaataaaataagataaaagtaattcattcaattaaaaaaaataggctgggcctggtggctcacagctgtaatcccagcacgttgggaggccaaggcaagtggatcatgaggtcaggacttcgagaccagcctggccaatatggtgaaactaaaaatacaaaaactagctaggcatggtggtgcacacctgtaatcccagctactagggaggctgaggcaggagaatcacttgaacctgagaggcagaggtcacagtgagcagagatcacgcctgtaatcccagctactagggaggctaaggcaggagaatcacttgaacctgggaggcggagtttgcagtgagccaagatcgcgccactgcagtccagcctgggtgacagagtggtactccatctcaaaaaataaaataaaataaaataaaatggcacagaagcatcaaatgtggatagaagaaatatctacctatgcctctgttgaaatatcaatgagtctgtctaataaatgcctgcaataggctacttaattaaaatgaatagctttagcaatcaccttggttgacaacattcagaatgaagagcaaataatagttaacacttattctacataattactcttcccttccgtacacaaaacatgtacagagcctgggcttggtaacacgaaatttccaataatctatgagagaacacttaaagactttacacttaagaagaataatttttggattaattttgaatctattttccaaaagtaaatgactttttaaaggcctagtcagttaccatgataaataaagacatacactccaagtatttggcacatgtaattacagtaaaatgaacacaccccatatcaagcacatctttgtaggtcaagatggcaataagaaagtatttttcactctggtccacagtgatcaaagggggatcaacactgaaactgtatttcagaatgccagccaaaagctttgaccatgaaagagaagcagtgctggccagttgcccacaagactgcatactacattaggttttaatacatttcaaaaacagagaatttatatagaaactgtgacaatttgaagaagtttgctgggataatcttagaagactgatctaaagacagtctaggacagctgcatgcaattctaagagtcagatctgtttgtttgtttccgagataagcgtcaaatactaatacagataagagctaaaactaaaataccaattcagtgaaaaagctaaaacccagaagacgttttatttcattacctgtctgaagttatttttaacagtgacaggtcatgttctatttcttcactggggtaagagagaatatttgaatgtcccaaatatattaaagttataggcaaaaatgctcacaaaccatttagaaaatgattcattttactgtctacctaatactgagctgaaatactctactctaagctgactgcttagagtatgtttactatctgctaatcctatagctcgcacttaaacaaggctggttggatagataatccagacaaatgcagggttccataacagagcatttttaaatgtcttaggctatcacctaagccacaaacaaaattgatttttccagacatgttccagtgtctgcttaccctttcctgctaccaactgtcatctcactcccctgataaaactcttgacatgttttgcagtatcctctactcccttcccattccaaacagctgtcttcccttcctggcagaaactccctgacatctggatactcaggatggctactgttatgatggacagattccattttatccaactacccagctccgagaatataaaaatgagcaaaaggaggagaagtgtgatagtttcaccagctacacaaatactagttcaagtaatggctatattaaagcattagcatgttgaataattttcttttaaaagtccaattttgtgacatctgtaaaatgatacagaatgttaaaatgcgatgattctgaaagaatacacaattacaagcttcctaaatttctactcaggtaatgacaacaaatccaagcccatagctcaaacataggatttctgcttcatggcctaatttgatgtttttttactagatttaagaacaaaaacatgtgtgttagatgaagacagatgagtcgaagaaaagacaaaacatgagtcactttccttgagctcatcgcccatatcccatcaatcaccagttccactttgtgctgcttcctaaatatgtatcatctcttgcatattctgctacactggtttcttaaactgttttcctatatccattctcccactacttcagtctattctccataagcagccagtgatattttattgaagtgcaaattgggtcatatcaccctaacaccccctttctaaatccaatcagtggtcccccttccttgtagaataaaacctacgctagtccacatggaccctaaagctttgcataactctggtcccagcttctctctggcttcatcaggagcctgtcttcccctcactcaacatattcaaaccacactggccttccctccattatccaaatgcatcaaatttctcccattcctaaggtctgctttagcacttttctctttgcctggctccctcctgcccatggttcagatctcaatttatatgtcacttcctcaaggaattactctgcaatcaactgcaatatgttatgtatccttttatatctctcatgggatcatggaatttttcttagcagcacttttaacaactgtatttaattaacatattaagtcagacattaaagagatttgcaaaactataaagcaatgccattctcaatttttggttttgaaaaattgttaattcttgtttaaaaatgttatcttaatgtgcaaaatgtttattattgttttaaagtattattttaaaaaaattttaatttctaatatggcaaatatcaatagatttaacaacataaacaaaacttctttcggtcgtcaatcttttttaggagtataaagggattctgagatcgaaaagtttaagaaccactgaataagaaattaaactatggcttgtgaaagaatgagatactacattttaaatcctttaggaatacttaaaattgtagttaaatatattttatgtaggaaacaaagctttcaagtaatgttgctaccttagaaagaaaatgcttaattcttatatactgctaagagaattataacaggattgtacagctaggtcataagcaatgtgtcaattataaaacagttgataagaaagttcaacttgccatgacaaacatagtttacagctttaaatgaacaattttttctttgaaagcattctaacaaatgttatctttaataacaaacacatatggcctttaaactttcaaggcaaagattcttgaaaatcataattaaaacaaacctttcgatcttacagaaaagttcttaacagaagactaacaattttgcaatgacaagatggtgaatatgtgctcaatactaattacagtcatgatgactgtgatatcaacaaacccatatatggtacttttctaagagcttagaaatcagccttagttactattattattagcccaaggatatgtaacttaccctgcatctgacagctaagtaagtgacataaatgaggtttgaatccagggtctgagctcttaactctatactgcctacatacatacatacatacatacatatatacatacatatataaattaacctttcttatcctgcttctaaacaaaggtaagggccacccagtcaatgctttgtattcttccaatattctttcctagaacttcttcaaaggctctcatgaagcactggtgaaactggaaatcactgaattttactaccattttaaccaaggctgaatcaaataatttagaagttaatattgtttatttacccagggtctatctacccacattactctcattttgttcacaaattatctaatttcctactgcatctggctttgcttattttgggttttcattgctcctgaagatttttctggcaaattctgggtttctgcccctcgtaatccttctgtggacattcaacatgaaatactaacgttcctaggccactggactcttggaaagctaatgctgtgaaatctttgctttgtaatagccctatactttgttcaatatctatttcatctgtgtaacaagtattataaataataaaagttgggagtctccagtaactgagaaaattctacccaaagtcaacatatttatgttaaacaaaaggtagtttgtattctcaaaatgaattgagttattgggtctgacatcctcctgattaaaatgtaaacttattattgagtaacgaactttgaacatagtcagaattttagagaaacatcaatttaaaatatataattaaacagacagagggctgtaagttcatctgacagaatatgtttacttttgttgaaatgttaatgatgtcagtgatacttccctgtcccccttcattaatcttgggaaaataaactatctgtttctcctcaaagctttgttctcctcactccatttcttcttgtcctcacccagaagctaatgaagtaaaagctttagggcttcttaggctaacaccccttctaagatcttgtatctaaatgtgtggttataattgtgtaggctttatcctaaagaggataaaaattgcataagattcagacgctactcaacctggatctgccttacgtgagttgtaaatatttcagtcaacttgcaattactgctcatatttttgtttctctgtacttgcagccgaggaaaatcctttggagtggctcatggacatcagtccccctgatacaaaagcttattttggcaagaaagtggcaaagaattacaagtcaggatagaggctaaacatgaattttagatctaaatttctatcaataggtaattagatgaaaaacaataataaggtagatccatatcagagacaaagtggaggcctctagtcctaaatgggcctgaataatttagaaatgtaacttaaaaatgtttggttttgggaacattttatgtaaaaattcaggtgtcaaaaatcagacctgataaaactgggtataaatgctctggcctgaatatatttcctatctacctcccttcactcattttcaaggcctgcctgtccccacctaagttaaatttaggcaagcccaaagggttattattaaagttatattcctcaaattatggaaataatgcccaagagatattaattattaaaaaaaataaatcaactgacataatagcattcataatagcattcatactatgtttcaacttttattttaaatgatttatataatttctaagatgaattcaaattatttattatggtatacagtattttttaatattcagcagaaaaaattaagcacaaattttattttaaataacatttcctaccacctttaaatataacttcagtagcagacactgtgttgatggtttggctaaaggaggacaagaaaataggacctgctcaaattcatgcatggtggcaacaaaaattcagggatcatggcaccaaaaatcttgttttccaggatggatcacagactgaggaagcacagattatacatttagagccgacattcatttcttcacagcagtattagaaaagaaaagccacagtcgatgccatttccatctagctgcatccaagcctttctgcatacagagaaatatctaattacccaatacactagagcaacgtgtggggattgttttaatatatattcacagcatgtgtcattatggctcctggcggctattaaaagggtgggctagcaacatgaattaacaataacacatttggtatatgatggctttataatgcctaaagcatttagctagtctcattattcttaatgtgccctacagctcacaagaatcatgtaactgtgtattcagctggtcccaaatgctaaatggaaagcaaaatatctcctaaaagtagttctgagtaactgctatgtctagttttcttcctttttcatcaactaacatggcatatgttataatcaacagatagttctgttttcagaacgtttttttccttttgttttagacaagcagaacaactcataatagtagacaacttcaccaggagaacagcagttcagtacaacaggaaggccagtgtctccccagtaccacctgcttaagctactacaagggttcccttaacagagatgcctgcctctatccatcctcctacagcccattctccagtcagcaactatagacatctgtgaaaatatcagatcgtatcacattactcttcagctaaaagtactccagtggcttcaatatgtactaagaataaaatgcaaacttctggtcatttcccacaaggctccttcatgcggtggctgcctacttatctctgcaacttctgtttgtaccattctcattactaaacctgaaacacggcgcacacctgtaatcccagctcatagtcattccagtcattccacacttttagcatttcatggaccctcagcctggaatacccttcccatagatcttttaatgactggctccttctccttcttcagaattctgcctaaaattgatctcctcagagactatcctatctgtagcaaccattttttcccaattctctatcgctgtcctatttaattttttttttaattaggcctagtagagtgaaattagttgttttttcagcatgatttcttatcaactatccctatataaatgtgggtatgcacacacacagaaattcgcattccattaggagcacggccttatctatctttcctattatcacctccccagtacgtggaacagatactggtaggcagtaagtgctcaaaaattattgggcatggacaaacgaacctgctagttaagcatttccatccaggagacaatcaagggagctcaacttgggaatgtattcaaatcaactctttgaaattccatctaacaacacaggaaatcattctctcttatttatttattcatgcattcattcattcattcattcattcattctgagccaggattcaagtcctagtccctcttactagggcagaaaaagtataagctctcgagaagaaattatattcttctaccctcccctccctgttcttcaacttcagtcattcacctgctctctggtatggtttctgccacttctgtgtattacaggtaccaactttcactcaatgctcttttcacctttttacaatagcctcacactaagcattaggttggtgcaaaattaattgtggttcttgccattaaaagtaatggcaaaggccaggcagggtggctcacgcctgtaatcccagcactttcggaggttgaggcgggtggatcacgaggtcaggagttcgagaccagcctggccaacatgatgaaaccccgtctctactaaaaatacaaaaattagctgggttaaaatattattttaaataacatttcctaccacctttaaatataacttcagtagcagacactatgctgatggtttgactaaaggaggacaagaaaataggacctgctatggtgtggtggcacacgcctgtaatcccagctactcaggaggctgaggcaggagaactgcttgaactcgggaggcagaggttgcagtgagacaagatcgtaccactgcactccagcctgggtgaaagagcgagactccatctcaaaaacaaaaagtaatggcaaaaacctcaattacttttgcaccagcctaacagtaataactttaggataaagagtttgctaggactagtttttcctgaattacattacaattactccttgactattaaaacacatacccatacgtatgcatttacacgtatttttccatctacaatagtctcctccaacatttgggaaaactggatcagagatgaaggaagactttcttccagggatagaggctcccctcaggcagaatgacattgcagagtccctggagggctcctaacttttactaggcactcagtggtgtcatgctctgtgctttatttattacaatacccctttgaggaggtattcatataatgtattttgcaggggaggacccaggtacagggagcttaagtcaataggacaaggtcacatagctagcaaaaggcagaagtcgtgttcaaattcaggtccatctgggcaccagatccattcttggaaccgctgaatcatacatcatctttgcaacacgtaagcgatccatgctttgttttacaatatacttctttcctaaggtggtaatccgagagcttttatttacttattttatttactaatctaaaaactgcacacacccaccttcccttcaatattcccaagtaacaagcttgttgagaaaccctactgaaaacaagctgagccttcttttcattactcagtgatttttaagtgttgctagtttttataccattagacttttattttcataattataggctgccatgggcttcttccaaagccccctgccaagtcttcattcctacatacaggtgctaattgctttcttagcaccactggttattctctgaacctttggatttcaccacctacaataggaccctgggtttttctccccttcagtaacccttagcacaatggtcacagtcactccatggctgacttggttctggcccacaagtctcatctcctcattctcaaagcggagtcaagttaattctgtgcccgtgctgcgtcctgttctctctcaattcttggtcgtggtgcttgatcctcaggttaaagcaactgaactctagtagctttgaaacaaacttgtatgtttcctcctcccctccatatagtgtgaactatatataacttaaacattaacaataatagcaaacttttattgagttcctatcagtctccacaccaaagcctctcaacaaatttatttcgtaaaaaacaaacaaaaacgagcaaacctccctgtggaggagtaccgattttatcccccttccgctatcttccagaagacagcactgaggttcacagaggagaatccattcttcctggttccagagtccgtactctaaagacccactacccactatccctcttgtgaaaactgtcccaacctgatcctgatgcaaaatgatggcaaataaaaggcagtagatagatttttacagtaaaagagaaacagaagataattaacttgagttgtgaaaagaattcaagaagggagatgcttcctttcaagacatataatctgctcctgtatgtctttcacttgttcttcaaggaatcttcgaaatgttcccctcacaaagtttctccttatgctcatatccctcctaagccatccatgagggtacccatgaaggcccagttcaccggagctgcctgacgtactgattatccctctctaaagcatcctcttttggacaacaaattatatgtccacccaaaccataatctccatgagggcagggatgtgccttattctcctttttatctctcaccaggatttttattttattttattttattttattttattttattttatttgacagggtcttgctctgtcacccaagctggagtgcagtgtgtggtcttggctgaaaactccggctcccaggttcaagcaattctcttgcctcagcctcttgaatagctgggattacaggcatgcaccaccatgcctggctaatttttgtatttttagtagagacggggtttcaccattttggccagactggtctcgaactcctgacctcaagggatctgtttgcctaggcctcccaaagtgctgggattacaggaatgagccaccacgcccagccaggattttccgattttaaatcagtactggagtaatgcttgctaagaagtcttccccccaagctaggtagaatttcgtcattactaagtccttcatagcattttgtgttcgtctctcttacagaaattatcacatgccaactttaatagttcacagaccatatatgccatgcctctgtggcaggcctgagtctccactcatctttgtatccctagatacctgattagatactttatccagtgacgtggttaactacatgctgaccaactgaactcaatattcttttgatatcctcattttgcaggcaaactcttactgtcctgccaatggaacagaaaatttgagagttgtgagatcaatgatacaccaagtgctggaggaaagaagacagagtatctgtacctggagaacaggagaaagtttagaaacagggctaaaggactaggaggtattatctaggtataaatgtctgggtattagggatgggagagagttgagagaacctcccaggaagagggaaaagacagggcagatacaagacagtctgcacgcagaatggtgtgagtaggttgtgtggctcctgatggctgaagtttaaaatcagaagggagatttgagtagacgcttacttctcaacaggctgttctgttaaataccagagcaacagtaaataagcatttaatgcaaaacttgccctcttaaaacagcgactttgggatcatcaaaactgcattgtaactgaagataacagacggacaggggagcaaatagatgacctcaggacagcttatttggggctgagacagaatacagcattctctctccacttttgcacttccctcagcagatctacagaactgcagaggaccaagtcctgaccaggaatgtgaccataccaaagggaaaacagtcatttcaacatttctgtgggtgcctgtgctgaagggacccagtgaggctgggcgctctgtttataaaacataatacgaatcatgggactaagctatttagcagagcagcaatgggacagccccacagggagagaaagggtgaggagatgttaacaaatggtctcaggggaatccatttggggaagaaggtcccagtggtgaagaaggaccagaggacttgtacaacagagctgtcttctgttcaattaaaaagcactgttggctgggcgcagtggctcacacctataatcccagcactttgggaggctgaggcaggcagcccacctgaggtagagagttcaagaccagcctgaccagcagggagaaaccctgtctctactaaaaatacaaaattagccaggcatagtggcgcatgcctgtaatcccagctattcgggaggctgaggcaggagaaccgcttgaacccgggaggcggaggttgcggtgagctgagatcgcaccattgcactccagcctgggcaacaagagtgaaactccgtctcaaaaaaaaaaaaaaaaaaaaaacactgcctgcctgcactatactaacatgttctgtaatccctctcctttaccctaagcctttactgttgctgcacacaatgattgcaggattaaagcactttggaaaaatgaaaaactgggaacgtgtccaggctgaaaggaagcatggagggaaaacaacagttggttgtctctcgagactagatatagaggaaggagggagaatcaggaaggggacttatggggtcacatggatgtgtctagggataagaatgagaagcaaataatcatacagccctatggccttgagaagtgctggttttggagcacgcatctatctgtggacactgatatcccatcttgtctctattgtcacgccacttctctatgtgaatgtgagccattatcttctcctctggctagaacatctatctacctaacgtagtaaatgaatcaaatttaatttaaaggaaaatcaaaagtcatttccatgcactgacataagaaagcacttaatctcaataaactagcagttaggatgatgggaaaatctacaagggctcagaggtatgcagcaaatcaaaattctccccatttgtataatggaacaaagccaaagtaagctttcttcctggcctaaaccacataacctaacacctgttagaaaaatgggctggggcaatgagctgtgaccaccggtgattcaaaggaatcactaaactctccccaccagtttcacagaactgcattggaaaatgacttttaccaagattcttaataaaatcaacatctttgcctgtttcatacattattagattttatggcatgcatttcagaactctaataccttaactctgtctacaagtgaggtgggattcccgaaggaccaccatcccacctctgaaaatattttcattacccaagtcagaggaagtgaagaaatgaaagcttcctgaatctggccagctaaatagcttgattcaagtgtgttatgttttcattatttacatttcccttggaatttgagggctgtcttcaaattttgtgacacctgtatttttttcacctacttctgttcagtgatttcctggaagaaggaagaacacggctgaaatgaacaatcaacgaacactgatttaatctataccacatttacctccaattaggtaaatcatggatcactgtttaaaaatatttttacaaggccattggataaaaacaagtattaggtatcagtcagtgctctgatttgggaagagccatttacggtctctaagcttatgtcatctcatctgtagaatgaaagtgactgattccccacatggcttccaactccaagaacttctggaatgctgtactgacactcatacagagctgatttggggttaattattgtttttcatttctgcttccttttcttgatggattttatcaaaaagtgaaccattttaaaaagcaattactggacattttttaagaactgcaggggagctggagatagttgcaagagggagacctattaggtttcctttttcttttactaccacttaactttttcctccaagcctcttgcctcacaataaacataaaaacagatgaccctatcactccagactgtccttcataatggcaacaacaacaataatacaagcttttaatttttgaactcccactgtacggcagacctttatctcattattggaaggagtataaagtaaggcatgaaaccactggctctgacatactgtatgatcccatttatgtaaaatgtccagaatagacaaatccacagacacagagcaaagaaaattagtggttgccagggacattaagcataggagaatgagggtgacttcttaaccagcacagggctttcttttgggaagacgaaaatgttctggaactattaatagacaggagtagttatgattgtatgaccttgggaatacactaaaaaagccactgaattgcatactgttaaaaggtgaatttttttggtatgtgaattatatctactaaaaagataaaatttaaaaaaataaaacacacatccatggctctggatggagattgtccaggttcaaatcccagccctaccgcttctcagcttttctaagcctaagtttctacatgtataaaatgggagaaatgacaaatacctcacaaggaaattagaggactaaataatgctacgacttttaggtacaaaggccaatttatagcgtgttttaaaaatattcttacgagacccttgaataaaacaatattagataccaaccagttctttgatttgagaagagccactcctggtctctaagcttaagtcattttgtctgcagaatgaaggggactggttccctacatgagcatcccataaattttcctattcttatgtaatccccacaatagttctataaaatacgtagaacattactgattttagagatgaagaaacatcagtaaagggcaaggaagttgctgagccactaagtggcagaggtgagattcgagaaatgtcagaatggaacctcacactcttgagtgacacaccactgcctcctgacccacatattaataacccagcatatgtacgaactgcttactgacttcttactatgttgcagaaactcagggacagtgccctcaagaaagtcattacctggccacttgcagtggctcatgcctgtaatcgcagtactttgggaggctaaggtgggcagattacttgaggcaaggagtttgagaccagcctgggcaacatggtgaaaccctgcctctaccaaaagtacaaaaattagccaggtgtggtggtgagcatctgcaatcccagctacttgggaggctgaggcaggagaatcacttgaaccagggaggcggaggttgcagtgagctgagctcctgccactgtactccagcctgagcaacaaagtgagtgagacatcatcaaaaagaaaaaaaaaaaaagaaaaagaaaagaaaagaaagaaagaaaagaaagcaagccattacccaagatgggagaagaacaacagtgcccagggattaaggaaattaaggaacaggtgtacacagtaaaagtataaaagtagatatttttaccatataattcagaaccttctgtctttagaaggggactttcctatcagggaaaatccagagtaactgggctgagaaaaaacattatgtagatgaacttttgagagtttctaagaaaataattaagagactgagtgctgtggctcacacttacgtataatcccagcactttggtaggccaaggtgagaggatcatggccaggcattgaagactggcctgggaaataaagcaagtccatatctctaaaaggacttttttaaagttagccaggcatggtgatgcacgcctataatcccagcttctcaagaggctgtggcaggaggacagcttgagcccaagactttgaggctgcagtgagctatgattgtgccactgcactccagcctggccaacagcacaagaccctatctctaaaaaagataacaagaattaagtgtaatcggccactcacctctatgccaaataccatattttacttaagatttcaaatctcgttgttcaataccgtggccactagccacatgtagctaaatttaaatatattaaaattgaataacgttaaaattttggttcctcagttcacaccaccacatttctagttcacaagagccacacgcggccactggctgccataatgaacagaccagataaaagagcatgtctttcaatgcagaaagttttaagggacagcactaatctaaatataaaatcacatcattcacagtcaaataataagagaaaatgcaacattttatttcatatcctaaaaagagatttggtatccaagtgaatacctggaactactataaatgctcacctaagttgtaagatgacattataatttcttatctacactttaaaaataacattatctgatcatattgctctggtgtaaagattttccagaaaaaaaatcactttccgagactccttatttttaaaaatcgcagatagcataggcaaacagataatgaacatgtaagctcactgcatctcagttttgaaatggattcaattcactggtcttgaaaagaaaagttcaggacattggggaaaactcagttgctctggtctctgagttaatagccttatgagtagaatgcctttttgtccaaagaattctcaaaatagtattatttttgtttatttgtgtttttgagattgaatctcactctgtctgctcaggatggattgcagtggcatgatcttggctgactatgacctccccatcctgggttcaagcaattctcctgcctgagcctcctaagtagctgggattacagccataaaccaccacgtctggctaatttttgtatttttagtagatacgaagtttcgccatgttggccaggctggtcttgaacttttggcctcaagtgatctgccctccttgacctcccaaagtgattacaggcgtgagccaccactcctggccttaaaatatttcaataaccattctaatgtgagcagacatggtagtggcaacaactcggaaataaaataatcttatgaggtttggtcaaatacgccaataaagctcctctgccatcttgcctctgagccatgctcatatttgtgaaatgggaggaaaaatttttctccttctttgcagatatattattctccttctttgcagatatatatgtgtgtatatatgtgtgtatatgtacacatacacatacacagaagcgcacacatatccaatagaagttggtatctatcatccagtacttcagtttttaagtataactgacacacatatacatataaattcaattaattattttacagtctgaacactttcatgtaaccaacgcccagatccagaaatacagtattaccaacacctcagagtctacctgccgcagccttccaggtaccctcaagggtaaccaacaacctgacttctagcaccactggtgaactttgacagtttccacatcttacatatgtggcactcttttgtgtctagcttttatcactgaacaagacaccatctagttttgacagatcttcgccacaaggcagccatttaatgctttcctgccttatagaataactaatccttattgagcacatattatgtgtcaagtgctttacgtgccttgactcctttaattcccccaaacaagcttatcagtaaagtattattattatccctattaaatagatgagcacattgatgtgtaaaattggctaggctatagttcccacttattcagttacatactaatctaggtattcctgtgaaaggattttacagatgtaattcaagtctctaatcatttgactttaagttagggagattatcctgggtggacctgatttaatcaactgaaggccttaaccatagggctgaggcttccaggagacagggagcataaaataaggagggaagggggcatttttctggagcagataaccatgagcaacaatcatccattaacttatacatgccaataacagatgtcacaccaactcaaagacaaggctcttcagttcattcttgaataggaacttgtagtagaaatggtatgtgccacattatttttcaagccagccctgatgtcatttgttcatgcacactgtccctgtaagaacactctcatttttcaagtcctgcatcatatttcaagttgggaaaaataaggtcactctacacatggtagggtgatggaggtgtttttggacagccagacttttcagatttactcatctttaaaagcaatctcagtgaaaggcttctcttgagtggatctaaatagatctcaagtaaacctaggagattttttaagaacaggagcaatttcttccattatcttatcccccttaacatatatcattgagcaggactgaagggaagtcttggtaagtacagatgcatgttatcatttgtctcctctttttctattgaaggctgattttaaggattttccattttcagaggtgaaattaaatggaatccttagttttcccttccaaccctcaagacttcctcctcaagtcttctccatctcaattattagcgtcccacattcgctgggtttcctgggccagactcagtagtgatcagcaagtcagttctgcctccaggcatatcccaaagctaaaatcttatctccatctccatctccagtataagcacccttgttctgaccattctgtttgctaaacacagacaaggagacctgagtgatctcctggcttccactcctgcccctctaaagccatgtcatatacaacagagagctcattttaaagctgcaaatgtagtaatatcactctcctgcgtacaactccaaatgagactggatatgtgatgacactaaggaaatactgtcaacttttagaagtgataatgatactatggctatagtttttaaaagagttctgatgttctagagatctatggtgacaaatgacagcatgcctccttcaaataacactgtgcagtggtggtgactgggaaggggtgcagctggagagaagggataggtaaaataagatagaccatgagctgataattattgaaactcggcaatgggtacattgggagtcactatacttttctattttcatatcttataacatttttataataaaaaactattaaatccccaatgactcctgactgcacttagagagtaaaatcttaagaacttgtatggctcaaaaggtatttaatgatctgactgatgcctggcaatccatgattttatccagtacccagctttgtccattaactgccaaacagctgtaacagccatcccgtgccttccagccctttgccaccataggaccttcagacaggctcttttcagccttagagggctcctccccaagatgtgccagatgtgcccagtgttgggctccttctccttcaggtgtccactccaacaaactcctcagagagggcctcctccaccatgctacctaaagcaccttccctccccgctctcctcctgcccacccctctgcacccttaccactctacctattttctttcattatttcttcataatccttatcactttttgaaatcatcttttctcttaagtccttttgaaaaataagctgatatagtttggctgtgtccccactcaaaactcatcttgaattgtagctcccataattcccatgtgtcatgggagggacccggtggcaggtaattgaatcatgggggcaggtctttcccatgctgttcttgtgatagtgagtaagtcccacaggatctgatggttttatgaaggggagtccccctgtacatgccccctgtacttacatcttgcctgccgccatgtaagatgtgcctttgctcctttatcttctgccatgagtgtgaggcctccccaaccacgtggaactgtgaatccattaaacctccttcctttacaaattacgtctcaggtacatctttattagcagcatgagaacagattaacagacaagtcacttattatcaatatactccccatactagaatacatgctctgagatcattgggaccttgtctgtccagttcacttgcatgcttccagtgcctatgatagtgcctagcataaaagtaggattccaatgatgacacattacacaaatcctttaaatcagaccagacaattaaagctgtgtacatagcacagggacaacaaaaaataataataattaatgccttggaaagtgaaattatccttacatgtatatatctgtagtattaatgaatagttaacactaacggatttcatttgaattaaacatatgtcaacataatgaataactacttacacatattaacacaattaatgaataattaatacctgtgagttttctctgaattgcattcaatatatccatacacaatacatgcacatacacatatagtctttatttcattattctgataccgaatatataacaccattgttggcttatatgtaaggaatatgacagtttatgattgctatatctcgagcaggagattttgctaaatgtattgttgccagagcttagattttaaaattcatttctaagtcttagctggtgttaaaccatgtcagcataataagcaagttttgatttcctttcagatgttcctggctgctgaaagaattgattttgaagattttcccattgacctatagggctgtgaagaagagatagctcttcttaatctcaaagatccaaactgagtttacattccccagcctttgtttggatgtcaccttcagagcttgcttcattatgtgtctcaggagaaacacagaagtattagtgataggacactgactggtagactttaatccttctttgagatgttgtttaataatgatggtttagtatcacattcgaggataactgtagttagttaatatttttacttttaatatacctactttcccaagtacaaatttatcctggggctacgtaggtgacccaagtgcatcaggagcagtttcgaacaaggtgtaacttctcaacgttacatggaataagagagagattcaaaaatcacatccaaactcaaacatcatttcaaaggtcctttcccatcttcctctccccaaaaacaactaaaacatggcatattgcatctttcaaccatggtcaaaatccttctctgttaagtagattctatgtatttttaaatatctatgcttttgtttgttgttttttttttttttgagacagagtctcactctctcacccaggctcgagtgcaatggcgtggtctcggctcactgcaacctccgcctcctgggttcaaatgattcttctgcctcaacctcctgagtagctgggattacaggcacccataaccaagcccagctaatttctgtattttttagtagaggcagggtttcaccgtgatggccaggctggtctcgaactcctgacctcgtgatctgctggcctcagcccccaaagtgctaggattacaggcgtgagccaccgtgcccggccatatctatgcttttaagtattgttttccttctcagacgtttgagaaactcaagaaggaaacattgtatacagactcagacttaacctcaatgtgaacatacacagcaacatcattgacagtctacagttacatgatctcaatggcaagtgtggtccactgtgatgtcaattttataaagggaagcttgaaaaacatcacaacagaaagaaagctgtcatgcttgctttgattaaagaggatgtagtatgtttcataaacaggttagttctcacaggaaggttcaataaatggaagcaaaaagcaaaaactcacaatggagatcctcccagtgtttgaattttaaaaaataaaggtcagtttatcactagagcgttcaattggctccagggttcatagggtattgttagactagagctccttttgctaaaaaacccagaggacttcttgtattttgcttctagctatctgggtctgcttttaattcctcagacatactcttctgctgcacgtagttctcacacctcaagacccatgagtttgctgtctgcccaaatgcatcttctctatctttcaacatccaagttgaatgcaacttctttcagaaagccttccatttccatgactagtacctcattttcaaatcaattccattgttctaagtggtttgaccttgctgggttcatgctttaattcctctgattgtaacaataaaaagtaatttactttctatgtgtttgccacacatactagatgaggcccttgaggacaaagatagcatctcatttgggtctgtgtccccagagacttcctcctcagaaaatgttgaatgaaagaatcaaataaataaaggaatgatgaatgaagcaagccaacagcacccttcaactctcagtttgcttcaaatccccactactacccttccattctatccccagtagaatttttctattctcttttcagtcttaaacactgttaaaatttcaaggtaagcatcactgaaaactgaagtgctgtggcacaatgggtttttctaatgaattatttatctgtaagcagtagttcatattcacatattttttagagaccagttgcctttctttgtgaatggatatgttcatgtatccatctattagatgctattgtcttgttttgcaaggcaattgagtgttttatttccttttttttacttatacagtaatatttgaaaatattctcactgtaaaaaattcaaaccatatagaaaaatataaaaactcccttatcactccttttaatccactttcctccccaaaagcaatctttattatcagtttcagatctttttctatgcatttagctacatatgcacatatacaagctttgtgtttgggtaggagtctcatgcatatgtagaatcataaggttttataaacttctcccttcaattaaccatgtatctcagagatagatagtcccagataaggaacatacctcatccactttaagtactagcattccacactttggatataccaacatttattcatcattcccatggtgactaaaatatattgatactccattttcactcttacaaatcctagatcatatttctttatgaaaaagcaccaagagttttcaaaaatagaattactaggttgaagggtatgcacagactggcttcccagagtatggaactgtttatttctccatatccttaaaaattgtgaatattaacaggttttgtttttccatttttttttttttttttttggttaatctgatgatagcacctatttcctacatgacctaaaccagttgagaaatgcccatatttacacctaccatggtgtgttgcgactggaacaggttcaagtgaaatataccaagtgactgctaacagcctcctacctaactcctttcagcttacatcccagtaacataaacagggatccacactgaattcacgtttaattatcagaagacagggaccttgatgagtgtcttcacataaactatcttgtttaatcctcttagaatcctgtgaaatagaaacttttattcctgttttatgtttgaccacagtgaggcaggccacccaagatcacaagattgtacttgattccacaaagcgctccactgaccccaaattaagaaactgccccatacttgcattcggtttgcagttttccactgttattgcttcttggtgcctaatgtaactacccacataaaaactgaagatgtctctacctattattttaggaaaagctctggctttgaaaatactgaatttttctgggagaagcagctggttagaggcaggtagaaattaagaatttgtgggccgggcatggtggcttatgcctataatcccagtactttgggaggccgaggcgggtggatcacctgaggtcaggagtatgagagtagcctggccaacatggtgaaactccatctctactaaaaataataataataaaaaaaatcagccaggaatggtggtacatgcctgtaacctcagatacttgggaggctgaggcaggaaaatcgcttgagccttggaggcggaggtggcagtgagccgagattgtaccactgcactccagcctggcaccaagcgagactccgtctcaaaaaaaaaaaaaaaaaagaatttgtgtatcagcaacaaatacaaactttattggacactccctccctttcttaatgagttcctcaggttttttccagaactaaaccaagtcatgaaatgtcagataataaagcccttaagtattaatgtacagtataggtgaatggctactgtacttactctatcttagcgatatttaataatattaaatgttttaaaactatcctatctaagaatgaaataaaagaaagccatggttttattatcttaagaaatttataccactcaactagctgtactaagcaaaaaaaaaaaaaaaaagtcacagcaccatggaaaatgaacacaaaagatgctttctaaaatgctgaaaagcataaaataaaagattaaaacatttcactatgcatatgttatgctggaaccttgaagctatcgcctacatgagaatggtactttaaagattactgaatatgttttctgaaagtatagaatgatcgattcatttttcaaacccttagtgtagttgcactcttcctttccctgacagatgacaaggctcagggaaagcaaagatcagagctgaggaacaacaaaaaaagttggcacctgattcacttccccttcatgccaaccctgtttttctcccttatcatacaacaaagcaaaaagaaaagtattgaatatgaaaaccaaaaagattccccatgactgagctttggcaagtacaaatgcattaggaatggagctgattcctgtgaccttttcaattatgataatcctgcaaagaaaattaaaatcattttctaaaacatggtccaaggagttccatagataattgaagaaaatatttaggaacatccctggcatttttctaagaatgtatatacttagcccaggtctgttgcacactgcagccatttcagccatgagtatttgtgagcaaaaggtcaaattaacttgagagatatttttgcaaagcctacttccagagtttttgcccttcattttttcttttgtatatatttacattttgaaatgggaagactgaaaaagagggaagctatatacttgtttctgctttggtctgaaaatttggtagttgaatgtacttctttttgaaagcatctttttggctgggaggagaggctcatgtctgtagtcccactaacttgatttggaaggctaaggtgggaggattgggtgagcccaggaatttgagagcaccctgggcaacatagggggaccccagtcttttaaaaaataaaaaacttggctgggcatggtggcacatacctgtagtcccagctactcagggggctaaggcaggagtgtggcttatgcccaggagctcaaggctgcagtgaaccatggtcatagcactgcattacagcctaggcaacagaccacaactcaaaaagcaaacaaaaaacagaatctttttgttttgggcatgaaaaataagtgaagaggctttagagttcctaggatctccactggatttctaacaagcaaaagtttccctaaagcatggaaaaacacacagatttaactatatttaaagtaaaatgatccacaaagctcatccttgcccaattctcatttaatgaataagaagactaaatacttcagaaaatcaaagactaccttactaatagacttagataaatggatttcagtttagacccaagaagggaagtcaaatctatagatacagcatctaagaagttgagaccttggttctctattctactctccctattattggccttatgaccacaagttggtcagttcgcctccctaagcctcagtttctcacagggaaaataggaatattagcaaatgacagagcaaattcacaggactgctatcataggattaaataaaacaacacaaaaaactgtaaaaattatataatacaatgtaaacaagcaaatggcataataattatttgtccttgttcaccaagttaggttttcaatatcaatatgcatctccctaccacagcaggacagagacagctacagttactggaaactataaaatgggttccagtcaacaaaagccattggactgctttctgattcttctaatagaaaatcagagcattagtaggagagaatggggaaaaaaaggctttgcttcaaatttatatttctgttcctgatacctattaagagccagttatgtagctattaagctacagcttgcaatttaaaataaataaactgataacaaaacccttaaatttccatcatcagagcagatcaaactacaacatatgctaccgaggatgcaaagcagctaatgaagacttcaatatcaggattatgacccttaatttcaataggaatgtgttctgttgtttgagctcacacataacgagaaaaaacatcacggaagcacaaataaactgtctcattaaaaagcactttgccttggtccaaatataatttcgtttttatacaattcaaatgctatagaacaaagaaagagaaggaagagggatgataaatgcagaggacttgggagggaagcctgttctgcaataattgagatggaaaggagggttcaacctgcactcctttgtttgtggagacaaagtcctcaacagctggcagatagcaggaagtagaatgctgatggctttgcagttagcttcaaaacctattagcaaccctcagatccaagagctgtacctgctttgaaataaaccaggaaatagggaataaatcatttcttctggagggaaaaaaattgtttaaagtgattaaaacatgccacaggtttctcacacaggaggaattaaggaaactatttcagaacttaatgggacctgttaaaaaaaacagatttgtaagaatttaaaagtaaatatttctttatgcaaacttatcatagtgagtatcttttaaatactaaagctagggatgcacttgcaacagtttttaggaaacgggggtggaatggggaatcacttcactgaagaagtttaaagacatatttattcctctgtggattccatttcttaaaagactgccctgaaacttcttcctaaattctgtcataattccctaagacagtaccaagggaattatcattctttattagatgccaaagaaacataacaaggatcacaaatgaaacaccagaaaatttatcaaataagattggatgtacagacccattctaaagagcattccttctcccccatgttttaagtcaaatttatattaaaaatcttgaattttctaggaattttaagtactgtcccctaattttccattaataagcacgctcatgagtatgaaaaaaatatttatttacatgcatttattataatgggccaagaaaatatttctatgtaaaggtactatcttcctattaatctgtagtttttttgctttttttgtaagggttgaaagaaagagaaaagcaacagattgcaggtggggatagaggcaaagagagataaacggtagagaaaccagttctgaaatgtcagggaattgcctggagagagttaaatatactgtttctgcggacccattcccagataggtaccgcctattcctacatatgaagagagaagagatgagttatattcatgactagtaggagttagtttatcttgcttctgttttttaattttactctaagacaaagggactgctataaaagaggaagaagtggagcttactctaattactctttattattctcttgatcatcatcacctctagtaattttgtaattcattacagtaatttatctaagtttccaaggattttaatatgttctttagctcctaggtagagaaaaattgtggtaacaatcaaatgactaatcacaattattggttaggaaaatgaaaatcacaatgcaatcattataaaaacagggtgtgtatgtaattacactaaaacttcattgatttaggccattattaatatttggtaacaactaaaaatatgtattatctttcacgttttatttcttcccagcttctccagtatgaataagaatgtatacaagaggatgttaatgaaaacaatcttacagcatcacatggtattaaatagatttttatctgtagctgtatatttcaaataaaattgatattttgcttattttcagaggaaatttgtttaaaatcctataatatttcatgttggcttcaaactctatatatttcaccccaaaccgtttctcagtacatacttacatccttttttcattaacatgttcacaaaacccatttgggtccttatttttctgcaaagtacatattatttccaggcatgttctatattcgtgtgtatgtatgtttgcttctccccaatccacataatcttcatgagataaattatattgccttcttcactactatctgtagcttcaacacttagaacaatgccttgcagagagcaggtacttgaggcaaagttgactgcttagataactccaatacctcttcacctcttcccatcagtaactatattatttatttttagctgagcacagggatccccgaaataaagaccacatcttctaatttcaagttgactgcttttgccccttcttctctctttcattctttctattggttagaagatggtcataatggctgaaaactctattagacagcactgctttcagtccttcttcctcatacaaacacatatgttcatatatatatatttatataaacacatacacatatgtgaacatctccccaagcttctccatctccttgctttttgtcagcatattaacacaccaggagaagtagatgttagtctaatctccaagccactaggtctttacttgaattgataggcacattttcaagtgaaccacaatggccttgaatcagcgttctcattttatcagtgtgatgtcaatattcagtccaaaactaaaaaaaaaaaaaaaattagatttgggccactcatatttaacactgaatatgaagcaaatggattgttcgcctttgggagggtggtctatgattaaacagaaatacagggttacctctaagcagcttcattttgctcacttggataactatctggttaagtggtattcacagatgggaaaagagttaacactcaatgaatgctatgttgtcattaattcaacaactgaacaaaagggacaagatccccacactcataaagctaacattctagtggggcaaacaaagaaacaaataacatcaacaaaccacactcaattggtttcttcagagaatgtaacactactgacaaattagtattgtcaagaactactggccatggagaggcgatggggagagcttgacctgtgcctgcatacactctagggactgagcttaaaatcttgactttaagctcaacaaatggctacatcttttgaccaaattccatcatgctttaagctccacggtttaagcccctgaagtcctttagaagatagaggcaacggctcttatttaatctatagacaccagttcaacagcagaaactattatcttgaacagggtaacacctacaaccgtgaggaatgataaccaccttcttaaacgttgaagatataatctgtacgacagtggcaggtgatgctttacattgttttataatattatcccaccacccagttctaaaataaactttaacttttttgttttttaaagccaggaaaggagataaagaatcaatgaaaggtcaacacagaacagacagaaagtaccagatgtgctctctaaattatgttctgtaagagtcagcagggagaacagaaataatttatttcaggaatcctgacgttaccatcatgtacactcggttaaatggtttgtatagctgaaaaactcagacaggtcttacaccattctcctttacttctaccacttagagaaattcaatcaaaggctgaggttaaagataccagttcccatcaagccagtatatatattaaaagtggcttttctgatcacagcaattctcaggcagtttaggtgtagtgataaacctaaaaatataatctgacaaattttcaactgttcattctaatgttcaatacttcagttattatacttcatattttccctataaatgtcaaggaaagggaattgtctataggatacacacatacctatatacacataaatgtatggggggagggatggaatttccattaaataaagagagaaggataaaaggtcacacaattgtcactttctaaaaataatttcccaggatctataatttctcagagctgtagtaaattagtcacttaaacttattaaaaccaaaaatttaaggaatacctctgaatataactcagaataatgtaacaagataatcatgagcctttacaagatttcatgttgattaacagtaaatagcttttttactgactgatttctgcttccaaatgacaccgcctaaacaaactttgttgccacagaagccacaaaattgtaaggcaatgaatttctgaattggggcctcaatgagaagtttgatttttaggatcttgagtgttctgaattgtgctcaacagtatttaccacacgtgttgcttgtttatgagacagagactacaaacatcttgaatgggacttttatttaaaattctagatgtttcacatttatattttaaagcaaaagatcttacatttgatcagcgtggcttttaattttagttatgattatttaaaaatatgctaagatattcctgacatctcaaaagaacaaattattactgtctgtcaatgcatttttagaaaaactgtatcataaaaaatgtatagcttcatataattaaaacattcaggtagtgtgcattgactaaagtaatatggactattaagtaattcaaaattgtgtttagcggcagcagctgtttaattaaaaggtaaaaactgcaactaatccactatggttgacagaaatacagcctatatcagcagtcagatcccctaggatagagaatatggatatgaattcaagaagtcatgagcttcatttaatgaatataatgaaaataaccacaataaatcagtactgaaacatactttatatctaaaattatctgtatgttggcccacttttaatttccttgtagctaataattttgcatttcgatgtagcaaaaaatcctttaacatacatattgtcaaccatcaatgcacacagcttttatcagagggcccatagcataagctcaacttataaggaggctagaaatgttcttagaatcagatgatcccttcaaagttctaaacttcagggttcaatattcaaagtactcactcataattaccttctatcatggagaaatacaaaatggccaataagctcataaagttaatcaaccttaccaacaagtgactaactgaacattacaatttcattacaaaattattttcacctacgatattaggggaaaaacctttttgttaattgaaaaaagaaactagtgatgttgaggatgatatagtcatttgtaaagataatcaagcaatatatatgatattcccagcccttgatccagaacttccaattctagtggaattacacaagtgggcaaaactttatgtacaaaaatatttattgcagaaatgtttttaatatcaggaaaatgtttaaaaatataaatcaatattggcaactgatccagaaactatggtaagcatacagtgaacaattatctgggcattaacaagaactggaaaaaaactatctgtatgtacattttatgtgacaaaaccaaaacaagccattggacaataaatgcagaataaattcatttttatacaatgaataattgtaaaatcaaaagatataaaaaaaattttcttaaatttgcctatgcttatgttaaagtaaactgtttaattcccttcataattttctgcttaaaaaatgcttatttttatattgtttaccctggctgtgctttaggaaatagatcagaagtatggaatgaggcagaccagtaaagaggcattgcagtaatacaggcaaatgaggtagaaatggaaatgtagagaaaaacaaaattataaatggcaaataaatgaattctttttagaacagttatactaaaataaaaagtctacctccagcaaatatatatagagagttatctttgaaggaggaaaaccaaatcatttcaacagtgttcttttatttccaggaggggaaaaatgtcctattaaaatggcagaagagaaaaggggaaggaaggggaagggtctctcttttactttacaaactagaaacaaacagttcacaggtttcttaacattcgtatcaaatgtcccgtggattttatttgcaaattatgaggccagcaaagcagaaaatgggagtctttaattaggaagaacaggtggctgagaggcacaaggtgagtattagccacatctctgcctggtgccaaaaaacacagatccgacctgcagaacaaattttaagggtgagagcgtaactgtctccagttggagtggagcttgagtggagctcaagctctgtattcagcttttctgaattatatttactcctatttaaagtgaaatggtttgctcttcagctttggttggaatttaccaattacaaattattgaccttcttcatattgacattctccacacagtctacaatcctctctgctgcagttgaagcaaattcttgacctgccaaatgttcctgtttctcttactgggttttcaaaatgattctcctaaacagctgattacgtattttaagttagaatgacaatatagggcttataaaagtggaacacagaggattttcagtgcattgaaactattctgtatgatactctaatggtagattacatgcaagtaactatttgtccaaactcatcgaacatacatcactaagagtgaaccctaatagaaactatggactttgggtgtcaatgatgtgtcagctcatcaactgtaacaaatgtgacactctgatagggaatattgataagtatatgtggaaggggagggagtattcgggatgactctgtaccttctgctaaattttgctataaacctaaaactgttctaccaagtaaggctattaagaagtgctcagagctgggtatggtggtgtgcacctgtaatcctagctacttgggaatctgaggcaggaggatcacttgtgccctgaagtttaaggccagcctgggcaaatatcacaagaccttgcatcagaaagaagaagaaagaagaaagaagatagaagacagaagaagaaagaaagaagaaggaagaagatgatgaagatgaagatgaagatgaagaagaagaagaaaagaaacttaaaaaccacttatacatagatacatattttttaaagcttttctgtcattaaatgttttgggtttacaaaattaaacatttggcattcttgctcaaaaacagcagtaatcttatcttaaagttcataataatcatatacgcccagcctctggctctcaacttatgagtctcacatttaggcaaatttttatgaattgaaccaatggcatttcatagtaacgtaagttcatgtccaagtgccacagcttgccacttgcttgattttaggcaattttcataacatcttatgcctcagtttcctcatctctaaaatgagagaaattcacatatctacttcactgagttgtgacaattaaatgaaagaatgcagttaggagctcagtgaagggcttagcacacagtaaagacttaagaaatgttaactctttttgttatgactaactacaacttaatgtaaaagggaactacaagtaattttttaaatcgataagcacatggagccttcgaggagaaaacatgacaccttcaaaaatgaatatgcaaggtttggaattcgttacttcagagtagaattttaccaggttagaggaatgacttataaccatatctaaaaattgtcattcttcagtgcattgctcttcatctgcatttgaagctgcctcgttataaaaaagctgtaaaacgtcctcaaagtaactttagttcttccccctaagagttcaaaatccactccctaggtttattctttggtacaaaaaccttcaaaagctgatttgctgatgataacaaatttgttttcagaaataatattcctgatctgaggtgataaacaattcagaactttcatatcattggggaattacatttaagagatcaactggggatctgtgaaataagaagcatttaccttgctagaggaatgctagcctgcatttaattgtataatatttccccttcagggtgtatgagacagcgtgttggaaaatggaatgattcttggctttattcagaaagagaacaaaggagagaaggcaggtaaaggacacagcaccatggaaatgacatttcgtttccatttgaattctaaagtactgaacttttaaaatcttcatttgaagaaactctgagaaatttgtcaggagggagtaagaaaaatgatatagcctaccacttaagatagggtgccaaaaaacattaacaattgttcaacctaaatggttagtattcaggttgaagggtggcagaatatgccacccctacatatgccactttagcataaggattattttgagctaaaggcacttaaaaaacagcaggtgctagaagggcgctgtgactcacccctttttcttcccgaatgcagggataaaaccccaatacagaagatgtcctctttataccagaaggaaagtcacatttttatcatcaaggatgaaaaggtgagacctggagaatgctgcacaaagataccatgtgaaaataattcttatcttcctttagcctgcctacagagttcacttacttttccacaattgcatcttttcagtcaatcgaatataaaagcatctaggttttgccatttctttatgtcttcatttcctaatgagggctccataaaacttctattaagtatatttgcatgcttttcttctgttaaactgttttacatcagtttaattctcaggcccagccaaaaaactctaacaaggcaggggtagaatttttgccttcctcacaaggtgttcgtttttctattcttgaaactttccgtatgtttcacaatttttataaacaaaagttgggggaatgaactattactaaaaaatctggaagacaaaattctgttctcatttgacacaccgagtatctatttacacttttctcggaaacagcgtcttctcctcctccacaaaacccatgtgctctgagggaggctgactccatcacttgggctataaggataagccacagctctggtgaggacaactggcaaaatcccatcaccctgttcatttgattggctcaggggatgagtgagagatgaaagttggaccaataaggatgaaggatttttttttcaacagttatcagaagagcctttccattttcctacaagacatgaatggacaaattagaaaggcccagtgccaggagtgacattagaaccatgatctgagagtctcctggagactgggcacaatatcaaggaaatacagccaagacacacacacacacacacacacacacacacacgggagaagggggaaggaaaaagagggagagtgtattaatctgttctcacactgctaataaagacatacctaagactgggcaatttataaaggaaagagatttagtggactcacagttccacatggctgaggaggcctcacacgcatgccaggtgaatcaagagcaaagtcacaccttacatggcagcaggaaggagagcctgtacagagaaactcctgtttataaaaccatcagatcttgtgagacttattcactaccacaagaacagtatggggaaactgcccccacgatttaattatctccacctgtccctgctcttgacacatggagattattgctattcaaggtgagatctgggtagggacataaccaaaccatatcagagaaaaacgtagagagaaaaaaggggaaagagaaaaaaaagagaaggaaaggtagaggaagagaggccatacatgcactagataaagtcgcacctacagctgagcaagatagtttccaattatcctagccaataaattctattgtctgcttaagctagaatgggtcacatttttagttgcttactagtgaaattatcctaacatgctaacaggcaagataaaaatagtctgagcaatgactaaaggagcacattttttacctcatatactgacaattcaagagcattattgcatcatttgctgccaaatggagaggaaagttggttcctaaggaccccctcggccagaaaagtacaaaacatctgttgaagtcatgggtgacttgttagcaaagttcagcagcagtaaagcttcctaagaaacaggtcttttctcaccagcgggtattgatataattagggtcaattacaatttagaatttccagggcatggggctgaattacagtggcatttaagagctctgctaaattttcccattcatcttgaagatttctggaggaacctgttgtaattaagtaatcttcttcttttcatttttatgacaattttcttcttcaggctttgcaattacccactactccaaagtaccttcctttagaagaagaattaaaaaaaagaccacctgattttcaatcgacaatgagacttggttttgctgcctgctaagtgatggattgtgatgtgtacagcaatctctaaataagctgcttcaacaagattttttaaactcccactgccctcaccaaacacagataatcccaaaaactcattgtctgagtgggtgatcaaaaacgaaagaggtgacattatgattgctgggcatcctttacccacgtggtttgtaagtagccctgggagatgtgcaaacaaactctattacttccttgtgggttttcacatatgcttcccccatacagattttatgaagacataccttttgagctttatgcaatcgaggggaaagagctttcactggattaagctattccaattgcatttaccttgggcaacaaagtaaaccatatccataaaaaacagccagaggcttttaagtattaggtcaatagcacttgagtatcatatagtcccaaaagaagctgtaacagatcatgttgattttatggaatgccttggctctctctggggagggagtagtacatagggagtgaggaacattatgacacctattactatcaaccactgttcagtgatggctttctatgcaagcacccaaccaccctgagaaaaaagtactaacatcttcaattgcacaaaagaagagggaaaaataattacagttagttgtctggtctgtgatcatccagctcaagtgaaaaaactaaaatttgaaaacctcatctttccaattccaaagtttatatttaaaaattgtacttccagtgttgaaaagtatctttgggaatagttatgccagtttctgactcacaataagatacactccatgcatgttgtgtgtgtgtatctaaaaccatccttgacccagtacaggcacttctagttaatctttcaactgatcttatccttgtccagcgtgtgggccactgctcatgccatttcttctacacagcatacctttcttttccctcccatttccacctatggaaatcttgcttgtaagtcaaagccctgctgtgaactaactatgtgcaagacatgacaaacacagcagtcagacagatgtagcctctttgttatctattccataataacacgaggcatgtaatagtgtttcacagtttatgaagaccttccaatgcacttccagaatggccaaaattccagctaactctggaaaacgcattccaaagagaaccaactagaataaatggggaaaaattttatgtcatgagtaccgaatgtgtgccaagtatttccatatatgcctaacttaatcattggctgtatgacaaaatatgattgcaagcatattaatgtattaattcaaaaatatttttgcaacagctctgttgttaaaggttctgtgttagacacttgatgcaagcaacacaaagatgaatcagacgagaggaaataaagtctacacaagtagacaaagaaaaacagtgctttatattggacattaacaaacaaaaggaacctgtaatcccagaactttgggaaaccaaagcgggaaaattgcttgagcccaggagtttaagaccagcctgggcaacatagcgaaaccccgtctctataaaaaaattttaaaaatttaaaaaatttaaaaaattagcagatcataatggcaactgcctgtagtcccagctactagaaaggctaggtgggaggatcacttgagcataggggggtcaaggctgcactgcggcatgatcatgctactgcactctagcctgggcgacagtgaaactctgcctcgaaaagaaaaaaataaataaatagaaggaaataaacgtgtgctcaaagggtattatggtagtagacacctttattccagcagctagtactgtacatgggaaagagcaaataatgattatttaataaacagataataaaaaaagactgggctgggcgcggtggctcatgcctgtaatcccagcactttgggaggccgaggccggtggatcactaggtcagaagatcgagaccatcctggctaacaaggcgaaaccccttctcaacttaaaaaaaaatacaaaaaaaaattagccgggcgtggtggcgggtgcctgtagttccagctactcgggaggctgaggcaggagaatgccgtgaacccaggaggcagagcttgcagtgagccgagatagcgccactgcactccagcctgggtgacagagcgagactccatctcaaaataaataaatgaataaataataaaaaataaaaacaaataataaaataaaaaacactgtggcctcatcgagtttctactgtagtacaccattgaaagagcacagaacactgaagtattcattgctacttatatttttaagtttttatttccattctacactccagtgagcaaatcaaaatgcctactgccaaaaaaggctcataattaatacatttttacttacaatgaaggctatcattagtatatcaccaattaatgtcagaaaaggaagatctgtcatgatattctgaatcgacattgtaaaaaggagaaaatatatggatggaaagtattctggcatgtttctagttattaagaacaactctgctgaacagcaatttgggatgatgtgaaatgaaacaaatgatatcactcattgtattcagtgtgatgatcagttggcaacaattacaaaaatgtaccagtaaggatataatatcaaatgtctatagatagtcaaaattgcaaatggcatggaaaaaacataagagaaaaccatcacacctttctctctgttttgcagtcaatgattttctcatttgtattctcctatactgtagacttcccaggacagagattacctgaggttcttctctggatctctagacaaagcccactgtccaatacttaatatatgactgttaactatggaaacaaggaaggaaggaagtcacaatttcattctgaaaactaatccaccttcttatcagccaatatgtcctccttcaaggagcagcactggaaaaactaatgaaataaaacaccaggacaaaacgtggtatccttctccagaatgcacaggaaatttctgaatattaccaagaattaaatatatttgattgttatatagcctcaaatgggccagcacttacttgtgagttactaatctaatctcaactatttcttttctttacaacattgtatttcaaaataactcaaacctacaattggttgcaagttagtacgatgaatacctgcaataccctacttcaactgttaaggttttatcatatctgctttctctcttttacacacacagacacacatataggcacacactcagcaatatcatcatcattttcccaattgcttcttagggcacaatggtttgggtattcaagaaaacaagaataaaagtcatggcatcctgcagaccaaagcaagacctaacccttgtgtgaggtataatcagtatcttgagtgaaatcatttccctggagtgaagagttcccagtgcaatgaacagtgagaactacaaccggaaaaacaggtagcaaagaccctaataactccatattttatctaataagaaatgaagtgctgaagatttgtgagtgggcttgtaaccaaataaaatgatttttcccaatataaattagagatactatatcaaacgcacagcagagacaagaaggtggtggcaggaaaatcaggcaagtttaaaacacctagagtattagcaaaaaaatacataatataactggatttgttctattcctctaacaaaatataactaaaagggtttgaaaagtcatcggccaacaatatttaatataacatactcaaatcacatatatttcaattaattaggtttctacaggagtaatgtggtatttggacttggacattaaatcaatactggccttacagttacttcccatgttcttcagccctccattacaatccactcccctacccaaaaatcaataccaaagccttatatgagacagaaaggacagtaatctttaagtggaaataggaatctaaattacaattgtaaatgtctaaagcttgtagtctggggattttcctaatgggaatatttgatgtgactttttgttattcttatggttgtgctcataagcacatcacaaggatggtttaaaggcccgagcaccataaattagatattctttaagaaatcatgttcttgacatattttttcattatctgagaagaatgaaacagattttttttgttaattagtgctaaggcatgtattttgcattagcattaagtttaccaaaatggctttaaaaacttgaacagatggcagaattataataacttttccttatgatttaggttaagaataaagtgtcatgagaattctcctcctacctaacttttctataaagttaatgcatttaatagatatggcatgtttgtttttctcactgaggtgtaaacaactctatcacacctcagatgagtataatgagatgcgggaatacatttcaatactctctacctagggtaaagggattttccagggtttaaacatcaaaccacgcagaaacaactccaaaccttcgacaataactgcacaggatggcacaggggttgcaaagacagatgtctttaggggcctggcaggtactgaaaacgagtaaagtagacttgctctgaggataatagggagtagtgggaactgcagccagccggacagagcaagcaccacccggggcgacaaacccaacttctcaccaactgctttcaggaatggaatgaaggccctgagtagctggaatcacttattttccaaaagccgccccaaatctaactttcctatgtgaaatgtcccaataaaaatttcggtggctagtttatatttttttaaagaaaagataaaataaaaagaaatgaggactaaagaaaacagtcagtggcctccaggaggaaccatgagacattagtctgcagccttagatggatatctataactggtgttcatggacctgggaggtggaggttgcagtgagccgagattgtgccactgcactccagcctgggcaacagagcgagactccatctcaaaaaacaaaaacaaaaaaaaacaaacaacaaactggtgttcatggttagtgctatggcttatttcatgccctgtccttgagggggatctcagcccctaagtgaaacacttgaaattagtaaactgggtcggcttgcaagcctgatttttgaaaaggtattatggtgaaacctggaaacctgcatgaattctaatgtggcccacctttatacctatgtgagatgatcttgagctctgtaacctccattgatcttaccagtggctcagctagctctcattttatttgtcttcttgactctcccttaaattccccatcgtgcctattcccaatttatgcctcttaaaagtcattagtaactgaaatgagcaaagtttaagaactggtgcctcttcctggcctccatatgctttaatttcattgcagcattggatatctcatcttcccatgtctcttatcatcaacctcaagctccccaaatttccttgctctcactaaatttacccatttttctcaagccttttaagatttcttagaatccagaactgtaagcaataaatatttgttgtttctaaatcacccaggctaaggtattttgttatagaagcaggaactgactgaggcaaaatgttatcttgcttaattcagaagacagaccctatggttacgccattttgtagatgagctaactaaggctaagagaggacaggtaacttgcctgaggttacacaactaggcagaagccaaatccaaataccagtcaagcactagccaccaggctctcctttctcatctcccacttctaatcaattgataactttggtagatcccaccttggtttagtaccttgcatccacacctctgtgccatcccagcaccatcataattctaatcatacatttcagtatgattggtcaggtgcaatagtctcctaatctccttaatatctctagtttctttctcttcaacacaaatttccacactctatgatcttactaatattcagctcccatcatgttcttcagaaaaagaaaaatgtgtggaacctacgcaatgtctaggtctgttcagtgtcttcaaggtattttacaactctgttacattacaggtaactaatagtaatgcaaaatattaagacatgcaaattatttcctgtttgatacaggtttactttgacctccttccttcctgccacctggaggaagaaaacagctttgcctccattttcacacacatttcaatattcctgttttataaacatgcctgttgtttggattatcttttaaaccagttatatcatctgcagcttcccttgtgaattaaataaaatctttaacacaggttcatttctgtatctgtctgagagttatgacttaacctattgctgaaaatgttcttctaacatgtttagctcctaacagatccttgctctaaaaccttcaatggacaccagttgccaaatgaattaaatccagaaacgttaccctggaattcaaaactaagagtatcatctactctgtcagtcatatattacactgcttgtccattcacatcctgcatggacaataaaagaaactccgtgggtgccacacatttcactctcccagttttcttcctctgctgatgctactctttcaccctggattgtggcttttcatagagtgttcaacataatagctgctgtggatgccctaacccatgcttctcaaacatttcacagtagtaacatggcatagggattaacatttgcttcactgaagtaggggagcaggaggaggacaaggaaggtggaggtaaagtagactgctacaagcagaaatttctttgatgtctcatgctttagctcaaaaatatatgcagattaaaaaggaatgagatcatgtcctttgcagtgacatggatgaaactagaggtcactatccttagcaaactaactcaggaacagaaaactgaataccaaatgttctcacctgtaagtgggagctgaattatgagaacaaatagacacatggcgggaacaaaacaaactaaggcctgtcggagggtcaacggggaggagagagaatatccggaagaagagctaatggatgctgggcttaatacctgggtgatgggttgatctgtgcagaaaaccaccatggcacatgtttacctatgtaacaaacctgcaatcctgcacatgtaaccctgaacttaaaagttggaaattaaatacacacacacacacacacacacacacacacacacacctctgcagattttgtacacactccatcatatatcagcaggggcttttgtgaaaaataatattgccacctccaaatattacaataaaatttcccttcctggcaggtgactagtctgtggtgttgtacatcccatgaaacactctgtgacaacgttcaactttacctgagccctgtgctcccagaaaaccagaattaagaaatcttcaatcctttctgtaagatcccatctccatcgttcctcaggattcccttgtttagcggcctctctaaaactccaggcccacttcctcttcttcaaaatgttctaccataattaatgctctccctgtagcagtatcctaaataaaatcacctccttaactgtccagtgcattatatctttgacatatggcatcccttctttgaaaagtccatgattttagatggtgcttcctaagattattactttaaaatattaaattgtgatagtagtataggggaaaaatatattttcctcactcaccactaagttcatggctgaggcacctataacaaaaggtagatcaacaaggaaaaagcatataaatctattgaatgaattttacgtgacatgggagccttcataggaaaatgaaaccctcaaaatagggaagcctgtgtctttttctatgttggtttgatggaaaagtggatagtaatgaaaaagtattattggatgaaaaaatatgatctaatggtaataagctgggagggactttggaaggcctgtttgctaaatcttctttgtgtccctgtatcttcagagataaggatgttccctttctccagatctgtggagggtacctcttgaatgagggtcttatgagaaggggaaggggaaggggaaggtaaaagagatcttcctgcttctgctatgttctcaaatatcaagatgccatattttgaagtcatgtgtcctgaaccctattcagttaaaaaaaaaaaaaagacctaccttgatgtggttccgaaagatttttttcacctgtccccatttaaaatgactaccaaagttatagccgtcaaaactacataggaatctctgcagcaggccaggaattgctgaggtagagaaatagaagaagtgggcagagacctttcctatcacccttaaaatatctgaaaactaaaactactggaaatagacactagttttcattcaatctttctttcaacaaatgttgctcagacatagcagatgagcggctgggtactggctatacaatctgttcaggggaaagctatggaatcttgattaaaactttgaaatccaaaccacagataagatgaaaaggaagaagatgagtagtgggtgtggagagaccttcaaagccggaaggctacaaaacatcaaaacattctgaggacaggatgggaagaccttaagttatggcaactgcaaataataatggcttacatttgttttaagggagtatcttaaaatattcaggaactaagcttagtaatttacattcatcaccttgctaaatccttagagtaactccaggagctaagtactattattatccccacttaacataaaaagcaacacagcctcagagaggttaattaacttgcccagggacttgcagacagtaagtagctaggctgcccaactcaaaatcatgtttcaataatgcaccccaagtgctgttaccatgggttttctagaaagggtatccaatataaattggaatccagagtgaggtggagaaagagtaaagagtgggtcagatttcctatgccaactcagggagtgtgaacttcaccctggcaatgggatgacaaggaaataattcaagggagggaaagcaagaggctgggacctagcaatggatacccctgtaccactgggccccttccagagcatgaaaatgaatgagaatagggtagaatacaaccacaggctcaagtgtctcaataaccacaaggtcagaaaggatttgctttaaggcaatatttaaacgccagtgaacactcaggtctgaattctgtgcatctaaccactacaagttagaagagaaaaaaatattagtgttcttaaggaagatctagcaaaaccatccttccagttctaagggccgtagagggtgtaggaggttggttcacacttcagggtgtaccaattaagtatgatgactgcagcaaaatagtgagtaacacagctagatatttaaaagcctcagttactggattcctgccactgcaggaaacttctgtcttgactaaatttaaaaaaaaaaaaaagaaaaaaatagtgtcaggagaaacaaagtgtaaaatacagaacttatttttcttcctgccaggtgtaagcgttaaaacttggcgtattcactattgtttagaagtttgaaaacttttaacaaaacaatagaacacagaagtgaaaaagtgattgttggggctttagacttaacacaaagcttttgcaaataaatgcctctataaccttaatgaattctaataaaatatattatgctatttttttcttgtatctgtcagaggtgtttgaaccagagcaactctatcttgaatagcggctgggtaaaataaggctgagacctactgggctgtatttccaggaggttaggcattctaagtcacagacgagataggaggttgacacaaggtgcaaatcacctgataaaacaagatgcagatgcgtaaagaagctggccaaaacccatcgaaaccaagatggtgataaaagtgacctctggttgtcctcaatgctcattatatgataattacaatgcatcagtgtgctaaaacacactcccaccagcgccatgacagtttacaaatgccatggcaaagtctggaagttacactatatggtctaaaaagaggaggaacccaaccctcagctccgggaattgccaaccccattcccgggaaagtcatgaataatccaccccttgttcagcatctaatcaagaaataattataagtattttcagttgagcagcccaaactgctttccaaataaacttgctttcactttactttttggaatacaaaagtattttggaataaaaaaagtacttatccctttactttcctaataaagttgatttcactttactctttggactcactctgaattcttccttgcatgaggtccaagaaccctttcttaggctctggattggtacccttcccagtaacatatccacgacaggtgagaaaagaaaaacaaaagacatatatatcatattacatcctacctaagatggtaccaatcgcaaggaacgtattaatttcagagacggtgagtattagaatcatcaaaatacactataattatcacattcatgagtcctgttgatacatttattttactgtctaaaattcaggagtttatggtaagggagtctatttgtaagagaccctgttgattttcacaagtcaagaaacaataaacttcaagacatactaaaaagaaaccagcctgatgtcagatcctcttcaacatagaaactatcctcatagtaaattaaattgaggaaatatttaatggataagcttgactttgtaaacgtgccttcctgaccaataggtacgttactgatgacgttcaggacaccccactttggcactggaggaaacagcagaagcaagaaggtctcttggaccttcttcctgcccttctcctctgaagcagactatacagtaattctctgacctctgcagtacatcattaagactcccatttcagaggttctctcactgtacctggagaaaaggaacatctctgtctctctgaagacaaagggacacagaagaatctgaacaaacaggccttcccaagtcagcccagtttattaccattagaccataaccttttatcctcctataatatttctcccctaccatctactttatcaaactgaacattaaaacatgtacatttccctatgtctttgggtcttcattttggaatgatcctgtgtcacataaaacttatgttaaataaagttgtatgtttttctccggttaatctgtcttttgtcatagtgtctcagtcatgagtctagtgacagatgaaaaatcttttgtcccctacagcatctatgaagatccaaagaatgtcaaagtataatttttaaaaagttacaaacattgcttttagataaatataaagcaaacatatcaaaatgaatttcttaatgagggaaccagtagcatggtgtattcatacaaaaagaattaaagaatctaagtacaaataggccctgacaatgtcaaactttacctgagccctgtgcttgcagaaaagtgatggttaacaaccacccctacaaaccttttgaaaattaaaggcaaaacatccccaccctttttggttctgggaaatggctgctgaagagaactacccttccccaaatgacttagatatgactattcttactctatcataattttcacaaaatgtgcagaccaccccttttgtttacctgtaacaaggccagaaagagacccaaccctttttacctctagccaatttcccactctgtggctcaggattgattagctaagattagaactctttttacccctaaaactgctagacgctgaaataaacatttcctgttcagctaactgactgaaattccctgacggcaaaacaatcccagctgtgaatctcttacctaaagagttaaccaaataaactctttatgtggttaggtactttatatgacttagtacatataaagtacaaagaaaaaaagataaaaaaaaaagacttggatttgaagaacaaagaactttagttctttgaaaggcacagtttaggaaataaaaagccaagtcacagactagaagaacatatttttaatgcaaatacttaataaacgacttatatctagaataaaaaataactaatatctcagtaagatagtcaacccaattaaaaatgagcaaagtacccaaaatgacatcgtacaaaagaaaacataattacaggaaaaaaatgcttatcattagtcattagggaaatgcaaattaaaacccaaatgagatactgctacacagctaaatagaatggctgaaataaaaagactgacaatatcaagtgttgacaaggattggcagcaattaagaacttccaaatgttgatggtagagtgaaaactgatataaccattttagaataccactggcaattccttgtaaatttgactttaaatatagcatgtgactcagtaattccacttgtaggtatgcatccaagaaaaatgcaaacatattctccaatagactcatctatgaaaaattatagctttcttcataatagccataaagtagacacaacctaaatgtccactatcagatgacttaacaaactgtagtataatcatgcaacaatactactcagcaatgaaaaggaatgaactgttgacacatgcagtaacaagaaggagaaaaggccccaggaacaaaaagatacatgctacatgattccatttatacaaaatacttaaaaagccaaacctaatctatagcatcacaaagcagatcagtggatgcctgaggccaggggtggtagagaggaggtggaatgcaaaactgtggaagaaacttattgatttgatgacagtattctacagtaatccacagtgtatgtaaattttatgtgtgttgctgtatataaatgatatcaaaaaattaaaactaaagaaataaagtctttagcttaaatgcatctttcaacaagttcttcatttgcaatctagcttatcacattagaataattggcagtctcctaggaaactggtctggagaaagtgagtgtttttttttttaaatgaaaagattttagatttacgttgagaattttaccaatcatcttaaatatttttcctttgaatctatttgatctgttcaaattaaacttgttatgtcctgaggtggttagctaagggtaccatcaacaaagtatgtggcatcagcttccagtgaattccccaaagtgggggagaaaaatattagagatggatccaaagagaaagcctttcaccaaaatctccattcagccttgcttttcatcacttaaatcctagaagaaaatgttctctgaggaccactctgtatgtaggagtagcctgatgagcaaacataatacttctcaagtatagacatgataaagcagcaaagtcaaaaccatggacagattcaagtcataaaaggattttgaatacatttagccatgcactcactgataaagccttcctaccaatagttcagctcatattacatataacaaggaccagtagctagaaaagctaaagcttaaaaagaaaaaattatcacagtggaaaattatcattagaaatactcaacttaagaaaagacttgaaaacctcttctgtacacacagcactttatcactataagttactggttctattatcttatttaatcctaataacactaacaataatacattaagagagttaatagagagttaatataaaagcacaatagagcaaacactgcatatagagcatttagaagtccttcgaaagcctctgctaggaatggcttcaaaacccagggagttgaatgtggactctccttttctcctttcttttatttcagtggttcttgaatgttcaagtacatatcaatatatcaaaaccatgtactcattaatgagccacttaaggaaggaatttttaaggcaattgtgatgaaatgcgactttcacctcactgtttctcaatctttttttcatcatcatccctgcaaggagcgttttctaattgcccccctgaaattttaataccacagattttctttatatccttatacgtattgtctctatgtctgcgctttacacataaaaagaatgactttttattgctcccaagaattaattttcaccggcttgggggtgatatcactcccactgagaatgcacgacctaacctggacctctagcttaatatgaacctctcctgtttatcttcaatggctcctttcaatgaaaagtctacatcccagagccttcttggttgaagcatatctattaaagtttgttttctttataccaagtttttcccaacatttctgctgaagtacacaatgatagtggagaaggaacatacatgctgaaaatgaaaaacatatatagacatatttagcaagcaggaaatgtatttgagctctgatatcttaaaacattaagcaaacagagaaagagtagtctttttaagagatggtccttggacaagtggatatctacacacaaaagagtggaaggctcctacttcatagaatatataaaaattaactcgaaatagatcaaagacctaagagtttaaagtataaaacttagaagaaaacatacatgtaaaccttcatgagtacggattacacaggggtctcttagctatgtcagcaaaagcacaagcaacgacagccacaacaaagaaaaaatatatataaattagacttcatcaaaatgtaaaagtttgtattttgaaggacatcattaataaagtgagaagacaatcaaagaggaatgggagaaaatatatgcaaatcacatatctgagaagggacttgtatctagaatatataaagaactttttcaactcaataataaatagatgattcaaattttttaaatgggtaaaggttttaaatagacatttctccaaacaagatactcagatggccaatacgcaaatgaaaagatactcagcattaaaagccatcagagaaatggtgatctaaacaccatgagtcaccatttggcacccacaaggtcacctataactaaaaaaaaattaataatgatggggaaaaatcagaacccttacatcttgcaggtgatcatgtaaaatgatgcatctaatttattatatacataaagatagtatatataaaggtatatatattacccagcaattccactcctagttatacacccaagagaaatgaaaacatatgttcacacaaaagttctatatgaatgtttataacagcatcatccataaaagcctaaaagtggaaacaccccaaatttccattgatggatgaaaagataaataatgtggtacacgcatacaatggaatattattagcaataaaaaaataaagtactgagacacattacagcatgatgaaccatgaaaacattattctagctgaaagaagccagtcacaaaagaccacaactgtgtgatttcatttataggaaatgtccagaacaggccaagatataaaaacataaaatggaatcataatgcccagggccgcggagggggcttcatgagaaacagaaatgactgctaatgcatctggggtttcttttggtggtgatgaaaatggtctaaaaatgactatggtgatagttgcacaattctgataatgttccgaaaaccacagaatatacactttaaatgggtgaatggtatgctacatatattatatctctctaaagatgtttgagcaggggaagggaaaggattaaggaggagttagatcctcagatcccatctcccactcctgatagccaggagattgcgacaccccctcatcctggccagtgacttaagctttgttcctgtagagagtaaaatagagggtctctgacatagagtaccccagcaaaatgagagagcagggctgcaggagagatgtctctaggaagatgaaagtgccagaataccagaagtgcatgaacatcttgagaaggtatttagacaaccagtgaagactttgggggctaagacagtgataagtatttacaaaaccaagcaaattaaaaaacaagaaaattattacatccagagaaatcaaaagtcaggcaggatagaaagtgtgatggtagtttactccacacttcagctttagatgacatttcaatactgtactaatatgaatattaatttcatcaaatttgcagtaaaattacattgagataagggacagaagaagagcgtgtgcaatagaagtgaagggaagactagtgatattagttatgttctctgcttccatagtgcaaaatcaatagaaagagcttgaaatgtaaaaaataaaaaagtatacatattacttagagatacagagataaatactaaaataatcagtttaaaagaaatgagggagaggaaggagggacaatgtaggggttttgaattattttttagtaacaagccttatagggctacatgaggtcacatatacacacacacacaataaatgggaaatgcttgcaaattgcataatgtaatgaaaattttcaaatactttataaaaataccatggaaaaattatgctattataagaaatgttatgtgaattgtgttctcaataatatgatttttgtcataatacaaaaatattttaaattactcagtaggtaaagtatttaactttgttctcaaataagcaaaattcctcaaaagatgcagcatgtttatcctaggtctccacgggcctctgaacacaatagcaattaccactataaaatcccagtctgagattttgtgcttaacatatgaccgttcttccacacttagcattttctactgtatacatcattaattcgtttagtaaatatttaagcatttactaatgatcaattcaagtaaaataaaaatatctgatctaggactgatcctaacaaattagttttctggaattatattttttctagattgctgatcaccacgtacatgaatacaaaactatttattgaagatgtgtgatattcagcctaaatcttgtaaaacttggacttgatagtctaagaagctattatgtgcacacatatttgaaggacatttttaaaagtgctaaactataaatattctgattcactgctctcttacatgcactaaaaatgacttcgtgcaatcactaaccaggaggtaggttttgtatcttactgaaaatgtcacttaataaataaccttcaaatttaaatgcaaactgtggatatcattcatagaacctcaaacttgcccttgaagtctaaatgggcaaacaaggtaactacaaaaagcttttcaggcgttaacaccctactgcttcaactccttgaaaagcagtctgaacttttgagtttttagcataatattcttatgctgaataatctctatctcctatagcatttaggctgaggacgttaagtatgatgtactgttgggataatttgcaattttcacttctcattctcagattagattactaacagtgttggaggaaatcactttactgcatagttcattcatagcagttcatttgtctattcaaaacctgatgtcttgtttatggctgtatatcctaatgtgttgcattaaggtgttaacagaactagttgcaaccctaaaattggactaggcaacatgacttgggactggcacagtcagagaccaggaagctggacatttattgagtaagaagaaagggaaattttgagacagagaatttgcaattatgtattatttacattatgtgaagttgactttttcattagccagtatacatccttgattgtgactgctatatatagtttacttttatatcctccatagtatctgtgttcacagtaggtgtaggtgtggtcgacagaatcctggccacctatagatgtccatgtcctaatactcagaacctctgaatatgcttacatgggaaaggggcattaaggttgcagatgatgaaggttgctaatctgctggccttaaggcagggagatgatcctggattatctaggtgggcccaacataatcacaagggtccttaaaagatggaagagacaggctgaagagaaggtcacagtgatgaaaagtgagaagtcaacctgccctttctggctttaaagatagaggaaggggccatgagaagctggaaaagtcaaagaaacaggttctctactagagcttccagaggaaacacagccctgctgacatcttgattttagcccagtgagagccatttaagacttctggcctccagagttgttaaatgattttatttttgttgttttatgttactaagttttcagtaatctgttatggaagccatcaaaaactagtaaatgattaatttaaaactttcaaagtaaaaaataagaactaagaagaacacctaaaggaataagtatgagccatcaagatattttcagttttctacgtctttaaccttattgggaacctttggttgatgtagttaatcactggagttttcctgtccattcatttgaaatctagaatttctttccatttgaaatagttttcttttactgaccagaagctaaactgtcctggatcacctgctggctgttcttttgagaaatcttggtattttccagtgagttatgactgcactatgggatactacttcctgagaacacaaaagttgctttagcttatcgctttaggcagatatttttgcctcagttatcttttagctgtgtatgacttaaacacaaaaattttaaaaatgtgggagtgcaaagaaatatcttttgaggtaggcagtcttttatctatttctccattcaaccagcatttgctaagcatttaaaatatcctagcattgagccaggcattgagtatgtgaagactgaacaacacagggtcattttcttcaagaagctcacagtctagtgaagcagatagaaatgttggaacaaataagagtttaagaaaggaatctgtaagtgttacaggaactttgagggagaaatgtctaacttcattttaaaaaactgccatttcggttcataaaaaatggggagttacacccctatgggtgaacatttgctgaccttgtaattagttataaactcatgggttggttagaagattcttttaagtatctattcaggcccatagctttctctgaaaatgaccaggcctcatacgacgccagaactaacatgaccaagggggtgtatctgactctacactgggccagccaatcagattctcagtccagagaatttggaattagaattcatgggatgaggttgtatctgttgtgacagcgaagtcaggtgacagagactcagtggtctaagagaccaggccacgcaggcgcatggagccccagcacagaaggcagcaaacagagaaaaagaaggccaaagcacagactccgaccacaactgcagttcttgcttgcctcccccagtgaggctttgttgccctctctctttcctgctgcagtgagagacacatttgtgtccttcacatacaatccctattttggttaaagttactttgagtttctattacttgcacagtgacatggttctacctttttaaaacagattccacattttcaccagtccatttgcctcaataaccttacctgcaatatgggaagaggaaagcagtttcctttcagggaaaaggcagtagaactcataaaagatgttcaagtataaaagcacttggactataaattatcatacacatgcagaagattgaaatctgtaactggttatgaaatattgttcacaaatgacccctattaaaagccaaatggaaggattttccagcaaaaatgaggtaggaaaaaagctcaaataaaaatgggccaagattctaggcagagctctaatattcagtttcagagattagttcggctttggccatttccaagtgtgaaagagggatggggcgaagaaggtaatggcaaaaagagaaagaatctacaaagaaccatggggaggaacaccggcaaggattttatccttccagagaaagccatatctgctgttaaaacacagtgcacagcagactgacaatgatcttcttgcaataggtcatagaaagggcattaaaagacaactttcaaaggtctcaaactagataaaccgaaatcagtaatagaggacttatgctggacctataggagattttcttccaggtgactattaccagaggaatctacataacagtggactgctgctatttgggggctaacttctgctgcccacctttgaagtcactaatagcttgttagcacagaagccacgctccgtggctcacacctataatcccagaactttgggaaacaaaggtgggcagatctcttgagctcaggagttcaagaccagcctggtcaacatggtgaaaccctgtctctccaaaaaaaactacaaaaattagccaggcatggtggctcacatctacactcccagctactcaggaggctgaggcaggtgaatcgcttgaacccaggaggcagaggttgcagtgagctgagatcccgccactgcactccagcctggggaaagggagtgaaacctggtctccaaaaaataataaaataaaataaacgcccattagcatagacaaagagaaagacaagaaagtaaaaccttagcttatgttattccctattagcatctctgataatggatttgttcattaacaagttaggaactaattgaactggagattcaaaataatctaaaaatttcagttcttgatgttagtactgctgtctctatgcactatcaagtgcacggaaagtatagaggtcaatgtatggcacatctgctttccattaccatgaaattcacttcaacacatcactgtcataaaaaagtcctatactaagcattctgttgttggtattgatccttcccttccatgttatgaagatagttattcatttttgcagactcaacatggcataatgcctggcacagagctaatactcaacatctgtgaatgtataaaagagcagatagtagaggctccatgcacttctgaattgctgaccataattgttaacattttctgaaaacttaccaaactccaggtgtagtaccaagtgctttatgtacattgtttcattaaaccctcacaacaacccaatgaggaaactgaggcacagagacctgtccaagatcatagactactaactggaggaagtgagatgcagacagaggcagcctggttccagagctcaagctctacaccacgctgcagtactgcctcccgtattctagtcctctcatgaaggcttgctgatggtctagcacatccttcatgctctgcgggacacaaaaccagacacaattttaaccttgctctttggagttaagagtgagagttaagtggtatttatacaattaactccaatatgaagcagaatttaacaagtatgtctagaaatgaggctgaaggtacagaagacaggaacacaactcttagctaggatgggagagaaatggaaggttgcatagaccagggacacataggctgggccttaaattatatagaagatctgcaaaggcagagatagagaccagattatagtcagcaaaatcatcacatgtcagaaaagtcagtgtgtgtctggggctatctggggcacagggtatcttcaggaagcagtaatgatgaatcctttaatgatactctaccaattcccccggtgtgaaaacatatcaaatcttgaggtacagaaagggggacaaaccgaggactcccaaaactaatcaaagaatactccttgaagttctgaacattaatgaggatgaggacctcactgaatggccacttctgtacaaactgagtttgaagtcacagaaatgttagaactgtaatcctaaaactcagttaagagggaagtgcatctacaaatcaagacagacctccagctgaaaatgcctcaacagacacttgcataggccttccttccacctttccgtgtgcaaacggatactgtgattttgagaatgaaacatgatagctcctgcatccactactaacaaaagcaagtgactggcaatgagggtaaatcaggcctcccttgagttggtccttgaaggtgctatcaaattaacgtatgtctaacaattctgtctccattcaaatcaattcgcctaggtagctaacctgctcactgtttctctaacaaggtaaacaatggattagtaaaaactacacatatcagacctggtttcttacaacattaggctcaaaatgcaagatttacataaagagaacatctatggtgagaaataatttgcttagacaggaaattttatcactgccattcagttagttggaaaatgaagatttagagatttggggaattctctaatgttctacataagcatagggtaaaataaaaacttcgtatttctttgaattaatatccaattctcttctagaggaaattttattgaattggaagtgtaattcttctgtttaaaagaaagcctcagccaggcatggtggctcacacctgtaatcccagcactttgggaggccgaggcgggtggatcacaaggtcaggagttcaagaccagcctggccaacatagtgaaatcctgtctctactaaaaatacaaaaaaaattagccaggggtggtggcgggtgcctgtcctcccagctactcaggaggctgagggggagaattgcttgaacttgggaggcagaggctgcagtgagctgagatcacaccactgcattccagccagagcaacagtgcaagactccgtcgtctcaaaaaaaagaaaaaagcctcattattttttataatgatcatgctgatcatactgctattctagtcactgtcaataaacaaaatgacaataaataaccattacaaggcagcaattaacatgatggtacctcctaacttctaagcttgtttctttaacgtgaaaacactatttctattggcaagtatgtagatgagagctgagtcttcctgaaggacagattgaaagagttttcacaaatatttaaaatcacagaaaaagtaatgttctgaaacatttacagaaattaataaaagtatctcatctttgtgtagattaaatattaaaatgcacttatataacttttattaaaataattaatatttaacgaagacaattgaaagaacacaactatgacaaattacattttggcagtaatgataagcctttgagttctagttctttctccttagggatgttacatatctgttttctctacttaaatcactctgcctcattatcatctctgccttctactctcagttcagcttgaaagttcatcttatacagggttacacgattttataatatcagataactctctttcacaccacttaccagagctctaatactaacttatgtgtctcattcttggttgaacatttctctacctcactagattataaactccttgagggcaggcactggttccactctcttccactaaatccccaactccaaaaccctaacaccttaacacctaatatatatatcaccatttacatatcagtcactcaataaatatttgaagaacgaaatgacaaaataccctttacctgaatgcttacctaaaaatgtatcttatatatggaatgaatgatccacacttactacatggatgtataaactcaaacattatacttttctttgcacatttgagaatatgtgtcataagctatgtttacaatgatatggaaacaaaaacttgtctataacaaaaacatgcccatagcaataacagcaacaacaagaagtggttccaaattcaaggtggtagcacagcttttttcaaaaatttgagaaaaaacaaatctattaaaacagaagatatagtctcttggactccactaaaatgagtctgttcaggtctactacaaaacacatctttaagagagattcatggccttagtagccagacagtaggtatggcccagaccttcccagcacagcctatgtattgaagactttagtgaaaacactcatgtcagcaaatttagcatggataattgcaataggaagttctataactttgctttagggaaaaaaattctattttaattttcattcccaaacagaattatgttagaataacaaaataaacttccccacatttatctgttttttaaaaatgatagtctcaaggaagagaaactttcttttcattcatttaataaagatttttgcattttatttaaagactccttatggctatattttaaggattcaagttcatttatttgtgataactagaaaaattttttgtccctttgtgaaaattttggaactaggcatattttcattactgttttcattattactgacaacttggctccctgctctgggaaatatttctggaagaaaagaaaaaaaaaaaaaaactatgaatcaactaacttacttagcaaggtcatcagcttactcaccagggcttatttcaagaccctctctgtgccacaaacacaagactactttgtctaaactcttgtccaattccaatcatttctctgacttgcagtacctgccttaaagtaatgcagaacaagcccagaactccataaatgtgctctcctaatttatccattttgagcaactaatcagattctctcaatcttgtatattcttttcctatagatctaaaatcatagctttgcttgatcaacaggtttttccggtagtcttgtggaaacttgacagtaggcattcatcttatatccactacacagaaacctgagttcacagatgttgtcttagtcaatgccatacacacacacacacacacacctgtgaccagcacagtggttggcacataatatgtgatcaataaatgcatacttaggaaagaagattttgttctatagtattacagagggtcaaagttcttataaaggagagtcagttactaaaactaaactgatattctatcttctcatgtggtctttcggcatcagtcctatcctacacaataatgccttgcaatctgtagttgtgaaattagacttctttttatgtgtgcacaaattaagccagtttctacaaattaaagaacatccagcaattattgctctccttcaagctgaccaataggataagtttaagcagtagttttgagaatttgtttttgcaattttttttttttttgagatggagtctcgctcagtcgcccaggctggagtgcagtggcatgatctcggctcactgcaagctctgcctcctgggttcacgccattctcctgcctcagcctcctgagtagccgggactatagatacccgccaccaggctggctaattttttgtgtatttagtagagaccgggtttcactgtgttagccaggatggcctcgatctcctgacctcgtgatccgcctgcctcggccacctaaagtactgggattacaggcatgagccactgcacccggcctgtttttgtaatttcttatactacaatgtttccttctggagacagaggaagtccagcagatgaagtctaaaatactctgcttattttgtgaaaagaccaggcattcacacaagcgtttttctcaaagctgagaaaaaggaggctgaaggtgcaaaagatatcagagtactcattcagaacccaagagtctataaaatataaacctggtgagagaactggcctcagccaatggagatgcctcaatagtgtttgtgtcacgagcgaacaaggtgaatcataaaaatattttttaaacttctgtttcaaaggtgcaaaaggcatatatattagtctctttgcattactctaaaggaatacctgagactgggtaatttttaaagaaaagaggtttatttggctatggatctgtaggctgtataggaagcataacactagcatctgtttggcctctggtgagggccttggggagcttacaatcatggcagaaaacaaaggcgagccagcatgtcacagggcaagagagggagaaagagagagagtagaggaagtcccagcctcttttaaacagccagatctcatgtgaactcacagactgagaacaaactcactcattactgcaaggatgacaccaagccattcatgaggaatccaccctcatgtcccaaacacctcccaccaggccactcaaccaacaatggggattacatttcaacatgagatttggagcggacaagcatccaaagtatataagtacagcagctagaactttcagttacttaaaaaaaatcttgctgacatcttaattacctgctgaagtcctggtggtcagcaagaaagcagtgaaaacatttaaaatttcaattttcatattaatggtcctaatttctggatctggttttctcttttaaccatttgcataaaaatgttttgtgagggacatataaagaagttggaagctgcagatataggcgttaaaaaggaattatttagcagacagtgagggtatggagtcctccgtaaggttttcctttgaatgaaaagcagccgccaaatcattttcttttctaacaaagagcagcctgtaaaatcaagctgcagacccagacaagcaagctggaagcttgcaatggatgaatgccagcagttgtgccaataagaaaaagctacctggtactaagcatgctcaaaatggcagctccatcttcccttttctttgccagccacatgtagagtaacgagcaggcaacatggcgccagctgggagaagtcgccatttgcttaagatcagggtagggcatccagcttcctcgcatgttatgtaaacatcacacctcgtccaaccaatctttgggccctatgtaaatcagacaccgcctcctcaagcctgcctataaactccaatgcactctgccacaggctggaagtctcattcaggcacccttttctctctcaagagagaaagctgttctcctttctctttcttttgcctattaatcctcagctcccaaactcactccttgtgtgtgtgtgtccctgtccttaattttcccggcatgagatgacaaatctcggatattatcccagccaatgacactgcttcactgcaatttgcaacaagaaaaatatttacgacaaggaaaaaagatgaaccaactggaaattaatgacttttttagattcagcagagaactgaggtccaaagcaaactagtatccccaaatttggagaaacatgtaaacacaaagaatcataagatcagattacctaaagcaaaaacagaaggacctaggaactgatacgaacacgtgtatgataattttgacaaattgctggaggctcagtgcagactagcttgagagttaaaaactcttgcagcctagtcttaggggagactatacttttctgagttttatgtccaagaaccctatcatgttctcatggggaagtctggagaaaaatctcagggaagagaaaaagtaaccattttggaagtttcccagattgttctctgtaagaaagacacgtcctttcagggaagctattttaccagagttctatctgacttgggagaagggcaattagtcccctccagactcttttagccttcctgtctaatgtcaggggacgaaaaaagggctcagaacatttcagaagatcgcagcctagaaactcaggctcactaagaaaactgagatgtaatcataatatacaacaattatccttcctgagacctcatcaccacgtgaagaggtctttggtgattacaactgagaggtgaaacacacagactctattgaataaggagctcttaggaaagcccaaagacaacagggaagacaaaaaatacgagcacacagaagcatctggaacttaaagctacagcaagcattaaacacagtccagctctaagctagattaacataaaacctcataacaaaaaaaaaaattcttagttcccatcactcgaggtattatttccagctttcaacaacaaaaataaggcatgcaaaaagaaatttcttaaagataaactttaaactattttaaactaaataaaaatgaaaatagagcttagcaaaatttgtggaatgcaaggaaaacaatgctttgcaggaaatttaaagaactgaacacatatatcaaaaaagaagaaagatctaaaatcaataatctaaacttctgttagaaacccacagaaagaaaaacaatttaaacctaaagcaatcagaagaaaaacagaatagaaattagagcagaaatcaattacattgaaaataggaaatcaatcagagaaaaattaacaaaaccaaaagctaattattttcaaaagatcaataaaattgctaaacctctagtcaggctaaccaggaaaaaaagagcaacaatacagattactaacattagaaatgaaagaggggtcatcactactgatctcacggatattaaaaagatgataaagaaatatgatgaacaactctgtgatctcaaatttgataacttagataaacagaggcaattccttaaaagaaacaaactaccaaaactcacaaaaagagaaatagataatctgaataggtctattcaggttatatctatatctgtatctttttaaaacattgaatcaataattaactttctaaaaataaataataaattgggtccagacaatttaactgatgaattctatcaaatatttaagcacaaaatgatagcaattctctacaaccttctttagataggtaaagcagagggaacacttcctaagtcattatgttataccagcattactctatagcaaaatcagaatacacgtgcaaaccccattaaaagaaagaaaaactagaaattaatatcgctcgtgaacatgatataaaaagcgtcaacaaaatcttagcaaatcaaatctaataatgtataaaagttattatatactacaactaggatttatttcaggtacacagctggtggaacgttcaaaaactcaacaaacattcctagcactttgggaggccgagacgggcagatcaggaggtcaggagatcaagaccatcctgactaacacagtgaaaccccgtctctactaaaaatacaaaaaaattagccaggtatggtggcaggcacttctagtctcagctacttgggaggctgaggcaggagaatggcgtgaacctgggaggcggagcttgcagtgagcggagatcgtgccaccgcactccagcgtgggtgacagaacgagactctgtctcaaaaaaaaaaaaaaaaacaatagaagaaaaccaaacaacaaaaaaaactcaacaaacgtaacttagcgtatcaactggccagagaagaaaaatcatataatagcaacagatacagaaaagcactgacaaaatcccacactcatttatgagtagaaactctcagcaaactaggaatagatgaaacttcgtcaactcgataccaaaaaatctacaaaaaaacctacagctaacatgacatcatactcaatggagagaaactggatgctttaagatcagtgtagtatagtaggctgactaatgatctcccaaagatatcaggtcttaacttttaaaacatgaaaatgttaccttctttgaaagaaaggactttgtagctgtaactaaattaagaattttaaggtgagaagattaccctaagttatctgagtgggccttaatgctatcaatcataaatatccttataaggtagaggcaaaggtgaaataacacagactcatcaagaagccagtgtgaccaggaacacagagatcactgtcacacccacacccacaacccaaagaatatatggagctaccagaagctgtcaaggaatggatttccctccacagcttctgtgggagtacggccctgctgacacctagattttagacttctggctttcagaactgtcagggaagaaatttctattgtttgaagctaccagtctgtaataatttgatatagcaagctactgagaacaaggcaagattttcccctgttaatactcctattcaacagcataatggaagacctaggtaaaagtaagacaagaaaaggaaagaatattaagaaaaagatataacgattgggaagaagaaaataaaactgtttttgctctcatgatatggctgactatgtagaaaaatcctaaaaaattgacaaaacattctctagaacaaataagcaactgcagcaatgtttcaggataaaatttttcttttatcctgaaaaaaacaggataaaatatttctttccaatatgccagaaaataacaaatggaaattgaaattagaagcacaatatcacttatattagcgtaaaaaataaaacacatagatgtaaaaatctaacaatatatgtacaggatctgtaaggaaatataaaaaattctgatgaaagaaataaaatctaaataaacgaatagatattctgtgttcatggataggaagacttgatactgttatcggttcttcccaacttgattatacattcaacgcagtttcagtcaaaatcccagaaagttattctgtgaatatcaaaaagctgattgtaaagttcatagagaagggctcaagatccagaatagccaataaaatattgaagaacaaagttgaaggagtgatactactcaactttaagacttgctacaaagctacagcgatcaagacagcatggtactggtgacagaataggtaagtgaatcaaaagaacagaagaggaaatccagaaatagaccaatacaaacataaacaacttgccctggacagaggagcaaaggcaattcaatagacaacaaatagtgctagaataactggacatccatatgccaaaaaaaaaaaaaggggggatctacacacagaccttacaccttttacaaaaataaactcaaaacgcatcacagaactaaatgtaaaatgaaaaatgcaaaatgtaaatcctctgaaagataacacagggaaaaatactagatttgagtttggcaatttgtttatagatataacaacaaaaaattatctacaaaaaaaattttaaattgaattgtattaaaatttaaaacttttgctctacaaaaaatactgttaagagaatgaaaggacaaggcacagaatggtagaaaatattaacatcatatgtcattaggggattacaaattaaaacaatgacataccagtatatacctattaggatagctaaatccataagactgataataccaaatattggcaagaaagtggagtgatgggaacgttcatgcattgttggtggaaataatggtaaaatggtatagccactttggactacagttttacagtttcttataaatctaaacatagtttcaccacagaatgcagtaaccaagttcctaagcatttactcaactgagttgaaaactaatgttcacacaaaagtctgcttagggaagcttatagaaactttattcataataatctgtctttcacaacacgagaatgtataaacaaactgtggcaaatccatacgacagaatactagtctacaattttttctttaaaagaactcttatgccataaaaaggtgtggaggcaccttacagacatactgccatatgacattatggaaaagggaaaactatagaggcaataaagggattactagttaccagggatccaatatagtttcttagggcaatgtagactattctatacgaaactgtaatggtggatacacgacaatatgcatctgtaaaactccatagaaccacagaaggccaagagtgaactttaaagtaaagtatgaacttcagttaatataaatgtgtcaatattggttcattaacttcagtaataaatgtgccacactaatgcaaggtattaatagtaggagacacttggtggtggggcggggatgggggaatagtggcgacacggaaggaaaatgttatggtaagtctctcaactatctgcacaatttttctgaaaatctaaagctgttctaaaaaataaagtattttaattttattttaaaaagtacatcttagaaaacatacctaggatgatctctaggctctggatccagaaacccctatttcaaacaagtaggaagattcttatggctgctaagatatcagcagtccatggtttcaggaatacagagccccaaggtgaatacaacaaccagactgaaataagtgcagttccaagaatggagcttaaactggaaagactagagagcagctggctagctgtttagaggtaacagatggcagaaccctcaggatcaagtcatcctgaatgaagaaagacctttggagagtgcacacttgagtaaatagcggcctctgttcatgttctccagtaacaaagaaataaactaattagatggcattcataagcaagctaaaattcctttcactggaaatctggaaagaactgatttaggagagcgaaaaacagggatatatacacacacacacatacacacacacatacatgtttgtagtatcaggaaatgctcaactttgctccctcaagtcatccagttccaatgttttatatatgctattatatgtgacaaaatcatataatatatattaatacatatcattaaaaatatgtaactgttaatgtagcataggtatatatttttcacataccataacatttatccttctaaaatatgtaattcaatgcttttcagtatattcagaaaaacatgtatccatcaccattatctaattccaggacccaattttgtttttaacacatctcaaatgtagattacaaaaaaagaattgatccactagggatacggtctgtaagaagcagcctagattttttaaaaatgtttttcttctactctacatgtaaataagtctgcatcctgtcagtatttaaggttttctttctttctaacaatcatgtaaggctggtattttttaaagtttccactcagaagactgtcttcctgacctgtaaagaaattaagtgtaaaaatgtatgcaattggactaaataatgaaaaagaggttgagaagagtgcaccgaaagaggtaaaaaaaggagactatgggccaaaggtatacaatagggaaaataaaagaagtttctagggcactgcagaaagacaatgtattctagtgattacctttattagactctattggatcaggagccagttcattaaacattaatggcaggggaatgccatccatatattataaatagccattaagttgagatagacagctctgcccagggtcagtatgaattaataaaaaaaactgaagctggcatttcagaatcataaaaagataggtttagtagaaaatattcaataagaaggaagaagaacagtatatattacactatttgtctgaagagcaaactgaaaatgagaacaaacttaacataaacctaaaaagacccttcatgaatgaaacacttatttctcgaaaatggatgtcacttacatttaagaatcgtaacagtacaatgtgtgacattggcaaatggtaaatgtaaagacaaatgaggtgtagacgttcagctagaaattagacaaaatgtgaatgcaaacaaaatatcctcactgaacacagttccaaacatagtatgtggcagcaggagaactgaagttattaacagataaggtctaatttccaatttatctattgagttaatcctgaaacctatcccacttgcctgtatttacaaggtaggtcatcttagttttaccatgagttttcactattttaagagagaaatcatgttatgaaacatggtactgataagatacttacataaagagctacacttttttaatttatttttctcactttctttgctaatttacacccattgtttctgagtaatctgaagaatgagacattcccatttttttatgtatcataatgtttctaagataacgcatggactttttaaagaatttcatggtagcaaatattatgactcaaagtcaatatgaccctggttaacaaaaatgatcaaaaactaggaaataaagctaacagtagtggtagcaatggtgtatgtggcgtgtctgttcaatactgtactagaattttgttccccaagcccactcaaggattatttaattctctaaaagaacatatctgtgtttggctttgctatatacattttgattattgtaccaccactgtcaagttataggttaacttgtagtttttgtctagtacgaaagaaccactgaagtttatggtttaattgtcctgtgggatactaatcagtcttgtataaaacctagtaattttattcaaatattctccctctccaactcctttttaacaaaatgtctagaagtacccaggtcctcaaaatgcccctggattgcactggtttcttcattaaagacatattaaatgttggtatatatttattctgtatttttattatagtcatattaacccttagaaagtagtatttttcactccaccaagcacctgtgtaagattttttaaaaaaataaacatttgccaatgttttgagaggtgaattaactcaagtaaggcataaccagtaatgccaaaaataggtttatgccccatgaattatctctccagtggtctgccagccacccataaaagtacatttttaagttatactatagaatgagtgagataaataaaatgaataatgaacggcagacttaaaaattatgacattttcttaatcttcataaagcctgtgatggatttttcacttgtctacttggctaaggtgaactacagtccctccccacttgttcaaacacagatctagatgctgctgtaaagagatttttcaggcataattacagtccctaatcagttgagtttaattttaggaaatcatcttgggtgggcctaacttaaccagtttgaacactttaaaagaagactgagaaagtcttgtacttggtgttggctgccagctgagatcttggctgagactgtcagctagaactctattttttaaattttattgtttaaattgacacacagtcgatgtacatagttttgaggtacatgtgataatgtaatacattcatattacttagcattgggatatccatcaccttaaatatttgtcttttctttatgctagatacatttcaattattttcttccatcaactagaactcttataactcacggctagccactccacgtgatttggcttctctcacagcatggctgttggattccaaagaaaagcatcccaggagagggtaagtgggtgtagagggggaggaagcaggggtggggagcacacaccaacatgcatgaggtgaatgctattcactccacctgcactgagtgcatcctactctattctctatcctagtttcaacagaaggaagagaaaacagactccacctcctgatagtgtatgacaagaatctggaacaccacaatgaactagaaatgcaggtgtggccacttttggaaaatgtaattatgccacaacaatctttgactatttttctattgtatcattttcataatggtttttagaaacttggaataaattagagtcattagccctatgtacataatatgagttgcaaatatttttccctcaaacaaatgtatttttgttattcttacgtatcttttatctcagaattctaagtcccttggaagtatgcaaattttattgaagggaattgaatttttaaaagaagcacttgtagaggacattttcaatattagtgctatcagttaagtaatttacagtaactcttatggtacccaatctttctctcacagtgatatttacaagtttaaacattttttatctcaaacagagtggcctctgaattttcctcctaacaaggagcttaatctactatagcaaccataatgaaaatgttatttaaaaatcagacaagagcaacagggaaagtcggtgtttgctatttaaattgtttttgtatcaatgggcttagaacactgtggagctatatcattttattcagttttctttcattttaatgtcactgaaaggtcaagcaataatccagagatcaatttaccatcccatgcacattgcttccctccaatttgggaatataaattcaaatgtaagatggtcttcacccaagctcttccctgcaaaaaaaagttaaggcctcagatatttttatatctacagagcagagaaggctttacttcaaataaatgctgttgcaattagcctgatgacccttcttttgccttttaatattttgatattagcaggttctacttttcctcctgatgccgaaaaaaccatgtcatgttaacaaattccttaaatgttgaactcagtcagatcatctataaaatgcaacaatatcatctccctacctatctgttaagtttattatgaagacaaagtaaaatttccatttttttttcagacagagtcttgctctgtcacccaggctggagtgcagtggcaagatcttgcctcactgcagcctctgcctcccaggttcaagcaattctcctgcctcagcctccccagtagctgggattacaggtgtgcgccaccacacccggctaatttttgtatttttagtagagacgggctttcaccatgttagccaggctggtctcaaactcctggcctcaggtgacctgctggcctcagcctcccaaagtgctgggattacaggcatgagccaccacacccagccaaaatttctgtctacttctgacattagactgctgagagtactacatatatgacagtttattagtattgcttttaatacttagaacactgtttgagacacatattaagtgcttaataaattttacctggtgtttttgtgatatgctttattttatttaagaatttaaggggatcaagtgtggaaagagaagacctaccatctcatcatcaagtattatgtgcatatagcatgagaggaagagagaagaaaaatggggagacaaagaaggaaaaggaaaagaaaggattcagggttctctgattatctctgtgcaggtaagctgagggaaactgcacacacttcatcagcaccagtgggttcccatccagcctctttcatttactactgatatgaccttgggaaagatacataacccctctgtatcagttatctattgctacttgacaaattaacccctaaaattcagggcttcaaaccaccataaatatttagtatcttatacaggttctgcaggtcatgaagtttgaagctgattagctgagtggttctgactcaaggtctctgggaaactggagtcacaacacccaccaggttgggaataatctgcagacttggctgaagctgaagcatccacctcaggttcacttacaaggctggaagttggcgctggctgttggaaagaaactttattccttgctagaggaagctctccataaagctgtttaagtgttctcacaaaatggtgactagcttttcccaaaatgagtaagattttatgacctagactctgaagacgcacactgttgctttcactgtattctactggtcaaagagataacataatacaaggtgggaggagatgtcactaggaggagaattttaaaaggtaaggatcactggaagccacctggaaggctggctaccgtgccctcaaagtctctgatccagcatctataaaatgagaataataatgacttctacctcacaatgttggtggaaagattaaatgacaccatgtattcaaagtgactgtggtccagcacttgctccacgaattgcaaacctccttaatcattctgttttctaggttctggcacagtgtgtgtgtgtgtgtgtgtgtgtgtgtgtgtgtgtgtggaggggggtgtgggtgtgtgcacgcacacatgcctgggtccatttggccacctgatgaagtctgtgtacaacttccaaaaatcatacttttaaaaaaaagtacataggattatgagaatacagattatactagaacatagccatgaaaatattttaaaatatatgtaatacactaatatttgtttctttattaagacattatacaatgaaacccaatggaagctttaacaactatatcttcaaaggaatgataagcacaaatgttttgggatacatataataactgaaatatgattagacagtatctgtgatttctattggtgagaaagtcacaagtactgccaatgccaccgtggtcttttgcctatattcacacttgaaagaaaggctaaaatctactcagaggttagtgtaagtgaagatatcatttttttaatccaagtttaaagttttcataaacactctccacaaacccaatggggttcaccggaccctggactaaacttaatttactttaaaagaaagaggaggaaagaagaataagaagaccattctagtatttaatattctctacaaataattttcttcctattaaatttcctactgtacacaggaacatctgttctccatggttctctcatttcaaaatgatcactcatttcattggacatatacctacataatactttcatttaaacatattttaatgaatctttagacctagataaatggatttacagaagtgctacattaaaaggccattttaagtttgggatcgaaaggacctttaatttatagctccagaaaatatccattccatggctcaaagatccttgtggattataaaagaggaaacgactaacagaaaaggaattattcaccacattattaaacatgacaaaaagcttctgaattggagcttaaaacgggctatttaagattccagcaatccctaggactttggcaacaaaaatgttcaaaagccttttatagttgctgtcagatttctgtaaagcatttgagattcctgtgaacttatttatataacaagctaaaacctgaagctgacttgaaagtctttctattctaattatgtagaaatggaaatgcctagaaatgatgttccgtgttctcccaagaatatcctcttgaaatggtggtttcagaaccgggtatttagaagaaggaatgagagtgtagctgctatggtttattacacggaaccattcagcagatatacaaactatagtttagcaaagtggcttcaaagaactgccatttagttattctctctgcagcagcacattctaaatgactgttcatattgttccctcctggcccactacagtggtttatttctgaagctctatagttcatgtgtaatcatgtagcaaagtaattcacgatataatgacccaccaggatctcagctgattgtggttcttatcacaatactgtttctgatgctatgcgtggctttccaaagccaactttttaacctcttatgcttcagcattccaatttgacaccaggcccctctgtgttccgagaagtcagcacataccctaagctagaaatgctaggagatattccaacagaaaaaataagatgggttttgggaaagagtactgtgcttgacagcttctaaaatggctcctaataagcccaccacctcctgctattcacacccttatgtaatcttctctcactttgaatgtgggctggacctagttatttccttttaacaaatagaaatgtgatttgtttataaatgactgtgacttcatccttttcaccctttctctgccctcttcctgcttgatgagacaaggcaagctgacctatggagagcctcatgtggcagagaactgagaccaacagtcaacaaccctagaagaactgagtcctgccaacaaccgtgtgagtgaatctggaagtggaatgtctctaatcctgacaataagatattgacaccaacagcagagatgttaaaacatgtagggtctcagaccttatcaaggaaaggtctagaaaaggaatatgaaaccatttttttctagttccaaagcctgtgcttcattcactgcattacactgtgtctccaaatgagtcctgttccaaatactgaattgggttttgcctgtttggaagttggaactcatttccctagagataaaatggcataactgaaattaacagagatctgacacaatagcagagaggggaagacagaggacttggggtgggagggctcacaaaggtggctgtgccaagaactcctgagtcttagcagtctgatccaggcagctcatgggggctggaggagtgaagtccaaaggctggactgagaaaatcacttcctgatttgagttagcttttacttgatactaggatctttgtggattaattaattaaaaatctccagatgagactaaagcggcctcattgtctgggatgataatcaggttcattgtctcacagctgaggaaatcaaggctgcagacacacaaggagtgaggttaaatggggaagtttaataggccaaagaaagagaatagctctctgctggggagaggggttctggaaaaatgggttgccggtccacagggaaatacagggggttttatagatacctggtgaggaggcagagtctgatttacatagggtgaaagactagttggaccaggtgtgccatttgtatagggcatgaaaaaccggttaggactaggtttgccatttgcataggatgcaaatttctggtcgcctccaccctaatcttttattatgctgtcacgtcctctatctgagctgtgccatgttgcccgtttctttactgtacatatggtaacaacaaaaaaagggaagatggagcctccatgtcggacatgcctgggccccaggtagcccttttctgttagcacagctgccagcattcccctgtgcaagcttccagcttgcttatttatgttttcagctcgatttttcaggctgctctttggtaggaaaaaaataatttcttgggatgcttttcattagaaagaaaattctgctgagaactcttttacccttactatctgcttaaataatttctttccacttcctgtgtcaaaattatccatatttagagtgagccttaaatccaatgactggtatctttatgagagaaaggactgggagatttgggcacagtgacccagaggaaaagatcacatggaaagagaggaaagattggagccagagtgccacagcctaggaatatcaggagccactagaagctcgaagaggcaaggaagtatgctcccctgaagacttcccatggagtctggccctgtccatatcttgatttcagatttttggcctccagaactgtgagatgatagattccggtgatttttaagccaccaagtttgtgataatttggcacagcagcccttagaaatgactaccaacaccagtgatactaatattcaactagacgtgagagccaccacttgaagctgtggcgccaaccttgccaggtgaactgttattgagctcaaggtagggcccaggtggaaatcactagcaatgagaacaccagctgcaataatcaccagaaaaccaccttcatcttcaaaacaaaatattaaaaacccactgtgttaaaaagtctttttttaagcaaggctgttgtgagacgcttcgaaatagttgaatataaaccaagacctatattatactgtagtcggatatcatctcaggattagcatactgtgagcaaatcctcaacacgttgggagttccccttccccttccagataaaagttgaaaagcctgagaaaatcaggggtgtcctcctaacttggatgttagctgccgtccatttctcttgaggttttcctttctttctttaacttttacaaccaaatatttatagttagtcctgctctaagaaagccttagaagccaggataagagcatataatactcagaacaaaactgtgtgaaacagccatattattctatctgtgacttgataattagatgtaactaaattgccggccaagatatcccatacccaagcaattatagacaccaactaacgaagacaggaaatcaaagaatgaaagctgaatgccatcagtggacatatcagaaaacatcaagaaaagctttctatgaagaaaaaaagtgtgcaactcttttaaagaaagcctagtcataaaatgaaattgaaatgtgtatttttttgttttattggctttatttcaaatggctattattaaatccctgatagtcaattaaaaaacattcaccaaactagaaatctgctgaagtatacatgtataagcatgcctaaatatattacaaactattgaattgaaacattaaaacattctccatagcaacactaaatcaaactgatatttcattttggttcccctgatgccaatacatatagtacattaaacccacagctttcagagcataaaaatgtctttgaaaacatacgtaatctagagatgatgttcaaatatagtataatatacaccttggtttatagttattatttctttcccaagattacatttctatgagaaagaagaggagcctaaatatgatatagggtcattaattttaatgatgaaaacagaaattttgactttgccagttctgaccattggggaatctgtgcccatagtaatagattactcatgtcttacttgcacttttcccaaaaatctcaagtcaaagaccacagaatttatacgctagaaaatataagaaaaaagggcacagaagctaaacaagaaaagaagaggaaaaatattccagttatggcttcaaagtcactaatttccatggaaggagattaagcgtatactttatcgaccttctctgccagcaaacaacgttttattcatgtcacttaatggggaaggaggtcaggtacagatctgaaggtcacctaactatatgctttcttccacagtattatagggcatagggaaagagcctaaaatatgcctgctggttggaattgaaaatgaaacggtcccttgtttaatgccataaaaagtatcctgagaaagtgtagctcttaggcttttcctctccgaggatttagggaaaatcaacagtgcccactggacaaaaccactttagataaagaggaatggcaaatttaagggctcacaaaatgtacttaaaagtttagaaattgggctttcaaattataccagtcaagttttacatgaattaagtcctattttgagctaggatgcatcattatgggaggtaaaccaaaatcttaaaaaatatattagtttagaatgagaactgtgcctcaggaggtgccatggaattcactaggaggtaaacctactgcaaattacattttaaaaagcaatctcagcaatatattcttctctaaaaccacaaattcattttgaatcaatatttgttatgagtccttttcaacatttttccaggagcaacacagcactgtgtcttcaggggtcgaagagggaatctacaggacttaaaaaagcatagggagtgaatatggggtcatagcttctgtcattgttgaaaagagatgccagtaagttctatgcattaaaacagaccacgcaaagcacatctgatggaataagataaataacataacagattcactcttgcatgtccaagcgtacttctgagatggtgaaatgcatttgatgcactgaaacatgaaaccatcaaaatctacagctggaagggacctcagagatgaatcatttgaaagccctccagaggaacccaggttccaggaaatatgaagaacgtgaccaaggtcacaagttagctggcagcagaacttgcaccagaatactgatctaattttattatatacacttttagtttctaaacaccaagaggcatgaatttacaaacaatgagtacagccacatgctgtgcctaaaataacaattacaaaagtaaacctacagcctcagttaaattacttacctgtgtttttcccccaccatacagaacattaccattcgcacaaaggtccctcatgttgcccctttctggccacattaatttgctcccgccctcactcctctaaccatccttaatcactgccaaccactcatctgttctccatttctatacttttgtcattttaaggatgttatataaatggaatcatacaacatataaccttttgaaattggctttttacgctcagtgaagttctctggagattaagctgtatgtatcaatagttcatctgaatgcagaatagcctccgtggtatggatgtaccacagttcatttaactattcacctgcagaaggacatctggattgcttctagtttttggccattatgaataaagctgctaggaacatttgtgtaacggtttttgtgtggatccaagtttttgtgtttcttggataaatgaccatgatcacaaatgctgggttgtctcagtccgcttgtgtcgctataaaggaatacatgagtagccaggtcagtggcacaggcctgtagtcccagctactcagaaggctgaggtgaaaagatctgttgagcccaggagtttgaggctacagtgggctatgattacacctgtgaatagccactgcactccaccctgggcaacacagaaaaagaaatctcttaaaaaatagatataaaggaagacctgaaactgggtaacttacaaagaaaaaaggtttatttggctcacggttctgcagggtttacaagcagcatgatgctaacatctgcttctgatgagaacctcaggaagctcccactcatagctgaaggagaaggggagccagcatgtagagatcacatacatggcgagacaggaagcaagagagagggtaaaggtgccaggtagtttttgagcaaccagctctcagggaaatgctccaggaactaagagtgagaagttgctcattgctacccggacagcactaagccattcatgagggatctgccaccatgacccaaacacctcccattaggccccatctctaacagtggggatcaaattttgacgtgaggattggaggctattcaaactgtagtaggttgtaaggcagttatatgtttagtttttaagaaactactaaactgtctatcaagcgtgactgtatcattttacattcttaccagcaaagatgcaaaagcagtttaatagagaaaggatagcttttccaacaaatggtgctaacgcagctgggcatacataggaaggagggtgatatggtttggctgtgtccccacccaaatctcatcttgaattgtagctcccatgattcccacgtgttgtgggagggaccaggtgggagataattaaatcacgggggtagtttccctcatactgttcttgtgatagtgaagaagtctcacaagatctgatggttttataaggagtttcccctttcgcttggctcattctttctcacctcctttcatgtaagatgtgcctttcaccttctgccatgattgtgtggcctccccagccacgtggaactgtgagtccattaaacctctttttctttataaattaccaatcttcggtatgttcttatcagcagtgtgaaatggactaatatagaggggaaggggggaaggaggaggggaaagaagaggaggaacagggaagcaagaagaactttcacataaacctcacaacttgaataaaaatcaacacgaaaggaatcattttccccgcatcttcaccagcatttagtgttgtcaccacttgtcactctcatagatgtgcagcgatatctcaacgtggttttatttagcattttccttagagttaatgatgtagaacatctttttgtgtgtttatcagttaaatggctgtccatgtcttttgcccattttccaaatggtttgtcttttttgttgttgttgagttttgcgagttcattataaatgttagataatagccctgttttggatatgtggttttcaaatatttactcccagtctgcagcttgtctttttagcctcttagcagagtctttcagagagaaattttttaaattttgaagttaaactaatcaatttttccttttatggctcatgcatttgatgccaagtccaagaaccctttgcctagacatagatcccaatgactttttcctctgctagtttctaaaagttttattttctaaaagtgttacattaatgttcatgagacattttgaatgaattttgtgcaaggtgtgaggtataggttaattttttttcctaactgtacaatttgttgaaaagtctattctttctctaactgaattgcttttttatttttgcaaaaaaaaaaaaaaaaagaccagtgggcatatttgtgtaggtctgtttctgggttctctattctgttgcatttatctatgtgtctatacttctgtcaatgacacatggtcatataaatattacaagtatgtaagtcttgaaactggatgatagactaattcctaccaccttattctttttcaaatctgttttagctattctagttcctgtgcctttacatatgaatttcaggataatcttgtctatatctactaaaaattgttgctgatattttcataagaattatattaaaactctgtatcaacttgggagaactgacatatttactatgatgaatcttctaacctgtgagaatatgtctctccatttattgagatcatctttgctttctctcatcagcattctgtagttttcaccatacaaattctatacattttttgatagattttcatgtatttatttttgtgtgtgtgtaaaaggtgctgtattttttatttggtatctatctgttgattgctaatataaataaacatagttggtttctatatgctggtctaatatcctggggcctttctgaactcatctattatttctaggattttttaaaaagattccttagacttttctaggtatgacttacaaggaagtcacctgcaaaaaaaaggctagttttactgcttcctttctaatctgtatgtcttttatttcctttccttggctcactgtgctggcaagatcaataatgaaagtattaaaagtatcagaacttgcgtagggggcataaaatactaaagtgttttcctactctcacacactactcaacacttctcacaccagattctccaacagacgctaactgggtatcctagaattcaattcagttcacacattatctacccagagatattgtcagatccaacaggttaggggttcagtcccacaagacagctcccactttggatgtcagttgtgtaccccaggctgtgaagtgtggttctgactggccagctataaatcaggattcctacaacctcctcttcatgttcaagaaatttggtagagtggctcacaggactcagggaaatgctttacttatgcagatatacaaccagatggaagagatggagaggacaaggtatgtgggaaggagtgtagaccttccctctctgggaaggtgccctctctacgagcaccaccctccaggcatcatcacacgttctgtaagctggaaggtctccaaatcctgtccttttcaggtgtttatgaagcttcatttcttatgcatgattgattacagcattggctactgatgatcatccagaccttcagaccctctcccctccctagagtcaggagataaggctcaaagttctgatgcttataccacatagttggttctcctagcaaccagtccccattctgaggctatctaggggccccagccaccagttatcatattagcattaaaaaacactcttatctccagagatttcacaagttttaggaattgtgcacccggaaccaggggcagaggccaaatatgtttattatatcaaaatatcacaaaagtattcgatcttccaacactgtgttgaatagtagcggtgagagtcaccatctttgactttttcccaaccgtaaagaaaagcattcagtctttcaatgttaagtatgttacttttttgcagatattctttatcaatttgaaaacattctcttccttttatagtgttctgtttttatcacaaagtggtattaaatttcaccacatgctttttctgtgggaattgatatgatcatgtcatttttctttcttagcctgctaatgtgtatgaaattagataatttaaacttaaaataagtcaacttaaagctgttagagctttaaatcattctgaaccttgagaggtggctctgcagcctgagtcaagtggcatgcagctgcaacttctggcttttttcttgtaaataattaagaagaccaagcagtgccagggacaggaccccctcagatcattaccctttctcacagagtaataaagtaatcttcctttgaatgtagcaatccataaccaatcaaattactgtggcatgtgcactggtcttgcatggaaaatgttgtaatcctgctggaacttctctgtccctgcctatgtaaatgaaacctcaacagcaccaaattgggctgctgatccatttgtgtagagtcagccgtgacgatcctcaagctctgcactaggataaactccacatttaatcgtattctttgaacctcattatttacggttgacatgcggtagattccattgctgattttcaaataaaccctacttgatcatgatgtatacttctctttatacattgctgaattcaatttgctaacattttgttaagaaattttgacatctctgtctatgaaggatgttggtctgcagggtttttcctactattttcatttggggcaatacaacttcaaaaattaaaaaataaatgaatattcttccttcatctgagagtgtcttgatttccctttcatatttgaaagacattttcactagacatagaattctaagttgacagttattttctttcagtatggaaaaaatatgatgccacttttgcctgcctgggaaacattggctttattactactgggcaggggagaaagtcctaattgtctataatgcctcttctggtatcacccctgagtggaggaaaaggtacttctctactgttggtagaggtgaaaatccaggctccccatgtggactcgttaccacccactggatatgagaattctggctctctacttggctttctgtaataccaacctgacaaggaggctggagtggctcattacatcccagtgacgatagtagttttggctcccacttggcctttgctgttggaggtaggagtaggtaggccacacgtttttcaatgtgtgtatgtgtggtgtttagctggagtagtacagatattatctaaaaattttctctatattgctagactgcccctttcccagtccttcacctacagtgagcaggctttcgctgtaacctttccttttgtctgtgccctctgtcagctaagggttactagcttctttagttccagggctgggatagctaaggcaaaaacaacgtctagggaattcactaccatattgtttcttgtgtctccaggtctctagctgatctgacttctctccacctctcagaatatttttagttttgtcttatatacaatattcaggattttttacttgtcctaaatgagaggaagaggaaaaagtacacctttttcctagaagtgaaagtccccttgttttactttttcaaaaaaactaaaatctttctcttgactgttatcacaacagatcctatcaaagaagagaaattaagaccaaaaaaagtgtaactgagggatagtaagagaatattcacagctttacttgagaagaaaaaaggaagggttacaaagtggggaggattagagtcaaaagactcaagttctaatggaaagatggtcagctactagccttgcatctctaaatatcacttaaatattcaggcagccccatattttgttttgttttgttttttcctgtaagatggggatgatatcaccgaggtgcccttccacagttgtggtcgtataagatgagataggaaatgggatggtgctttgtcaattttcagtcaagatataaataaagggcatgttattgcactccgatgataaactccctgcctacttcccacttgctccaacaaaacccagttgtttccagtttgtcctgtgtttcagcattgatccagcaactattgatccatgtgcacaaactagaaatatgggaggcattttggatacctctgactccccctattccccaccagtcaaaataagaatatcacagtcctgatgttctccttccagatagctctcagatccatctgcttcactccatcagccctagatccagcccccattctcttttacctgtactgtaatagtcatctcccaagtttccctgcttccaaactcatctctaaaaagcagctagatcatctttcaagcacccaaagcatctctcccgagtccattctagattcccccggatccctagagttcccatttgggcttcccgtttctcaggagacttatctgttcatttatttaaaaaactgaaacggttttctcttatttatcctaaaataaaattttgacctgaaagtatgattttaaaacactttaatacctttatagtcaacaagtaaataatatttcataataggaaaataattatgtgacatgtcatattggcattgcttcataaggtcaagggaaaagctggacatataaactagagatagtgtgtttcaccatagccttatgtacgtattactaaagaatgaaaacatcagccataacttgcaaatctgcattatgactcatgaaacaagtacactgtatctcgccaagctataattactgactaaacctaaacttctttatcacaaactcattcagcctcatgtgctcaacccatacacataaactctgttctagaaactgcctagttgatcaattctgacccagatctactaggaccatttcatggctagttctagctcccaaaaccttctcctacccttctccagttccttttgacataccccccagtttccctggtgttggttcacctttgcaacagcaagctcataacatgacttagaatctaaaaattgttctgatactctttaacgggttttagcaaaataagtgattaggataaacattgaaaattttacacctaattttaacagttactaatattacttctagttagaggagaaggactacagagtagggagcagggtgtagaagcacagattactcttatttttctgtaaggactgaagttcaaacaataaaaatgcactcatacatttcctcagaaattttaaaaacacacattaaatgctaaatatacatcctgtcaattaaaaactgtaagagtaaccttataaaaggaaaaaaaagtttgctctcgggagatgattaaatacccatattgactaaatatatttaaagtggttatgattcaatgtcagactaatatttttgcctctactttaattgctttttaaaaagaagtatcaggaggttccaattagaaatttaactgaaggccactttgaatcaatatgctgtgggaattaaatgatgctgtttttatgttttcctttttgaagatattggtcattctttttttaaatttttatctctaagagttcaaggaaagcttggtttttattggtaaggcaagaaatgcagcttctgactaaatgtttatatcttcagtgtgggatgcccttctccctttctctcctcctggcatatttaatcaacagaatattcacagatcttttacctcctacaacaggcctactccaaccctgcataatttctcctatcttagggcctctgacatttatcccgaaaaagacaactaaatacttgattctatgttttaccatatttcttttcttcctccacatctcactttttatttttagaaaatgcctctaatgcaatttagtgatcatcacagtgcctaggacattgcttggaactaaataactatttaaaagaaaaaacaaatatggttgattagtataagcaactactttgcagaactttgaaatgtgacttcccatttcaaaggttgtctttcgtattccccagtcttccaacaatcatatttcactgacgtctaacacatatacctgatttgagaatattctgaggctgagctcctttatcaaagttaattggtagaaagtgtcactcaccagaaaattccatctaattgaaaactggactgaaatggctaggctcaaatgggggctgatctaaatttctcatcaagcatcactttaaggtatcttagacaagactgccttgagctgtaaaaagctttgatgccatcagccttacaccaggatcaaaatcaattttcaacttttattgaaagctttgttaataagtttctcccctgttcgtcacagttatgaaaaacctttaatatttttgttgcatgggaataaagctaggaaggatgtaaatttcagacaaattggaggtacattttaaaaatattgtcatcgagactgacaactgccaaacctggaaaccactttctcccacatcaaacacaccctgaagtaatggtgaattcaaattgatatgcaagcctgtgacagaggctatcagaagaaactatttcttttcacctctaaaatacaattcactaagcatgacatccaaattcctattgtcataggcattttcactggtttagaagaagactgcaggacggctaatgtgttttcgttctcagataaggctaatgggtttcagctctcttgccagtttgattgccaaatgctgcctgtgacacagtaaagaattttgaagttgctcatggactttgtggaggagagtaacacagtctatcagcaacatttaccagtatggcaaagcagcattcactaatgaatctgagccctctcccgttgctggacccatggaagaccatttccagagccttcagtgcagctggacagggccacatgaccagttctgtcccacaggctgtgatcagtgttgatgtgtgccgcttcacagcccatatgtgattttctatgcttctcatccctgaagccttgagataaaggtgccataagacagcagtagacaatcgtgctgagccaccccttggaggtgagctgtcctggagcatcacctagaacctccgcaggctttgcaaggatgagaaatactcccagttggttaagccactgtgattttcatattgtttgttattgcattataacccaacccactctgacttctacacacagctctcagatgagggactggagacaggagtgcccagcacttagaggattacagattaatagtaaggaacactggttcctcttacatttaagacacccacaacatcatgatgcatttccctccaatgagatgggaattcttgtacccttgcacagcttgctttcattttgatgactactaattgtgacctgcaccttggctcttgcttgtctcctttattccttctctccttctttacgtagacacacagatgttctagagcatgcctgatatatcacactaatacatttattaagtatccctttgaaaagcaaaatgaaacattacaatttctgtggctcttttaaatgcctgtgaacacactagcacattacatttttaagtatttcagtcaaggggtcacttgggttagcctacattttggcaagtaaatcaacaattgctgccaattgcatcagaaagattcctttacttttagcagatctctaccaggagaaaaggagcaaatgtattggcttattggagcaaatgaccaccacacctcaggaacaaaagcttatactttcacattgcttactagatgccaggaaacactctatgagctttactggtatcaatgaatttaatcctcccaacaaccttagaggtcatggccacatttactcctattttacagatgagacaagtgtgtgagtttacatgcttacaaaaagcacttatcttttatcatcataaaatagagtttttagataaaacataggataagcagttaatctttagataaataataaaacagttttagtatatgtgccatatattgcatgggacatacttattctaaactgttttttacatttatctgaaattcaaattcagctgggtccctgtactcctatttgctaactctgggaactctaaattagaagctggatttaaaatttcatcaattctcagtatctaactttattaagcaaccaagctaagctgattgtacatctctatcaaacaaagttaaagacaagtttttattaaaatctctgaatctaatctactataaaaataaaatgccaagaagatttttactacaaaaatttgcttttgctttcctactacccagtctgtggcaattgagaaggatacagacattgaatgtagattctgtccgttgtcacattttatatctaaattggtgaaaatcctaccactcgtgtctgtaagccattcactttgtttggattgggggctggggtttgcaagaaaacacagaatattcctttttgttctttttttttaaacttttataacatgggacctgttaagacagaagcatgaatattctaggtcaggcagagatgaaaggacataataaataggaaacactgctctcccaatgtatcctgaagaagtccttgtcaatcatttccagtaaagtgaataaaaaatgcttaccatggcaagagcatacactgagtttgatgtagtggggacaaatcataaaataggtgtagggtgaggccaaattttaaaatctaaggtaccttggaataatatacttccagagattctcaataacagcattttaaattcttcttctctcttccaggttctgtttcatgcagggccatgagttactgccaacaagttaatatctactctcggctgttgattcaacccaaacactgtgcatctccaatctccatccatcaagggcttcaaaacaatgtgtttatctttctacttgttgtgaatattaataaattaagatctttaaactgtctaggaagaagtaagaaataactgccaagagcttgggtacagatgaggtatttacatacattagagaagtaccattaacagtaagtaatggtgcttttacattctcagaatgcagtgcaatagactgtcgatttgttttgaaggtgtctgcagtcataacacgtatctcatgctaaatggatacttagcaatttttaataattttaaactgatgtgctatttaatggtttggtgataacgcacagttttatgaagacggtttttgaatttggaatttttattgaacttgattaaatttaatgagactgcatcacttacattctaccttaattcttaatgtttataaaggtcacaacaactaattttaaaagttgtattttagaaaagcaaattctgtcagttaatgactatacaatttaaaccataattccaagattttctaaagctagcctacatgtagtactgtggtatgtcttcatgaggggtattaaagcgtaaaagtctaagacatatcactgttgtgaaggaaaacaaataggagaattttattaactccagattcttttgactttgtctgacttttgattagaactagagtacgcaaaactcagcagactatggtaaagaggatttacgtcaactcaacttcccaagaagttaaaattaaaaacatatctcccctaagtcaatacatcccgcattatttcactggtgactttagtcccaatttgtttgaggaaactaaaggtaaaagagaaaacaaatttgctttgaaggagtcaaggctatgtggaatagaaatctctgcaaaaatacttaacccagtctgtagcctttccatgaagcaaagaaaacgtaaaacagattttggggcattctgacacgaattactaagatatcacttatatgcctgtttttagactgagaggctcctcaattcctttttctttctgtctgcgtcatttccatcaggaacaactgttcaacccttacttgtagatcttcataatgattcttgacaatacacgtgcaaaattaaaatgggtctctttgcactgcttgcagtatggcaagagagtttacaaggcaataattctaaatataaaataaaaaacaaacacattacatgattttacaaatttaagggaatgtgtagaaggagtactaatcacacttggcatgtttaaaaatacacttggtgctcgtcagtgctcaaagagtacagtcatatcgtttgaattatcaataataataaaatcatggaggattgatcgtgagagtgttttccttcatcttagccacagtaataagacctctatgctgcacttcttttataattaggcaaaaatctgacagaaatcctgtgaaggcagaggtagttatttctgtgtattctttagacttccacattaagaaaaccatgcccccttttgacatgactatctctttcttccccacacaacaaaactgagaacataaaattatggacacaactgggcagctaaatgcagacacgctgactgcaataaggctctcatctcacagaggaggaggcagtacagcactctgtctccagtaaaacatctcctcaaaaacttcaaactttcttaacatctacagagaagtcttaacagaaaagtcagtaaattcgcctgccacacaccatcttgtcatttgacctttgatttctatagttcagcactccctaattccaatagacaagattcaaagaaatgtctgtaatacttcatctgcccgaaggaagacagtgagataatatccacacaagtcttgaacttttaaaatccattctcactgatacaggggaatatgaactggaagaaggattgaatgccatgcttgagtttttaccatcaaataaaatcttcagtgtgttgtttgacaatgatatttactttgagtgtgttttaaaaaatgacacctgctacaaatatcatggatctgtatatccttgatgtctcacaggtcataaaacagcaagggcaaatattttatgagctacattgcattgttgttttgttcccaggaaaagaggtattttctcaaatactaagagaccagtctattcctggggtcagctgaagccagtgttgaccctggacaaacactgggagagagctgtttccctactatgatgatccctggagctcagatgctgtctgtgcccagaccctcaaggcaaccatggccaaggtagagaaggtgaggacactgctctgagacacatgtggttcggcacacacgtgtactgtgataattgttgctaatgatgctgacagtagccaacatttaccaagggatcactatgcagtgagcactgtgcacagtgccttatgtgctgactcactgaatcctcataatgtcatttggaggtaagtactatcagcaacactacttcgcagataagaggaaaacaacggacagtaatcgtgctgcacagcagcaatcttgggagttgaacttgataaatccatgcatttattaagctcaagtcacccatataaggagtcagacttcagtcagtctcagctccacctttactataaccttggccaagttacttaacctcacaaagcctcagtttcttcatttgtcacatatggatgacagtattacttgccttacagaaaagtcatctcaaacttggaaagaggcgattgagcttactgcattccttcagtgtagagttcccactattgggcctgactttctgtttacagggttaactgacaactctcaggagagggaataattagtatgggctgttacagaccaggaggacatcatcctttctgtatctaacccaacactctaccaaattgcacgtataggtataggtataggtgtatgtgtatatatatatatatatatatatatatatatatgcctctcaaatgctctttggactgactttaacgttacattgggtccccccccaacaattagtgagctgaacaaaatcttgatgtgttcattttatatttgcatgagagcatgaatttgcctttctgccaactgtctgaacacaacattgttttaagaattgagataatgcatatgaaatgttcagcataggacctgggttaccgatgattcactaaatgtcatctatcacatcactcctataatcatctctataactgatcaccaaaagtatactatttaaaacttttaatgtgaggaatggttgtttctatttactcatattcaaatacaaacagagagtatttaatcactaactgtgagaatagctctgaaattatatactgttatccacagctggggccactttaaaatctggcctagagagtgattatctcacacatcacacacccagtacgaaaatggagtttttaagatatccactttctaggctgcttggagccttagtgccgtcacctctggtaaacaggattcattagagtgataattgacagttgtttccctttctaagtgattgctctgtagttccattatgttctgtcagggaagtgctagcaattaattaccaataaactaaacaccagctctgcttgcagcggaaggtttggaaccatttatcttgggggttgagggaggtgtttgggagaggggaaaatccacctcaccaaatacataaagtgctgtgtaaaaaccttattacaagggtgggtggggatggttagaggctctgggaggacaagagacccccatttccacttctgacactttggtatattaaaagaaaaaaacctcaaaccagtggtccaaaaagtatggtccattttaacataggctactttgaacactaaaaaaaatacactgcagaatgattatgacagtcccaagatgacgacaaaactttttgtttaagccaaaagcatagcaaggaaatactcaagtggtgtgacagaggactttttaccttctattaaagattttctgtgcattccttctactggaaataatatataaactccaaattgaggctttttgtgaaaccctgagatccaagggtttgagcttcctctcctcagtaagccaacagactctgaggtcagattcttctgcaaaccatctgagatcctataccatagttgcttgcttcctttcctgtttaactttttttttcaatatagaaccatgtggtggctttttatatagatcctggggatacatcctcgcagctctccaacttcctctatcagctcaagtcgctcccacagccacaatggtctctgggttccctagattctcactacatattacttactataatttttaaaatatacttaatcacacgtgctttcagtccacttcacattcgagtgtctcatttcataagactgtagctccttgaggacaaggacacgtcttcacagggtaattaacaattactgagcacctgcctgctgtctggaatcaggtcatgcaggcagagcaggcaggcaagaaagcaagtaaacaaaggcaacctttatttacttctcccacatttctctgccgtgggaaaggcaagtcaaagctgaaagaaaaaccaaaatggatttcatggatttcaggtctccacagagcccatgacctgttatttgaaggcttttgacccaccagtatgtccaaacatctgttgacatctgcctctctgttctgtggtgtttttcaagggatgctaggtgttcttcaaggtcaaaagggaatggtgctctcttaaagaaactggtgctgaaaagaataagggtttagttacctggggcaagaagtagaacaagaattgggtggaggtcaagaaaagcctaaggccaagtgagaaagaccaacagaagcaaaggagacagacaatcaatgataaatttcccccaccctaggcctaggggtcagtactgataaaagaggaacagaccaaaaaggcacaggtgcaggaggtgaccagtccaagcctctccagttggcttctgagagagctaacagctactggggaaaactggagcctccagtccaacctaacctggccttaaaaggcacaacccccaagacaaaagcactctacgtattcctgaaacacacaaggacacagattagaggaaagaaagaaaacaaagggctcatttacaaatgaaatttgtaattgaaattattttgaaatttatttcaaacttatctacatggtccaagaattagatgagtacaggggacaactgtgtatgccccagattcactggttattatatttttccccatctgcctatcatttgtgcactttcttgcttgctttctctctgtatacacactattttttcctgcttcctttgaaaataaattgcatttagcgcatacttcttaaaactaaaactaaagatattcttttccaccccagtacagttactaatttcagtaaatggagcattggtacaatattatatccagtccactgtcttctgtttctcaattttgtcaattaacccaacgtcatcccttttggcatcttcccctctttaatataaaatccagtataggatcttatttagtgttcctaactcttaagtctcctttaacctcaaacattactttgtctttctgttttcttttttaacagtacacctccatgccccaaacccctctaccccaacgtgtgtgtgtgtgtgtgtgtttcattttgtttaaatagaactattcctcatttgggggttctctgctgtgtccttgagtttagattcaggttgtatattctggacccaagtaccatattggttatgcttctcagggtactgcatcaggagacacacacatatctctttgctcatgaatggtgatgtgaattctgatcacaggtcaagatgttgtctggtttcttcactatatggctactgtgtttttccaaacacaagactgcttaatattctgagtgtatattaggcaggcaaagaatctagctcattatattttagttatacactaacaaagtacgcacatttataaaagcttacagttgtattttgtttgtctaaaataatgacacattaggaccaatgcataattgctcactctgtgttgtctaccattctgagctataagcttttattatgcaaaggctgtggtttgtgagctatcatttgtatgggctccttcaggccctctcaataaaatgacacatacaacaaccaataaacatgcccttttcttaaacatggtcggggtggactttcacatttcatagagcatctcagggctgttcaagctaacagatatttgaaatcaattagtccaacccacacatttttacagttgagaaaatcaagacctaaggaagaaaaaaacgacttgcctaaggtaatacagtataatagttctttataaactgaattataaaatcaatttagtgggccgtgaccagcatgttttaaactgaaatacaatttttaaaaaaatctgagtacttagcatacagcaagggtaaacactgtttggtgaaacctttaattatatatgtgtaggagtatagatgctctcctgtactaatgggataaaaaaatcttttttttaagatgggggtagcccaggctggagtgcagtggcatggtcatagctcactataacctcaaacacctgggctcaagcaatcctcctgccttagcctcctgagtaactagaattataggcatacaccatcatgcctggctgattttttttaaaaatttttttgtacagacaaggtctcactatgttgcctaggctggtctcgaactcctgagcacaagtgatcctccttgccttggccccccaaagtgccaggaccttagccatgagccacctcacccagccacaaaatgtatttcttactgaattctgtggttaaaatcctttaaagaactccattagaactaacccaaaaccagtggtcattctaccaggaaagtgtttttgcaaagtttagtgtgaaaacaaataaaggttgaaatgcagcttctgatttaacagttctggtatggacctgagattctgcatttccaataggttcctaggggagatctaagctgctcctgccagcctatcaactacctttgagaagtatgattaaaaaacactgcatctgagggaggacctactttatttttaacaacgcctccctgaagtaggtactatgtatatacatacgtatatacacacacacaatttttttgctaacaatttgaataggaacaactaattcttgaaaatgtttaaaaataacaaaacaaaaccttccacaaagaatcacctcaattcactacagagaaaatgtgctaattgtgatggtaataagagcgctggtatttactggtgttcacaatgacacgcatgagaccgagtgcatccataacccagttgattcaggttgatatgatttcccccagattacagatgaagaaacagacccaaattagtttattttctccaaggtcatcttgcttgagagtggagggacacagattagcatccagccaattaattcctaaggccatactcctatcatactcactgactcacagatgtatgttatccacacacctatgcacatgctctaaacattacatatgatataaatacatatttagatacgtgcattagcaccttggcatacacttttataaacactctacaatattcaggagtcagggatcacaagaggaaactaatatgtaaaaacccagttctctaaaattaggtgccttctcaagtaggtcaagcaaccgcatttatattgtctacattaaagggatctcttgaaaacagtcacattagcagaatacaggggctgagtgagcaggctggcaggggaggagtgtgagcaggctaacgactagagctacaaacaagattccatcacctataacttagatttcatgtggtatatttagttcaaaccctgtcactttatacaaataggttgtcacgtaaagtgcaaacaactctcttttgacaaagtgatactgctgtggtgctgggttgatggctttatattccacaaagctttttaagtgacaaatgatagctgagtcttgaaaatatggtgatatgaaatgactgcataaatcctttcaggcttcccggggggagcaaaagcatagcattttgcacattaattaaaaaagaaaatctgagaggatgaggttagatctttctaatcttgactctgtgcaaacggactttgaagttactggcacaaaattgagagatggccccagaaaagtcttcaaatgagatgtacaatgttgtttaaagatcaggctcaagtgctgctcttggcccaaatgaggccaggcaagggtgcaataattatctctgctagagactgttggtgcactggcgttgaaatcttttgatatgttggataatgcagattttgtgtgcacacattgctttcccaagctgtctacatcagtgtcatgttcaaatgaagccgaatagtttaaaaggctcgctttcacactggctttatttagcttgcataaacattttcccttcaatctcatataaagtcttgctgcgtaaatgcagctgtcctgctcttgtgtcttaatacagatctttacaaagaggcctgttgggcaacatatttctggtagatgattaataagagatataggatttcttttaaaaaaaatcatgctctgactacagagggcaaattcattacccataaatcaaaaggagtaagggatttcagtagtatcagaagccttatctggcttcaatctgacagttaactgtaggccgtgaatgattaaataaaagtctaagttcacccgagcctggataaaataaaactcaaagcccagaaacttcaaataaaataagaaaaaatcataatttttcacctcaaaaggaaactgagaagagaagtatgatgtgacagaaactatgatttcaaatggagggtttcttttgttgtttgtttttcagaactagactcacattttacaaaaggctccctacccataaggaagaaagttttgagagtaatgaggttgatctgaactgttaaaaactttctaactgagatatagcaacatatggtgtggcagaataaaaatggccacaaaatctttaacattccttccatccagaagtgaggggtctatgttccttctccctgagtaaggtggggccactgagtattttcactaagagaattcagcagaggctgggtgcggtggctcatgcctgtaatcccagcactttaggaggccaatgcagcaggatcactcgagtcccaagttcaagaatagcctgggcaacacagtgagagcctgtctctattttaaaatttaaaataataataataaaagaattcagcagaacttactatgcccaggcctcaagaaactggcatttctcttcaaacactagctttcaaatcctgaattgctctaagataagaagtctgccaccctgaggctaccatattatgaggaagcccaagacagcatgtggcgagagaaagggaaagatgcccacccaacctccagctatctgagtcatcccagctgaggctccagacattaatgaactgcagtaagctattcatcctaatgccctgtgggaatctctcacccacaaccttgggagacataataataataaattgtcttcagctattgtgttatggagtagtttgttacacagcaacagatagccagaacatacaataaaatgggctaatcttaagtgtatagctctgctcttttgcatatgtatacacacgagtaaccaccacctaggtcataagacatgtttccagaagcctctctctgaccctacccagacatttccctcaataaacatccccatcctacccccacacaaataagaaaccagtatcctagcttctattatgatagacaagttttgtcagttcttgaatttcatgtgtaggaaatcacatagaaggtacgctctagcatccagcttcttccgttcaacatactatctgtgaaattcatcactgctgctgcacagggcagtagatggtatgttttcattgctctgaagtgttgcattttgtaagtatactacaattatccattctgctgctgctgatggatatttggttgcttccagtttggggcttttatgaataaagctgttatgaacattctcatacatcttcctggtggacaaatgcactcatttctcttgggtatatacctagaagtaaagttgctggatcgcagggcagtgcactcatttggtaaagtattagttcatattccaactactcaaagaattgctcatctgggccacgttatcattgttttctcccctataactagcaaatattgaggcaaaatcatgctgcattaaattaagcaatttatgatttgtccttccatattgacctttcctgactaactacacaatagtattgttctcaatgatgtctactgtcatgaacatgacattgttcttggaaaaatcctatcaggcaaagtcaacctctaaaatagcattgtaataaatatgcagaaatgtcactttttgcattagcccaaaggttttgtatagcttaaggatacatgcagtaagctaactataaaaatagaaacttgacagtggggatgtatgtgtgtgtcaaaataatattactctttctgggtgtatggcagaaaaaatgacactacatccaccagcatgatttttatagatctgcctctttgccagatgtcaccttttataaactgctttataaaaacatgacagtataagtgcaatagtgtgtttattgcttgataaactttagtaataaacttaggataggttgaaaattaaagccttagagcctattcattaagcatttaggacaagtgagtaagcaaaaaatgcaaactattaaatcctaaatgtatgcagatcaagccactagcagcaagcactatttctcaatcagtatgtcttatggaaatatctgccagtttccttgtcattgagctaaatgcattacagccacatctaaagcatgccatttgcattgctacaaatttgaatgaaatccagaatgttacaactgccacaggctcactcaaaacagattaagtctttttcaaaactgttctgtaacttagcacagcatattttacatatggcaaaccatggttccaacaactacttttctgaaaagacttgaaaagactttaaggaatttcttaaaataatttcatagcacacactcaatattttgattactgatggattatacacagcaatgtagtgtggtctgaggactttggattacctgcagagcttgttaaatagagcgatcctgtagtcctttcctaatcgattgaaataaaatctctggaacaagggacccaagaactaggattttattaagtaattccaaatgatccttattcacaataaaatgtgttaaccatagctatacagtaatctaataaaaagaaactttacaggaaagtatattggcccagaagggtgtcattttaagtgaataatgtattcttacattcttaggttcaaactgttactcaacattatatttttaaaaattcaaatggcttatattagttcatattccttttttttcttgtagttatgtatgaacacccacaaaataaaatctacttaagaacttttgaaaatcaatccctataacaagtgcatatataactaaattttcctgatgattctattcatcctggactgacaattgttatctttgtaattgataaatgaaaaaagcagtaaaataaaacaatccctttaccaaatggtctattagaattcctctgatgctcatcacatttttccactgcttactattcacccccagatctcataaaatatttcagtagttaactacagcaaagctactaacatgcagtttgtgttgggtggatcctcacaaaagtgatgctaatatattggaaatatatatacatatatcattatatataattatatatatcattatataatcatataatatgtaattatatatgtgtgtgtgtgtgtgtgtatatatatatatatataatattttccccattaacaaatcagtgtgccaacatgacaacaagtaggagagactgtcaaagcttcacagttgctacagaactctagtactgggaagtactagttcaaaattccattctgggcaagtttttcttctttttttttttttttattttgagacagggtctcactctgttgctgaggctgtagtacagtggtgcagtctttgctcactgcaacctccacctcctaggttcaagtaattctcctgccttagcctccctagtagctgggactacaggtgcatgtcaccacacccagacaatttttatattttttggtagaaacggggttttgccatgttggccaggctggtctcaaacccctcacctcaagtgatccacctgcctcggcctcccaaagtgctgggattacaggcatgagccaccatgccccgccccattctgggcatcttaaacaaaagcaaaaacaaaaaaccctgaacacatcatggtataatgcagtgataaagcaatgtagggcttttctggacattaaaatgtttgaaaataagcaccaagaaaaaaatcacattaaggagcaaaaattacagtaactgcttgcctttttctttggacatcaaaagaaagaactaacaaaaggaaagtcttgctcgatttctgatcattttatttatcttattgtgaaagaaacaacactgaatcaagagtgaaatagaaatcaaccaaatgaaatgacagcaaaagttgcaaagaaaggcatctggggggtgaaaaaataaatgttccttcacagaaagaaaccagttgtttaaaaacaaaacagaacaaaacaaaaacttacaaaaacacagaaataggtcaagcaaattctacccaaatccctcttcctttgggccttgtcacaacaagtaaacctcatcagaggggtcaagaccacaatgactgacatcctgatcatgtgatgtgatggacagagaacttgactccgagtcagcagaatcgtatagtccagtttgacttcaatactcattaattcaccttttaaaagtttctgactctctgcattcatttttgattgctgctgtaacaagttatcacaaactgagtggttaaaaataatacaaatatattatcttacagttctggaagccagaagtacaaaatcagtttcactgagctaaagtcaagttgttggcaggctgattctttctagagattcggaaggaagaatggatttccatcttttccagcttctagtggctgcctatactccttggtttgtagttctttccctcatctccaaagtgcatcctccagtttccgcctctgttgtcacatggcctgctctctgattctgaccttcctcctgccttcctcttcttacaaagacactatgactaccctgcacccacccactttatccaggataacttccccatcttaagattcttaacctgatcacatctgcaaagtcccttttgccacataaggtaacattcacaggtaccaggaattaggacatggacatacttgggggccatcactcagcctaccataatctctttggattttcttcttaatactagttcattctttgttcatttactcatccacccacccactcacccatcaccctcactctacaggagttggccacagcttcccgactagtatggcagaacaaaacggtgtgttgtaaaccttcaaaggatctgctgacaagttctgatcaatatgtataattgatttttgctgcaacagagtacacattctgacagggtgatgtttttaagggaaaaaaaaaaaacaacgaacagagtagatgatggaacggtatatagattgggataactgactgccagtaaaagggcagagacattgattcacattaaggtgggaccaaagaaatgtatcaggttttctggaatgtgcagaactgtgtttacaggaagatacagaaatttgtctcatgagcacatagaagtccgtgaccagaacagcaaacagcccaactcaaacagcagcacagccacaatgaaaccgcacaaataaagtgatcaccgtggaagcttccagagacactgaggggggctgtttctccccagcagtggttgcactgtaattaccatagttcgtttggggttgccgacttttggtcttttcatgccaggatggactcctggttctgagggtagaatcatctttctttaatttcatgggaaggggtagggtaggtgcctacacaaaacagggttttatcaggaagaaaaacaggaaaacgacctaagaggatgcacaatagcagctctcacaaaaccgcagtcactgggggctctttcagtacctcaatttaaagcgctccgtaggatgacaacttatatcttaatttctcccacacaaaatccctctaaggtgagtttctttaggcaccatccagaccacattttaagttacaccatttaaaataaactttttaaattcagagaaaactatccaagtacgttgacactcttacgttgtttatgtataaaaacaattacaacgttaagcttcctcttcatttcaaatttgtttattcttacataagcttctagacaaaagcatactctctgaaggaaaactggggcagatgggggtggcgcaggatagcggcagcgttattgtgactaggtggtggttaagaaaatattttcaagacaacaacctgaaaatcaggcttaagtgccagaagtaaaccaaaaagaagcaatagcaagtgacaaaaatggctaactggagaggaaaaaaaataggatttcaattaaatcataaacgatggctaataaagtgcgttttaacagctgtaacgctaaacataatgcatcttactctgttttaattcaaatattaatccttgtccaatcactgtaatgggagaaaaatggtatgctctgaatgtcacattcgaattgggtagcaattatcttcctggtatcaatgtcagacattcacataaatctttaaaaaatgataaacttacccaaaaacatccaatcaaataaaatgaaaagatttctataaaacttgtgctataatttatttaaaattacaagtaacataagaaagatggataattacaattagggagatataaatttgaaatggaggaacatattaatattttaatctttctgataattctttaaaattacctaatatttttatatcagcaaatattgcctcaaggactcaattgaaacccaaatcgtaatgatcactatttaactaatttattaaataaaacatgttcaattgtacactaaatcaaatgacatggccatcataatggcagagctacaaattttaatgagactgaagaaaacagtaaaaggtctttgaacctgttatccatgtgatcacagataccgaaaacatgcttgtttctctcctttgtggaggctcagggactccccaactctaagcaacagttataataatatttactacgtgcttcccaccctgcgaagaatggacaggcagtatctcattacattctgacagcaggccaggtacagtggctcatgcctgcaattccagtactctgggaggctggggcaggcagatcacttgagctcaggagttcaagatcagcctgggcaacatggtgaatccccatctctaaaatacaaaaaatagccaggcgtggtggcatacacctgtagtctcagctactcagtaggctgagacaggagtattgtttgaactccggaggtcaagtctgcagagagccacaactgcaccactgtactccagcctggtgacagatcaagactaggtctcaaaaaaccaaaaaaaattcttatagccacctaaaaggttatcttcacttaagagatgcataatcaggcattgaggggttacaaaacttgcacaagatcccagaactaaggggcagaggaactccaaagcctgtaggagaactgctgaaatctgaggatctcctctctctgtatatatttaaaatatgatttctgtctcagtctattgaagctgctctatcaaaatgccttaaattgggtgatgtataaataatagaaatttatttttcacagttctggaggctgagaagcccaagatgaaggtgctggcagcttcagagcctggtgagggcttgctctctgctttaagatggcgccttcttgaagcatcttcagtggtagaaggggcaaggaagctccctccaacctcctttaagagggtgctaatcccattcatgagggcagagccctcgtgacttaatcacttcccagaaggtcctacctcttaatagaatcatgttgggtattaggttccaacatataacttttggaagaacacaaacattcagaccttagcaatattcatccatgcttctcaactctcattttacagcagaatttcccatggaattttcaagaaacacatttgtccaggtacagcccatagaaataccgtgggcccaacagcttattttcattatgcttttctgggcaattatgatgcctgctcaatgtgtggaactcctgctctgtgtatttcaggagatcctggagtatattagcactaaaatgtctctttttctaatagtagtacatcacattggttttataaatacttataatacatgacatactacaatgtgaaggtggttttgcatgtgtcatcacatgtgacatcccattaacttaccaagagtcacagggaaagacttgttattatacccaattacagtttgagtcaataggcacaaatgaattatcaactttttgaccttggaggccatctccaactttatattacataatccttttgctttattaacaagaagtctaaggtccagagagattcactgacttttacaggttcacccagttggtaaataagggcaccggacaagaaaaacaagaattcagctcccacaactgatatgatgtgttatttgtaacacctcacccagaatgtctccagccacctttctttgaaacctgcacttgcactgttaaactgggaaaagattaataagtacaatcgtatgatcacatgggtagtcacaacactgtaatctgagaaataatcattatagatgataaagaaagaggtagaggaggaagtactatttttgtgcccttgattatcacattacaaagacagaaactgcgacgactataaaagatgatcagaggaaatgatatcccaaatttgaaccgtctgaattatgaaaaaaatacaatgtttaactagaatgttccctaaacatgtcacactttgaataaaaggagcagaaggactgtatagaagactggcaacaaagacatacaggaaatgtaagattcactatttaggtatgagtttagatttttttgtatggaagtagagcattctccccaccctttctcctacttccaacttcctgcaaaaatcctacacagaggcaaaatatataaaatgtcttaaaaccaaattgttaaggccctgtctcctcctactggggcccaaagtacctcctccctcaaggggacgcagggctcccaggacaccaccgggaatcactgtttcacattcatgaaatacgtagtcagtgatgatatctacataacgtcaagcgtctaagtgcttgactaaattttcccattattttcactttgccaactacatggataataaagaaaaaaatgagaattttaaagctaaaagactcctactggccaattttgagtacttcctgaggatgagacactttccacataagccggttagagagatctcagtgagccagtgtcccaacagaacatggaaaatgaagcccagggaggtcatacaacctggtatatggtacaacatcgccctgcaggctggaaacaaggccaggtcacactgaggtttccagactccacagggagaggaggaaatcctagggagcagatccccatctgtgttgatcttcatgattttgctcacatccctgtgcctcctgtactatcattccggtctgtcttctttacatctgctcagttcctccttaaattactttgacttaaatggaaacattctatctgtaccataaatggaaaaccagtatcacttgccacagatagacagctaaccctgttaaccttgaaacaaaaggatattaaactgtagccggaagggatccctgcctgaggctctgagcctggggcctgcccacgctttgttataaggaagattagcaaatactagaaaggtgagaaagcttccccctggctaatgagaagggttgaaagaaatgaaagggaataacttcccaagcttgccagaaacaccaaggtagggcagttttttttaaccctgctttgaggtctagaatcctttgttgaaatgaaatcttattaacaatagaagcaataatgatgatgctgataagaaacagctggttgtattaggatacaccaggcattcaaatacaagtaaactcagtacttagaagtattaactcatttactcctcattaacaaacttgtgagacacagaaaggtcaagtaatgggccccaaatctctctgctagtaacagccaaaaccctggtcctataaccccagagtccctgtttttaatgaccacccagactgcccctcaagattccagttactaaggccgggcgcgatggctcacgcctgtaatcccagaactttggaggctgaggctggtgaatcatgaggtcaggagatggagaccatcctggctaacatggtgaaaccctgtctctactaaaaatacaaaaaaattagccgggcgtggtggcgggtgcctatagtcccagctgctcgggatgctgaggcagaagaatggcctgaacccaggaggcggagcttgcagtgagccaagatcgccaagcctgggtgacagagcgagactccatcagaaaaaaaaaaaaaagaattccagttactagcaactgacaatagagttgtggttgaaaagggattaaggagctaaagtgttatgctaagcatggttatgaacaaaaggcagaaaaagaacaaatgcgtccactatatggcttgatttgattacttgaaaattattcatttgttttactctttagctctttgcttcctttaaggtaatcacttttaaccctcttctcatattacttggctgatgatataccttggtgtactgttttctttatttgaacaaatatggttactgtgccagtaccttcaacagattcaaatctttttaagggtaaaaaggcttttctatttttcttagactacaaataatgactaaagtaattcaatgataatgagcattctagatatttctgaaggtttctgaaggtcacacaaaggtgactgtttctactgtgctaatatatccctggaattttcattcttaatattttccaaagagcaggtcaacacttcacagcaaaaaaacagagtgaaagagaaaacaatttttttcatattattcatatatgtttttaatagatgattaaagaagaaaaacataccctggaaatgtagaaatatgaagccatgctacatatttttataattatgttttattgcgttctgttaactggccagagggtttttaaaatgccaaaagattccaaattaaattaccattattaagccccttaagcctcatattgagtttagactgtcactaaaaacttttgataaattaaataatatgcagtatgagtattagagtttgaaatgtttaaaagtttctttacacatctgtcagcataacctaagacataaaatggcttacatacatttttttcaatgatagtgttttgttttcaatttgttttttagaaatgtaattaatgaaagctacagagcaataatctagcatctagaaatgccttcagagttgggtttttaaactcttctctaaatttattctgttgctaaaaatacattcattacatttttaatctaacaggttttagtgaataaaacaatgatgtagatataaagctaaatttctacagtacaagacatttcaaacatcataaaccaaggcaaaagaggatttacaatacagagtcaaactacaatggacacttcagaataaaattcagtcagtgtcctctgccctgccagcagggcatttactgtagtggagaggaccaggaaggagattcgctttataggataatcatgttatgttatgcttttattgaatgcacttacattttggactacacaattgttcttgaaatgtttccaaatgtgtgtaatcatgaccgacgtgatggcagggatctacttaatttccgcattcaaaggggaacatgatgcaaatactatcaagcgagggcacttcctgtcatataacacagaagagataagaacttgaccatgagctggcaataaattcatcaacatcctaaaccagcagtcagtccccaacctttctggtaccagaaactggtttcatggaagacaatttttccacagatgggggtggagtggggctggcaggggggtggtgatggtttcaggatgattcaagtgcattacatttattgtgcattttatttatattattattacattgtaatatataatgaaataattctacaactcaccataatgtagaatcaatgggagtcctgagcttgtattcttgtgactagctggtcccatctgggggtgatgggagacagtgacagatcatcaggcattaggttctcataaggagcgggcaacctagatccctcccatgtgcaattcacaatagggttcacattcctatgagaatctaatcctgccgctaatctcacaggaggcagagctcaggcagtaatgggagtgatgggggagcggctgtaaagacagatgaagctttgctcaattgcccactgctcacttgttgctgtgtggccaggttcctaacaggccatggactggtccatgacgcaggggctggggacccctgtcctaaaccatgtttgcttctgccccctcaccctttcccagagtgaatggtaattactgtgtacgatatttaaaaaatggacgatgtccccttaacagtattttctgcctgagtccagagctactagtagtagtgactgctgactaaaggatgaagctggagtaaaacctttcctgtgctgtgacccacatctccccattgctgaagaagagaaatgtaaaaatgctttctggaagaagaatttcacaaggttatgttttccctcagctttccatgatcacagtaatcgaaaaataacactcttagtttacagatttcaatttggcagtatctggcaatgttaattatataaatgagaagagagagataagaggtgggaaacaggaagtgaatgccaggaaaatgaggatccaggtctcctcctcatggaggtcgtccccaggcttcctgcaccagtgacagcacctgccaaccacaacatttcctaggcttcttccctgatttattttctccctagagcttacccctctataacacagtctatgtttcatattccatcttcttcatcagcttctttatcccccacaacaaaatgtgctccaccagggaaggggtttgaagttgttttgttcactgctgtgtccccaggactggatgacagaggatgcccaccttatttaccaatatattcccagcatctagtccaagggtctgtcacccttttcagtaaagtgtcagagattagctattttaggctttgcaagccatacaatctctgctgtgcagctacttagctctgacaccgtagagcaaaaacagccatagccaataaatatataaataaacgggcatggctatgttctaacaaaacattatttacaaaaacagccagaggaccagatgtggcccagagctatagttgccaactccattgtagaccatgtcttgcatatggtgtgtgctaaatatttaatattatgaatgaatgtgataactccaaaccagccaaccctcctatttatcattccagaacaaagaagactctcataaaagacaaccactaccagatgttttaaggtaacaggtattaaaagcagaatgggtaagtaaaacatagagtttgtcctcagtgactggagatggtctctgctgtcctgactaaatgacctatattagggtcccagtgggaacctaattcaattcagatggttcaaatgaagagactctaataaaaggcttattaatggaggggctggcaggcgaaggaaacaagaagggaggtggaggcactcagacaagagcaagagcaggaggtcatggcatccctcaaagggcaaggggaggccacagtgatcccagagccctgtgagagctaaaacatggaggaaggactatcaatgtcaaatgtaatgctcactcaatcagggaagaagcaagaaagagaaccccaacttccttctgctccagtcctctgattttcagcctagccaccatgcttgtcaatcccagatccaatccaactgtaagggagcacaggcaatgtagtctattggaaaagttggaaagggcaggcactgaacacagagtaaggcaggaatgagcagagacagggatctagatgagagtggcagactgagcaactaacacatggatcaattaagatcaaaacaaaatcattgtattagttcattttcatactgctatgaagaaacacctgagaatgggtactttataagaaaaagaggtttaatggactcacacttccacatggctggagaggccttacaatcatggaggaaggcgaaggaagagtaaaggcatgtctgacatgacagcaagcaagagagcgtgtgctcgggaactgccctttataaaaccattggatcttgtgagacttactaactaacaggagaacagcataggaaaaacctgcccccatgattcaattacctcccaccaggtccctctcactacacctggggattatgggaattacaggatagatttgggggggacacagccaaaccatatcaatcatcctactgagtacagaaatgaaaacttcagattccatacacttgacatagattacataaaagaccaccaataataagattgtgccccacctgtatacaatgagctgttccaagccaaaaatgtgtcttgattaatgctgtggtctttaccaggagcagttttcccacccaggtcacagtcttcacaaattggaagcagcattacctctagagtaagcaataaatgaaaatggtgcctttaatttcaaattataaggtaacacactgatggataaccatagcatgattagtcgattcaggacctcaatacacaatagaagaatccatccattatctgctcaaagtaattctttcatcccagcaactttaacaacaacccaggaaaattactgtcccttagcaaagccttttgaatttcatatggatttaattagttaactgccatctcaaggatgagaaccatgacaaatagttgttcttttcaaattagaagaatagactgttcaatgagcaatattgatgtttcccctcacctatttatacaagagattttctacttttttttttctaatttagctaaccattttaacatttatcgaagcttttgtgatcactgttctctagctgagtgttctagccattagccattagctttaaaaaacagctgaaagcagcctccctgtgtacagaaaataccgtgttcctcactagagacccctggcaatctgaaccactactagaggattctaacaagacattctttaccagtggacagaaaagcaaatagagaatattgttcaatgaacaatgcaactactaatcataacagtgctgtatcttaacctgtagtcatgaacctaacccagctgcttgaggcaagcagacccctctttctttttaactgtggaacaatctatagcatgggaaatgggttaagatttggaaaagaagttaggtgagtaactagcagcagaaagccaagcaccgtaagactctacctattccatctgcattcctgccttttctcaaaaagatctcaaagcagaaagaagcaatcagaacaaagccagtcagctctggtagcttgctcttacctctattctagctacatgtcacctcctgtgagaccctctgcccctccagacagtttaagaaacttctcagaagactagacacacactttgtggctactagtgaacaatttatatgtgtgtttatatttctacagaactttgaaaaagacttgcatctatatggtaagtaaatgctcctgatgtagaaaaaagacaaacaggaaagacaaaaccattttatttggtatcatcaaattaaaaattaattgccccatatgttcaaataataacttatagccgattgtggtaatccaacatattggatgttggctttcatgatctcaccaatacatttagcaaatggctgtggaatctggcaataaaatatttccagtctctaagtcttcttgataattcactctgtgttttacaaacaactgggctcccgggattctaagcacatcactcagactgacagagcaagtattccagacaattggttcctggagggtcaagacagcaatgctcgatcaggattcaaacgggtcataaacccttcatggatctctctcaagtgggtggtgatgtctccctagggctgctcatcatttgctgctacagtcaagcacttgtcattatagacaaacaccccatcagtcttaggtcctcatccagcagagtcttactgccaccggtggagacaaccaccggtataaagaaatccaaacaaaaattcggcatgtgtgcccatccaggcatgactgttcactgtgcatttcacttctacgtctgcactttcagcatggccacgaaactcagcacctgtttatctgccatgatttcaggcatccagattgttctggaaccatatatatcaaaagctctaaaacaccaaacccgtttctagaaatttatcctaaggaaataattggacaaatgcctaaaagatgtatgtacaaggtggttccctgctgtgttctttacagaagtgaaagactggaaatgcatcaatctcagtttggttgtctacagaacgggattgcaaaatctgatttacacgtgttacaattacatcttgtcacctaatgccaggagcagactatatatggctttaagctaaaggaacatcaaagtcatgagtgccttggaaaacagagacaggagtgtgcatattttaaagcagaagctcccaaccacagtcttgttcacatccctcagttctttgaaaggcagccagacctccatttctaagggacaaatgtgaccacaacctctcccttttcaagattcttccaaggcttcctcctgtcaccagaatcccctgcatatcttagcgtggagttgaaggtcttgtgcaatcttaagtccaactcacctactgccacttttctcctcacctacactatgctctagacactctggatttcatgaagtacccttacctccaggcctgtgtacatgatgttcatccattctgcctggaatgcctttctttactcatccatcagcttagctagcctcctagtttcttgcacctctcagtgccctttcctgatttttttttccattctttccatgggtggatataggttcccctctccccacatgtccctaagtgccaagtttcatgtttcctctatacattataactgcccttttcatatctctttcccatcagaccttagtcaccttggggtcaggaactttggcttattcatgttttagatgacaaagaacacaattttaggcaatctctaactctgccctcatgcctgccctaggttgggaagacttggtagcttctttgtcactccaattctttaacatagaaatatactcggtccgggtatggtggcttgcgcctgtaatcccagcactttgggaggctgaggtgggtggatcacctgaggtcaggaattcaagaccagcctgaccaacatggagaaacctcgtatctgctaaaaatacaaaattagctgggcgtggtggcgcatgcctgtaatcccagctacttgggaggctgaggtaggagaatcacttgaacccaggaggtggaagttgtggtgagccgagattgcgccgttgcactccagcctgggcaacaagagcaaaactctgtctcggaaaaaaaaaaaaagagagaaaagaaaagaaatatactctactgacactccaggaagcatgccctaagatctgtacctcatgattctcccacattattaaggtacaattgtcctgaatgcacttgtccttcctcaccatttctgtgtaccatgtacacaaaaatgaggggtgtatccaacaagggagctgcaaactagaacaagtgccactagattctttcattaatgctaattaaatatctattctatactaggtactgtccttagctctttacatatattaatttatttggtattcacagctaccccagaagcaatgtcctactattaacctcatttgagatatcagaaaatggtatgagagaggttaagaaaattttctactatctcaaaactcctaaatgataaagccagaagttgaacccaggtagcctggctgcagcatctgtggcactgctgcctttccaacctacccaagatgactgagcctcctggcctgatcaaggaggtatgcttggctatagagtatctgctcagacactagagtatctacgatggaggaaaattcgagcagacagtatcatcacagaaagaaactgattatgaatgaagaacgagctaggtgtcaaatggacatgcagcaacagaaatagacaaactagctggatcattcttttccccagagggctgtgggatctaggaatgggtgttaaccatcacactacttctgaatctcatatacacaggtggaacctgtgggaacctccaaaagactgattttccctcttaatgctattattctgtccctagatgtgaaaaggcaactattttggggagaatcgttttcaacaatatgaggctttatataaccagcttctactcttctgagccatcccttccttgatttcccccaccactccatccctatcacaaccaagaatttgttctccagaaacaaagatgacagaaatcaagttagggacatagagatgctatcacagccaactcagaggaagatttttgccctcccttatctcaaaacctgcattggccgacattgtgtctgctcctagacaccacttaacgaaagactttaaaaactttaggaacaatttatttaaagaaaactccatttccagtatactatgactgtattccaaggtaataaagtataaatgagaacaaggaacaagctaataaactgaaatgaaggctgcatttcaataacaaggtttgggagccatttaccagccacgtgtatctcactctcatgacttataacattggctgaattacttaacagaaatgaaagcgcatattgcttctgttatccaatgctgaacaatgtgacatttgcttcagagcacttgtatctaatcgatacataatgctaaatgtgatttaaaatcaatttaattgtgctcttgctctcccatgagtcaagggggaaacaaaggtatcatttgagatatgaaaccattaggctatttcccaaagaaatcatagatcccttgcttctaatggagcccaagaagtagatacagttagtttacactaaaaactccacatgtgaaaaacagtattgctgaaacagttaagatactgtgccctaaaaggcatatttgaactgtttttttttttgaattacaaaccaattgaacttttaaaaacttctttatttgttgtgacctttctacaaattatagcaaatttaaaaagaaaaaatataattaagaaaaaaacataatattgcatgtcatatatatacttactttcctagattacatacttttaaaatatctgtattcctacatattgaaaccaaccaaattgtcccatagagctaatgtgtatgatttattttaataaacatagaaattgattctcccagtcttaaaacatgagaaagttatgtttgtcttttctgagttcctttctcaagaaaccaaccgtcaggcctcccagataggatcaaggagctgaaactcaccagattactgtatttggacaatgagatgtcagatccctcacccatcatgattgcctaacagaccacctgcttcctgttgatcaacttctctcccttacccctccctaattcctgttttcctacacatggttacatttcttctctgcctacataaacccctcattttagtcagtgagagagatgggtttgacactgacttcccatctcctcagttacagcatgtgattaaagccttcttccttggcaatacttgttgtctcagtgactggctttctatgaaacaaatggaaggacctagactgaacccctggtgtttcagtaaccatgtaatattttctattatattgtttctctgaaaataattgtatagttatatgctgagccaatcctgagtgtgtacaaagatttggacttggagtcacttctagcatccatctgcctgaccaacagttactgagtccccagttggcacaaggttgtattacttatactcaaggaaatgaggctcagaccaattttaaaggagcaaattcaggactcaactaataatacaagagtctctagactttactttatatgaggatgtttaaacaatccaaaacagtcagtaagttccacctgaattgcagtacttgggttgagtgtctcacttttaaaaactgatgtattggccagcacagtgactcacacctgtaatccctgcactttgggaggccaaggcaggtggatcatcgaggtcaggagctcgagaccagcatggccaacacagtgaaatgccatctctaacaaaaatacaaaatattagccaggtggggttgtgtgtgcctgtaatcccagctacatgggaggctgagaaaggaaaattgcttaaacccaggaagcagaggttgcagtgagctgagaccacgccactgccctccagactgggcgacgcctgggcgacagagagagactccatctcaagaacaaaaccaacaaacaaaaaaactatatattgattaaacgaactatctgtgattaatgtacagcctgtgtgtattttttttctacctgcattcaagaaattgtatggctatagtatataagaaacagaatctttttaaattattttcctaacaacaactgaaaatagtcccatacaatgtacccaacaaaacttcctttttcaaaatttgctttaaatggacaaaattatgtaatagtgaagtaaacttttattaaaaagaccaaattactagttgaagttaattgggatagggttgttttataacactataacaaggacattcacacaagataatctctgatttgtaaaggaaaaaataaagtagttcacaggaaaatagtcaattttatggctcttgtgtttaaatagagggaagaatgtcaaaattcctataaacttaaaatttaaaatatcttcagaagttgccacaacttaaaaaaaacttgaattgcaccaaaaatatctagaaaaattttaagcagtaagtatattcttataaacatccccatattattgtaccttgtcttcccccttgaccaaggttttagactaaattcagttgacaacaggtaacatagctgataaactgaagatctctgcttggcatttgatagttcatcatttacatgggcaaacaacccacataaattcaaacactatgattcaaacatacagattcaaacactatgccaggaatgagcatctacagtgtatgcggttcaggagggtaaccaatcaccacacatcatcattgggtacttgatacagggttagcccaaatcgggtgctgtgttagatatgtcctggatttcaaagactcagcacacacacacacaaaaaagtaacacaaaaacctcttgtttttatattgaccacattttaaaatttattagatatattgggttggataaactatattaaattaattatgcctgtttctctttacttaaatgtaagaattactttggtgacctactttctattagacagtgctggtaaagaacttaaaaaaaatggtatgctccaagttaccactaagaaaaatttttaaaaatacattaaattaccaattacatttttttctcagatgaaacatgcatatgttaacacagaacatattctgacagatctgacagaaaacatgaaaaagtgtgctttctatcataatgattatttttcagataacaacagctgttggcctgtacaagcaagaagctgtttttccacatactaccaagtattagcattcaatcatgaaagaaaactaattctccatgggctctctccacatgctttacatcagcagcaagctgtgcactcctatgtaatctgaaaagccgaaccaagttggggctgcttcttggctcactgctttgccacttctctctaatatggcaaatacaaagcactcacattttgctgattcagaagtaaatgaaacattcaagacctgcacaaaaaccctgaccaaaaggaagtctcagacaggtgagcgccattttggctcttctttagttacaaaggagattaaaagtaatcagtctcttgaatgcctatgaaaagagtggttaaaagtcagctgttaaagaatggctttattctagaacacttgaacatagcccaaattttggaacttgaaaatagtttaaagttcccttataaatttcaagatctcatttatcacattttgtgctcaagaatcacctcagctgccaaaatctaaatagatctgtgctatccaatatggtagccaccagccacacatggctatttaaattaacaaaactttagttaataaaaattggaaattcaggtcctcattgtccatgaccacatgtggctactggcatagtagacagaacagtggagaacatttccagcactgcagaaagttccgttagacagcattgaattagataataacatacagtaagttagcaattcagaaaacttaaagagagaagcaaatagggcagaggaaggcatgtgactagaatgcagactaagactatttaaaaaaactcactgcagttgcattatgtcaaagtaagcaaaaaaaaaaaaaaaagttctttgtcagtttgatgagtgtatctgttatgcttgaagatgtagacagagagaaaataaaatcagtggacagaaatttcatttatatatactggttacgtacttgccacgaccacacacaaactacaacacagaccaaaattcattactgatgaattatggttttgcttttctacaagacggaggtaagcttggcaacatttattcttgggctaagttcacaattgagacaacaattctttccttaatgtgataaattatgctgctctacattagggaatgcatacttttttatcgaaaggtaggaaaaatcgcaaggtgtgccttctctattttttttttccgcccactaggaagacatgaagttctatcagggagttaaaacagttaaataatggttaaaagcctgcttctggaatctgaaaaactcggtttcgtggctttactactttctagctatgtaagcatgtgttctgactgtctcctcatctctaaaatttaaatgaagtaatgcctgaataattcttggtacacaccatttctaattaaagggatgcttaatgatgcaatcattcttcctttgctgctaattactaattttgaaatacatgttatgttttgtcatgacacatacaaataagcataacttaagtgacaaaaccataaacctatggcaaaaataccacagaccactcatatccctcagaggctttcatggtggacaagttagccgtgctgtctcgtacaccccactgcactgagttgctttgataaactgagttatgatcctgggagagagtactgaaataagacagacacactaaaggcttctgggaaaccacatgacatacaggtgtacctggggtttccataaagcccagagatggcagagaaagactcttgggggactggaatgtctgaaaatcccataaagaaaacagtttgcattcctggtcactgggtacaatcaaactcaggaagtactttgtatgggcaccgaagtgtatcctggaatacacagtcacacattactatcaagcctgggcatttttaccagttcgaaaaatcgaacacccaagtttccatttgtaaggtaatttttcaaataatgtttcttttcgaattttttttcccatttatgtagagaccttgagagaagtgtcatacctgagatgcagcaggggacaggatggaatgcgttttctagagaatcttccataaagggaagcatacatatattctgcatcactaagattaatcagaagaaattgctcaaattccaccacattccactttaagactatagctttcccattaatcgctactagcccgaagacctgtccaatgctataacagtgtatgataaagcatatatacctgatttttcacaatcatctataccacaaaaactctattcctgtaaatcatctaattatttagagatcctatttatttatttacttatttatttgagacagggtctcactgtggcgcccagactcgagtgcagcggcatgatctccaccaggccttggcttctcaaagttctgtgattataggcatgcgccaccatgtctatgtctggtcccagtattttatttacatccatagtatatatgtcagattgtttcttatacctagaattgatagaaatcctttatcacatgctgccttccaaaaaagagttcaaaaagcatggttaccacataaagacttgcagttactagaccacttagatgttgcctgagaaagatagagcacatgtggttttctgcatggtatgacatatctgaacagcaccagtgaatacagaagaccatggcacataatggtggtactgtgatggggaataaactgcctatttatttattagagcacataaattaccaactgatacgcaaaacaccaactgcaaattaagccttccctcagaattaaagagaaaagaggctggggaatggaaagaatcagatgggcctgcctcaaacctcagcgcactacttaatagctgcatgacctcagtttccttaaccctgaaatagacataacaaggcctcctttacagacttagtgtaaaggaggggacccacagaagataccatctggcatatagtttgtaaaactttacatttgctatttctgttatgtatttatgaatatacacatataattttatgatatctattgctataatatatgcaatatgtaagtatgtatgcacatatgcatatgtgtgtttatatataaaatgagtgatttttgctctttgatcttcaaatattttctttggatgtcaatttttctttccttttttttctttcttgatttggatctcaggatccaaaagtaaactaactttcctaaacctcttcagtattaaagagagattcattttgagccagcacactatatttctagtccatatctgaatccatatctgaaacaaagaccacgtctaaaagtaatactcttatttctaattctcacctaacacacccatggaagataagaaaattaacttaccaggcagcagtaacttcttggaattctatgctcacactttgctcagcacacataggcgttctgttgacagttggctctcaacacctcaagtacgtgtcagagggacgcgagccgatcagtttacccaagctccttacttattctcatttaccctctagaattttatttcctgcctcagaaagaagaatcccatctgccagaaggaaatatttgtagccaacatgacaaaagtggaatccctattttgtaacagctgtgaatcaaaacactagtgactgaaattaactacatcgtgcttcggaacagatgtgtgcacagaaaccaactcaagctctggtgttcctgggcaccatgtgtaaatcatccacagacaacacggtgggccatgttctcaccttgttgctatgcacgctcatttttaatgttctcctgaaccattgcagactttgagatttttttttaaaggcttagaatctttatttccaaaagaggagattctgaaagttgccaatcactcactggaagacctaactaaacagatgggttttgacacctctggtttgattttaaatgcaaacatgtcaaattatgctctggcacaggttcttctgcctcaaaattttatggaggggtgtttaattttttttaagttttcttctctgaactcagttgttccaccattagcaattaaggcaataaaggacttattacagaaacagtgatatgattgctgtattttaatgcagcagccttaagtaattgaaaatcattactaaaaactttaggaaataaatttcaagaacagacatctgcaaatgaagttgaaggtaaggtcacatttttatataaataggaagcgagaagaaaaacatatggctttctttggtgactcttcccataatcaacatacatgtattatctcctacaaccgaattagaagtaagtggtacattgcctctgatcactgttcttgggagcccatggcagacaatggtaatccactgcagcccttccaccatccatgcccttcagatgcaaaagacttgactagctgctctgaacagatacaaatcaagggaggacttgaacttcagacaagtaactatatggttagaaagattaaatatacacaaatgtaatcacttgagaacattttaagcaacatgtcagaatatgcaagacgatgggctgcaggataattaattattgagaatatacagttgacccttgaacaacacaggttttaactgtgagtgtccacttatatgaggaggacttttttctttttttgagacagagtctcactctgttgcccaggctgcagtgcagtggcgtcatcttggctcaccacaacctttgcctcccaggttcaagtgattctcttgcctcagcctaccaaatatctgggaccatgcctggctaatttttgtatttttagtagagatggggtttcactatgtaggccaggctggtctctaactcctgaccttgtgatgcgcccatctcagcctcccaaagtgctggattacaggtgtgagccactgcacccggcctatatgagaattttttttaaatgaaacatggattaatagtatagcattggggaatatgatacctccatatttggatggctgacttttggtatctgcagatccacagagccaaatgcgggacttgagtattcacggattttgttatacgatgagtatatccttgagtacacagaaggatgactgcgttctcattccaccgtgggggtgtgttgttttgagctggatatatccacacagcactttagtttgtaaggtatacctatattaagcctcatcgttgcatgtattattttgtaataatatgttgaatttataattttaaagggttaaataaccagtacagtttaaaaattgagtaaataaaaactgagaaattaaaatctgttcaaataagcactgcatttaaaacccatagatacacaaactctacagaagcctggagaaccaggcccacgtggagacaaaggcaggattgaatgagaaaaatgtgtttctatcacaaatcataattacttgtagaaaatctttttactgcgttctaagctctgttgggatccatgccttgaaggtaacacaccattggttgctttttcctgctctccctcttgattttttttttaatagactgaaggtaggaaatgctatatgcttatctctgagaagatgcctctatgtagtctctctgctttataattagcaacagtctttcccaaattctacacttagattgacttccaacttaacagatgttacagtgaatttcttttttctttttgtgtcttcatgggtattttagtgcgaggtaaccaaaggctgtgtgtaaggctaccagggaaatattcgcaccgcctgggtcagaaccctgtacgtggcatgggtcttagtaatcttgcagaattttgttccttagttcagccaaaacgaggttcttgtcacatgaccagcgaggattagaaacgtggacacattgaagggtaagggaattggaatttattgggtgaaaaagaaaaaagaaaaaaaactctcagcaaagcaagaggggatcctgctaacaggccatcacctcacacattgaattccaagccatacacaggacctgaagatgccaggctcctccccactgcacaggaggtgaacttcccctggcttcaccctgttctcccaataatgtgagggtgggtcagagattctccaggaccctccttttatctgcatcctgcatctatcagtaagtagttattgaatacacaattgcatgagcaatgtttaaggagcagagagagctctttgcatagcatatcaggcagctgatcactcaataggatttaaaagtcactgaatagactgctaggttccatagtgtggcagatataacacagggtctgagattctcatcctaggtttatgaatgttttgtgtttggacaccaaattctgattttaaaaagattactgtgataaaacctatttaacataaaatttaccattttaatgtttaaatatacagtttgtgtctttaaatacattcacattattgtgaagcttttaatagattgaatattcttctcttctgatcaacagcaagatgatttacataattctgtaaaactatgagttggcccattccctcaagtaaagcatgaagacttaaaagcaacatggaacacagaaagagaaaaaactttgagcccaacaagattttggctttgaaagagaagtaagatgtttaactaagactcaatggaaggaaaaatattgtctggagatactgaaagttgagaattataaagagtgattacaaatgcagaaggtaaaagtattggagcaaaaattggaaatctgctcacatttactggctttttaagcaagttctatcatagaggatctctcatccaaccttcccaaggaatttgtcatcactctaatccacagctaattttggcacagaaattatattagtaaactcagccatattgtcttctcacatgaagacaggactgatgtcctctaaataaaaaattagagtctatagcgatttgtttacaataacaactgatagttacaccccagggatcttctttttgcatatcctggtttttaataatgaattataccttctatacattctttcaaaatgtaaatcaatatactaaaaaaactacagaataagtcaacataaattgccctgtgtgagggtgcctagtagaccaatactaatattttggaggagatttctactttgtagaatctactgagattctgaaagctgcctgcaattctgcaagtgtagggaatgggggaagagacagggcagaggaatgaagcaatggacttatctaatcaaaagcctgattaaaacactccctagcagtctctaagatagaactatagggaggcagcaggcaatcaaaaggaagaggtccagctatttaagtatagctcatatctattcactccgttgtttgattagatttttacctgtaccaagtctatgtaggtatgatgaagaaaggtggtgtattaaagatgaggaaaggtggtgtattaaatattcctaacaccactttccccagatatgctactaataccaccccaaattttccactacgctttgccatcatgccctttgaaacctaattaataatgtttcatttttaagatgatagtctaggctgcaattttaaattggtaagactaatatcactatctatagtagaatacctctttcctccacccacattctgatgcactgtggatacatctgtccacaacaagagattaaaccatccctttctgtctttacttctcctttaaaagccctggactgtcttaatttttgacagaaactaacttctttcccaacagtggtggactactagaattccatgaagcatgcttttggtggctcatgttgtaaaaatcatgtatcactttctcttgtgacctgtcatcaaatgtgacataatttaatgcaacagctccaattttaaggatggcattttgcactttgctttcaaactctatgactacagttatccaacagaagctggccgacctcagtggaacagacggggatctgttaacaggttgccaactttaaattactgctgagtagcttagcatatctctagaataattcctttaaaaagtaattaatcattatttcaaaaaggtcttcagtgaagtgtattttctatattttactgatgggtagcatttgattggaaacagctaatacttctccattctctgtcttgcatttacatttttactgttttcaatattgctgtttttgtttgatgacaactagggacaactcagggagcagactgagatgcgtccaacaaagagaatatgaatagcaatctagaagagtgaacattaggcagctaatgcatagaaatacttgtattttgtatctattttctccatatttcaactgaagattcttgcctcatgttggaaacagattgagaaaagtcactcgtgtcagtactacagagaacacattccatgagcccatatcttcagcaatgtgtttgcatcctagaaattatttcagattatgctctctcttgaggccataaaaggcaaacactggaggaggaacagtgaggagaaactacataaatagctacaggctgtattttagagacgcctccaaacttgttagaagataacgtgttgacttttagggtttgtcaggaaagttaataaagctagatttataagtatctttcaagatttttttttctaattgaaaaataagccacacgaaaactgtattctaacactctttggaaactggtatcaaatcagtccatcacccacttcaaagaattttattagccaagatatcataaaagtctacattttaagattttttctttttatcataaaaaatttcaaagacatagaatgatataatgaatcatttatacctccactatcactcacaaaactatttaaaaacaaatcccagatgttacttaaggcaatgtcattagcaaatttccctttgtataaacactataaattgctttaaagtaaactttatgaaaatcatatgctttatttaagattaggaacatcctaatcccttttccccatacttcacaaattttaaatcatttgtgtcatactggtaatgaacaaattactaagtgtgtacaacagagatgatatatgttgtcctcctattagggacatccagtacgtgtccatgacaagtattcccctggatcttactacaggtccctgttgaagctgggcagggcctcacagtgagttccaacacagcacaccaggtaacactaactcatcaattagagacagcatgagaactactgaccttcctggtctacagcttactgtcaaggaatctcatagccaggaataagcttctttaccaattcctgctattgttaaatacctacaatcacactgttcaactaggaggagaactaagtattcatgatggcttggacctatgtggatactctccttgcttttcaagctcacagagaatggataaattattagatttcagaaaaccaattgtagactagaacgagaacctagaatgatctaccaaatccagtttgtgactaaaagatggcattgtttccattgtcaaaatcatgaaagtagactatcgtctcaagatagaaacaccatctttaccttccattatggaccttttaataggaacacagtgctaaattcctaaattacaacagtttattgaatcttgaatgacatcagtagtaagacctaccattattttatgcactttaagaaagaaaatgtctttttgaaaactatgacatgctatcaattataagaaacacctggtttcacagttactaacatatttgtatatacacacagatgcattctattaatttgtatttaagctaacatttcttacttgaagatgcattggtaatttattgataggaaaatcacttccacaactaaggatagtttttcacctttgttgctctgcaaagcttggtcttatctattcttccttttaagatttcatttccaccatcaatcccaagggcaactggtttaacgtaatagagaaagtcctggctagggaagcagagtgtgttccctgccaacatttgcccatgtctgcgcccaaatacacagtgactccttagagagtcctcacgcaatgtccatcaattaatatttttattattagagaggctagtgctctttacagcattggaaacctagaaattctaccagcttagccagcttttgctacctataagagtagtggaaaaataacaacatggtaaggatatctttctgttttcactgatctgaagtcacaagcctataaaaccattcaattataaatgtgaaaataaataatgctaataatgacagctcttgtcaactggacatgcccaaagcagactggagccagatatgtgcactgagggaagtgggtggagccacagggaatttgcaccttacccaggggaggagcctgtgctcttcagctcatctgtgtggcctggaatcgatctatgagatgaggacctgttagcaggaatcccccacgctttgctgagagtttgttttcttttttccttttcgccaaataaattccattcccctcatccttcaaactgtctccatgcctaacttttcctggtggtgtgacaagaacccagttttagctgaactaaggaacaaagctctgcaacagttgcaactaaattgcattaaaacaagatgtgcaagatgagttttgagacctacatccttttattaaggcagaaaaattcaagtccataatgaagtcaatatgaaaaggacctgaatttaggtttctgtagcaatccattttatggatgttgctttcttagaaattttatgttttaaaatagatttttaaaatttattaccttaaagattttttcctgtagatcatatggacacttaatttcttctatcaggcgtatcatctagaaatataatgcttacatgggaaatatattatcttatgatttgataaaaaatagatggagttgcaaatatacttttatgatattcttgaattttttttttccaatgcaaagattcccaatctgcctaccaactgaactgttttggtcgtgaaacattaccttctcggtatgtggtatgcctatcagcagaaaagtagtaaagaagaatagactaactttagttattacatttgcattgtctacaaagccatttacttaatggatgagtctcattagcagtccaaccacaatataaagaatacaatgatgtgtttcataggttcattaaaataatatttcaaaggagtcattagaataaaagaagctgaagtttcaacagacagtaagttgtctgcaaataaatgagatggaaccaacatgttttcaagtaagttaagagacatgtttacaaatacattacagccattaaaaaaggaagcatcaacttagcaagtgctggggggacgattactcatgcaatttactaaaacaaaactgtaacactctcacatcaatagttattgtagatgcaaacgcctgtaggtacaggaaaatgtgtcttaagaaggaaaattcattctacagccccgagatgattctccacttggaagcaaaattgaaaacattcaatcctgtcttcagatcaccactggtttggggggggggggggtttgttttttgttttgttttgttttgtacacacttttgtgttatttgccccaaaccccaagcatgcctatcttttcatttttttttgagacaaagtctcgctcttgttgcccaggctggagtgcaatagcacgatcttggctcactgcaacctccccctcctgggttcaagcgattctcctgcctcagcctcccaagtagctgggattacaggcgcccaccaccatgcccggctaatttttgcatttttactaaagacgaggtttcaccatgttggccaggctggtctcaaactcctcacctcagttgatccaccctccttagcctcccaaagttctgggattacaggtgtgagccaccacacctggcctaccctttcattttaaaaagaaattcatggtaaattagtaacatgaataatcctgtaagggcaaaaagtatactgaaaaaaaaattgtgtctatttgtaattatctaaccacacctaagaattgacaaatgtttgtttaacaaatcaatggatgaataaatgaatgaaaaaagcaattacttagcaaaggagagtttttagattaggttgttaattattgctgctttatcaatttttaaacccagtatttccacctgtaagcaaaataataaacagcttgtatatatgttcaataatgttgaaatcttttcacaaatagcagtgtcaaattttttttaaccaagatcatagagtttatattaaaactaaggattttatttttgggtttttttttcacaaagaaaattaacatgtagaacaaaataaaaaccactaaaggaatagagattgccatttatttattaactttccttttttgaaagagcttagatttataattctaagaaatacaaggtaagacacacacatgtgtaagtatacctgggacttggcaataagtcacaggcacctagaccacagctcttgtggcagagagcaaaaatggccccatgtaatttgcaatgtcttcccactctgcatcctgactcacctttggatgcttggcttagccatgtaacttgacttggccaatgtgatatcagcaaatggacttggaaagagacttgaaaaggctttgtgtatttctctttgtgctcttcctatttgccatcagcattagaacatgccagggatagcctgctggcggatacaaaatatttagagcggagctaagtcattcagccaagaacagcctagatcattgcccagccagctaaccctgacatgtgattgaacttagccaacctcagcacatttgcctaggtgaccccagctgattgtaggtataagagaaataaacatgtgtagtatggcactacttgacatccaacagattcacatataagctttgtactttgcagtaagattattctccaaatagaacatcaggttgcataaaatcaaagtagtactgggttttattaaagtaactaataaaaaattattcattttctattttttaaaagagaaaagacaaaattaaatttgtatgcacagtctgaattttgaagtgctggaagcttactcaacaatacatctactgctgaattcagctcacaagccaccaagtgtcaacctctgttctaggtactgagaagattccatgatttcaagctgtttacggattttgtgagaaggacagacacatagtgcattacataaaagaaattaaaactattatgtcttaatgcttaccacgtggacgaatataaacaatttggatttccagatgttttctggaatgcttgctattttgcctaaaaggtaataatcagaccaatccctacaattaaggagtttactctctattttttaaatatataattgataagcaaacatattccaaaagattcattgtaagtctaagtttttcagaaggtactaaactccaaaaatatacaagcctccaaagataaactgtttattaataaacgtatatataaggacttcagcaaacatagcttcctgagaaaaagcaattcaaagatcaatatttccttttaaattttacacaacttggacaaaattttctaaagaaatcacaattttaaaaatgttggaaagccagttccattgctgaattcataaggtaacttaccgtaaatcatatatgattatcatatttataactaacatcacatagccccttccagactgtcaactccatgagggtaaaacctagttatgttgacatctgttttctcaagcagttagaatttcctgattcattctcttgtctatctggctggaacagctaaaattaaggcagtggagatcattagtttgataaaacaatagaagacaattggtattggtgtaggagccactcaccagaaatgctgtaagtaatgactaggttctgcagaaataaaattaacagattattacagtacacactcccatacctacatcaggagtgaaaggatcaagcaccacagttaaaataataatgtcagttgcaactggggaactgagggtcctggagactcccaactcagatgcctgaagaagccagggcaggtatagtaagcaagcagggaaaacttggtaatagtgtacatgtgtacttggcttctgagtagtgggagatggcactgaactggcaagcccatatcccaactaaaagtgggtttcagctactaatctctaaccaatatttgccatgtagaagggtagagctccaaactcccatgattttatatatacatattaaatggaaccacaaatagcaatttctacatattatctccaaaattgtacgtaacgtcacaatttttaaaaccattatgtagaacaaataagacacatgtttaagcatttgtgctttcccaaagatgatgtcacctttgttcctggtccaggaagctaaaaacaagtaagaggtgacttcctcccatttcttctccctccttcctccctgtattccaccaacagtgctacttaaagtatggctatggaatattgccactccaaaacctatttttttcttttttggtctaagataagcgtgatgaacaggtaaactccatgatccagccccctgtattcatgctcttgtgtgtaatctcctctcttgagtgtgaacagtgtcagtgatttgcttccaaccaaaagaaatgcaaagatgatagaatgttactgctatgattatgttatgtaaaactccatcttgctagcaaactcactcgagagtctctctcccttgttggctttgaagaagcaaactgtcatgaatcctacagccacaaagaaacgaagtctgtcaacaacctgagggagcttggaagtagatcccttcccagtcaagcagctgatgagaccacagccccagccaaaagctatattgcagcctggtaggacactgaagcaaaaaaaagccattaacccatgtctgaacttctgactcacatgaactatgagataataaaggtgtgttatcttagcaccactaaatttggagtaatttgttatatagcgacagcaaactaatacaaggggcctaccccttaatgttaattaactgtatcactaggcacattgtttagtttgactgatatttattttttgtaatagtactttctcaatgaaggaagcaatacattgaattacactcagacgcaagccacctcatctcacagcagcccaataccttgagttctacagttgatgggcatagtggaaagagaggtctggtgtaactttatatgcagaaaatgagaaaggcacattttcttcctttgacttataattttgtctaatgatatatgcaacagaggtagtcaagagcagggtcagggaaatggagactatggtgaaggagttattacctgtaatacttctaagttgcatcataaaaatttgctatcactacagataaaagcaaaggatgagctaactgataatacctgtaaaatgctgcaaacaccaccatgatgtggtgaggaaagcaagataaacattcctatagaatcctcctattactacttgccctggggccttgtgaaaatctagagaatctaatagtctagtactcagctcgcaaggaaaccagtcagtcatctttgtcattctctgctcatatcttatttcctaacacaacaaaatcacttatagacccatgcagaaaccatgcccttccttctcagtcctagacctggctaacccctgtgccctctaaagatttaattagctagctcttaccctgaagaagccttctttgataagtttgttcctccttatagcttgctaacatcctgtgcaatctccatcatttcacttcttgccctgtatcgtaattagctcttccggtgactgtcttatccactggagtaattaattgctacttaagataagaaaccatggctctcatttttgtatttccagcactgaggagcatgccttgctcatagaaggccctcaataaatactaagtgcagagaaaataagtgagttattttactagaggctgcataagagccaagagaagcaacttaattatgaggcaacaataagcttggatgatgcagacaaaaatatgctaggagattttaagcactcagtctgtcagtggtgagcctaaaacaggttcctttaaaggtaaaagattcatacaaaacaatacgaaactaagaattgtacaactcaacacatgttaaaattgaaagaaatatcacaggtactcactatacccagatgtcaaattctttcatatcttgcttcaagcagcatgtgtatattaactcatatttaatacaaaaagctatgctttttctaaaagcatttcttttttaaaatttttttttaagagatggagtcttactctgtcattcaggctaaagtacagtggtgcaatgacagcttaccgcagccttcaactcctaggttcatgtgatcctccggcctcaggctactgagtagctgagattgcagttgtccaccaccacagtcaggtaattttttaaaatttttattcatacttttagaggaagggtcttgctatgttgcctaggctgatctcaaactcctagcttcaagtgatcctcccaacctcagcctcacaggtcactgggtttacaggctcaatgcaccatacctgacctaaaagcatttcttatcagagtcctacttacccagttttgtcaggtgccaggaaataggggagctcttacctaggagctccctctggtcagagtggcctcgcattctcagtgtgggggattcagtcctacatttatacctcccttggagatcaattccttaaagcaaaacaggtggctcactggatggcattcactttcagttgatcaattgatttgtttggagatcagttcttaacatttatttcaacagtttaacaagataaatttgaaatcatttttcctaaaaaaatttcaaggtgatcttaatattattttaccaacttcaactatgaccccttcttcagacttaacctaattccttctgaaagccaaaaattcagacccatttaccatgaagctgaatcctccactgcttctctaactacctcttccatcggccctaaaacattaaaaaaagtggggtgctgcttctctttttctgtaagatgcccaggcctggttggtaaaagtttaactgcttaggtgattattatgcactatacaaagtatactacatatcaagtgctctgcccagtagagggtctactaaaaaggcttaagagtgaaaactgccaaagggaatttcttaccttccctcagggcacacagaacctgaacctcagtaccaggtgttccctacatctccttctgctggtgagtctaaacctgaattactcttctttgtctaatcaatttagacaacaaattaagcatgaatactgcttggcatagtagccttaatcaaacaaaaaagtgagattttttatttttttaaacatctatgcaaacatagagcttttgttagaaaaagttacaaattaataacattaaataaagccaactctttagaaatgatacagaatagccaattcccagaagtatttgagtggctgaaaaacaaatctgtaaaaaagtcaatctcaagcaaaaatcaagttaaaatgagacagacacactttcaaaattgcagtaatttttaaaaatttataagaagtgtgtaaagaagttgacattcatacagtcctgttcagctgatagcttttttagagagaaatttggtaatatgaccccaaaaccttaacaaattttatatatttatcctatctattctacttcttagaactctaaggaaacaagaagagatggccagagacttatgtagtaggatttttctatcacgatgatgggctggagaatccaaatgtctcacgataaaaaagtggcaatataaaaaatggtatgtgatacaatagactcctatgctataattaatttttatgacatatgacatgcttgtaacatattaaatgaaaaatggcaccaaaattgtttaaaatacaattattttatttttaaagcatacataaactcatagtaaaaaagtatgcacattaatagtattagtcattacctgtgaaaggcagactgattagtgacttactttattattcctatccttattttaaacttttccaacccatatatgtggcccatcagatttgtaaaaatgaaaatccaaggcataggatttgaaggcatacattcctataccctgctaaaaacagactcagtttagtatctccttaggttctgatataagatgattctcgaaaaagccccaagccaacccagtctgaagaaacagatacagagtagttatcagaacaagaattcaatgccagttaagtcacctttcccaaatttaattctaataataagtccgtgttaaaaagcaaaggttcaaatattttagtgttattgagaggattagctcactgctgagagtgaatataaaaaacaattctatatcaaagccaactaattcaatcttatttttaaatgtcaccaaatatggcttctctcaaagtacgccggtccaattggtaatatctgatggctgattctgcttaactctactaaatataaaccattatcttagggaatcagtagtatactttattcttgttattctttagtattttgttagggatcataaaattggacttgactttgaggacaggactggctaagccagggcagttagtcctatggaccttttcactccgggagtctgtgactacttatccttaaacatttccagtaaatttatgttttagttatcaatcagttatctgtaaactagaactttaaagaatcctaaaacataaatctttttaatcctcaatgatttagactctctacatttttaaataattcagtcaaacaaaagaagggtaaattagtcattttgtgtgtcagataaaacacacatgcatacacagaataaatgttttttgttctcaaaggattttgttgtaacctccactcgtcatgtaacactggaacaaaatagttaggctaattacccaaaattaagttccacttctcgatttacaagctttccattttattctagcaattcttagctgtcatggactcagaaaattattactgccatcaattggaagattgttttagtggtacagatggctgtccttttataggccaacttaatgacttcttcttatctaatctgtcatctgttatttagttgtcattatgaactttttgggttgcatatcaatccattttccatgtttactaaacagatggctttatttgagaaaaaaaaaagcaaagcaagaaaatgacattgcatgattaaaaaatttcaaaaggctgcatacaatttttaatgttcctaaatgaaatgaaaaattgctattaaaaaaactaaatttgaagtcaaagtgaaatagattttaaaactcaatggacatgcaaagaaacaatcagcagcagctatctacaaatagaacaaattacttccaaaacagcaataggttattcttccagtttttgtcacaaatttttttttaaatttatcttgacaaatagatgacaaatgtcaacgaagtaactcttcaattcagaagctctttatgttgtaattcacaggtgtacctcctttgtctagtatttgtaaccttatttagagagtaggtaatgacataaatacttccatttagtgaaaattgttccttatctttgtctccttatgatgattttgtttaatcactgggtcattatcaaatcaacacccaaactcaagaagcgtaagggaaattgtaaagggcttgtatcaatgagttcagagatccaaaaataataactggcactgtgccatgaaagaacactgtagttcacactgtaccagagaaagaacttgacaattattagaaactaaaatacataatcatgaaataattttatgttacatttatgagtggtatttaaaattgtgtttgttcaggaaggatatttaccaagtcttgggatttgctgtatcagcctataacaacgctgcaaaagtaaccgagcagagccttctgaaacagtttcccatgccatactaagcacatcctccattgtagaacagattgagttcaactgtggtttttttacttgcccaagttcaaggctcctgagcacaacaaaaccaacaatgaggaagagcatgatcgcataattttttatgttcttcagacaatgtaggagaacttaaaatggacagccaatttttcaaaaaggacaaattatttgaaggatttcttttcttatatgataaccacagtaaaatgtaagactagtgtaggtaattgtcctgccactccattctaagctgtgagtgaaagtactccatcagcttaatgagaacaccgtgaaatataaaacatctatttcaatacaagttattgagaagctttaacaggctttcgggagaagctaccaaaagaaaaccgaataccagatacttgatttgagactgacaaaaatcttctattctttcctacggaaaattaaacaaaatgggctattatatagcaggaagacagagacaaaaaaaaaaaaaaaaaaaaaaaaaaacggaagaaagagtaaattgtatgaatcagaaacttggaataataattctacctcaaatacttctcttaggtcttctgctcacatctttcaggcagagaacatctatttgatgccaaatgtgtggctagaactgggccaggtgctttacatgtcatagatcaataccaaacaactagtgaaatcagcacaaattcaaccaatgaagctcttaaaacaataaggtgaaaaaccacattgttgaggagagccatacaatacagtcaggttctagttcaaattacgtttctttccttgagatcttctggtccatgatatgttttgatctgtctaaaatattatgtaggcattctcaagtgattaagaaactccggattgtttcaaataatcaggtcttccccaggcaaacactggagatcacttgttttttgtttgtttgtttgtttctgagatggagtttttctgtgtcgcgcaggctggtatgcagtggcataatcttggctcactgcaacctctgccttccaggttcaagctcaagcgattctcctgcctcggcctcttgagtagctgggattacaggcacccattcttgagtagctgggattacaggcacccatcaccacacctggctaattttttgtatttttagtagagacagggtttcgctatgttggtcagactggtctcaaactcccaacttcaggtgatccacctgcctcagcctcccaaagtgctggaattacaggcatgagccaccacgcccggcccaatatcactttcaatgggtcccaacacattaaatgatgatttcttgacaaagttttacacactacttaaggatcaattgacatcaaccctaactcaaagccaggaagcttaatccaacatgaaaatattctgtggatgttgtacttaggcatattattctctgtagtatatactttcatattgatacacatatttaacatattgcaaagcatattttaaaagcattgatctatgttctactggtaattttcacaacgcttaatcacatggccatcatagtctttgcataagactaccttgttgttcaagaatggttttagcattccatccttctccatcatactggctcagaggtgagaactgaccttctcccagtagataaaagactctcataattgtattatgtacagcagcatcagcatcacctgggaacatgttagaagttcgaactatagacctccaacccaaacctctggaatcaaaactcaggagataggccttagcaatttgtgttttattatatcctccagctgtctggagaaccacataagttttgagaaagaaggcaatgcaccttatcattcttcaaggcaaagttcacttcacttagcttggtattcttcactgcacctagcaccctcaacataacaagcacttaatacatatttgtgacataaaatagattaaaatattctaaagacagaactcattttagagaacaatcctttccagccactatttggagattttgatactagagatgtatttggctgagaagtttcctttccttaacctattgctaggttctgtgaacttgccatgaattgaaaccaaggatggactacagtcagaatgaaggaagatgaggaagaaaaaagcaaagaagaaaacaaaaccactctattccttctgaatttggcacaaagatctcaggtgttccttatattcttaagacgtaaatcacaatgaattatgatcattgagcaaatattactgtgagcctaggtcaaaaagctaaggtcatagtgttctgacataaacaaaatcagctttatttcagaaagagcatagtgaaaggctaataaacattgctaagtaaagaaggggctgataacacagatacaacatggtaggtctatactttctagtgcttatccatttctctgccagcccctgcatttatggcacatcaatcaaaagtcttggttttggagccaggtgaactgggttataatctggctcaggtcttcactagttgtaggtctttggggaaattattcttctcctttctgactgtcttcatctataaaatggagtaataatggtaactaactcatagaattgatggaagatttatattaaataatgtgtgttgtaaatgctcaataaatggtagattgtttttctttgtctataggaggtgttgagggcttgtagtctacttgttcaagcaacaggacataaaacaaaagctcattaagtcagatgtggtatcccatcagcacttgcccagcactgagaatacagcaggtattccagaagtgtgagccaaatcacatgcattataccacagtacaaagaaaccttccccaagagtcatggttgagaattacacagcagagattttccacatcacagaacagagtagactggcttgacttcatgatatttggatacaaaactgagaaaattagatttccaaaatatattattacttgaatatgaaaatatcttttttttttttttttttttttgagatggagcctcgctctatcgccaagctggagtacagtggtgtgatcttggctcaatgcaacctccgcctcctgggttcaagcgattctcctgcctcagcctcccaagtagctgagattacaggtgtgtgccaccatgtccagctaatttttgtattttcagtagagacagggtttcaccatgttggccaggatggtctcaatctcttgacctcgtgatccacccgccttggccgcccaaagtgctgggattacaggcgtgagccactgtgcccggcctgaatatcaaaatatctttttcgaattctgtgacagcccatgaccccttcaccagagcaagccaaacaccacttgttttcgccaaagagacaggagcaaaaggttctggtatttatcatctgggctttatctttttctggatagattatgaaattccagtgtattccagacaggtccattttcatggaaccaaccactgtcttccctaaaagcataacagcatcacaggcaaaggtcccaagataatagaattttatatatcaggctggctttctaagagaagtcaataaaatccaacaatgatgggaaatgcaggatgtagcagagatccttaaaagcaattagcagagagcagggatgaaaagcaattatgcaaacactagaacactaggacattcaagactttttttttttttttctttttttttttttcattctgtaaggaaaggacagatccctgctttggaaaaagaatacaaatgtgcaggtttgaaagttccccattaggtgcatctaccatttctattatattcaaatactaagctttttaggacttatattaaactccataatcttaatatttatgaccacaacttaacaattaatcaaactattaaacactaaaagagtcaaaggctgagtatgggtggggcaagaaaatttttttttttgagatggagtctcactctgaaacaatcttgaaaagcctccagaaggtacaaatttgctggcactataaaagacaaaggcaacttaaggaggttcaaggaaaaaggaaaataatgctaagaaagagaaaacatgagagaaggcactggggccaataatgcacagagttcagatactaaatagtgaagtgatccattcagcctagaagaatgttatggtagaatggaaaaatgcaagtctttgactctgagagccctgggttttaattctgtctttctgtgaccttgggtaaggcatataacttcactgagattcactctgagcacccacaaaatgagggcaacaatagctatcctatgaaataggtaactaataaatagcagcaatatttaataggcatgcaaattcttttctcttcccttcaccaagtcataataaacctgttctttaattcaaaatcaatatggccaaagccaaattcacaacatcttctcacaagcttcccttctcaaacagcctgtcttatcaatcgagccaccatgtctccactgacccaggcttggaatgtctgactgatagctgcctcaacttcaccttcaaaacaaatgtctgctcaagttatatccctccaacacgattcattttgacctctttatccctgttttgtcaaccacaacccaaatctaagtctgaattattgaaaaagccttccgtccgacccatgtgattcctacttttctccccacaaattcatatacctcccactgcttagcttatctatttcgaatactggtgtaatacatcctggtgatggctccctgtttcctactactcagtgatatattcatccgttcatccaataaacagttactggatatccaccaaataccaagtactgggctatgtattggaggtgcaaaaatgagcaagtcatgcctttgaaagtccagtggggagaagtaaacagatagattataatacaatgctataaagaagagatgaaactagaaattcgctttataggttgaacgagacaaaatctcagatcagagatggtgctgtattggaacagcatctcaagagaggagaggtgtttgtcaggcaaaaaaatggaaaagggcactattctttttcaaaggcacgtacacaaaaaaatcctgtgttttataagtaaaagacacccccaccaactgtagaggaggttgaatggatttcttgcagcagtgagtgtgtaaatgagtgactagctaggatgcaagactcccctcctttgaccaagcaagtaaacaaaggatggattcttcatagaagatgcaatggcaacaggtgacaagtttctttgggcaactactgagtcagttatgtaggtaaaggggtagagattcaagaatcaaacaaacaaaagacaacaaaagcaatacaatatttcagacacagaaccccactggccagagagagagacagattttacccctcaatgacagtgaacacagaacttagaccatttgaaataaaagttcttaccatatctctcctgactcgtacaaacaccaaagggcaatagtaaaggaggataaatctttttgagggaagtgagctgtactatctcatatctcacgggaatccattcatgagaaagtcaaatccagaagtctgttccacttcagctctcatttacaaaaaaagttttctccttcctttcttaaatcaagtgacacaagtcaactcaagatgtgcagcatcacatcgtcactcaaccaaactgtgcacacatcttctgccatgggtgtcaccaatcttaaatctcagtgtttaatactgagatttaaaaaaaaataattttattgtgtgcatttgaagtttatagcatgatgttatagaatatatatagatagtgaaatggttactaagtgaaccaaattaacatatcatctcacatggttatttcttgtgtatgacaagagcagctaaagtctacttccttaaaaaaatccctaatacaatacaattttattaactccagtcctcacattatacattttagatctttaaacttagtaatcctatatatctgctggttgatattgagatacaatacttagaagctaaaagcttatcaaacatgaaggcttttctgttcggatttttttttggagagggttaacaaaatgtgttgttttaatttcattttcagaacaaattaatttatctcaccacactttttgtttctagcaagcatgacaccactaggtatgagctgtgtgcttattgtggataaggacagtgtgttagttacctctttatcccatcacagtgtctgccacttaagcattcagcaaattaaatcatcaacatgagaaacatgagatacatttttatcatgtacatgagatacatgtcctgtatttttatcacctacgtgaacagagctgaacacctcacctattcaatagtaactccaattttattaactttcccttgactcattttcttcatcaataaaacgtggatcagattgccttccttatagagttatagtgagggataaacagggtacagtatacaaaaagtcaaatgagtcttcaataaacggcagacaaatcccaaacaaaaagaggggcaaaaaggcccgtgtcagagaaatcagaagttaaatcaccataacaatgaccataagcagcagagaacttcagaaggtatccccagccttttggaaatgtcctttaatttcttcatgttgggtaaatctagcaattgaaaaggaaagacgctgttaagttcaaatgtggatgttcattataggagctgaatgagagacaggtaaaagtttccagggaagaaaaaggcagtatgcaacaaagagttgggtatcaaaaaataaaaataaaaagaggtgcagaaaacaagctccttttcttctctaaattcgtggtgctcctatccaggtcggcaaccccacatcagtccttaccattgctctacccagtttgtgtccccactgaatcactccccagctccaagtgacgtgtgtgtgtgcctatgaagttttaaggaaaaattacctataattttgcttgatctttgtgaatctctgtagcaacacggaaaactgcttaacttttcaaaacaaatctaatcaccttatcattcttttatttcaagtaatggctacaatgtattgagcacataactaagcactgtatgccagacactgtattaattgctttatatggatctcatttattcccacaactctgacttgtatactgccgctatccctgttttacaggtgagtaaacctggagatgtggagtggttacatcatttttccaaggttatacagctagaaaataagtggtagctagaacttgagcccactgaattttaatggtgtcactgtaaagcctctgcgctgtgtatctcctgtccccatcactccccactctgctccactgtgctctgtaccccaggagtctggcctccgtgaactccaacaagcttccctggcccccctggcccccctggcttcagtgagtttgtgtgatagactccaggcaggagatgagaaggagggaagaacagttcaggatatttattcctcttggtccttcctggaaggtcacctcagtctagcttcctcaaaggacggtcaccatcctctaaaggcaggctcttctccacacttctgtcctttgaggttcccacaactgctacctccccttgtccctaggtcaaggggtggtcacagctctgccgttactcatcccagtaactcatgcagtcactataacatcatctgtggtttccctgcacccagcccacaactttgtaaacagtcccattgtaaatatactctttaatatatgctgatttgaatgtaccatctggtccctcttggaactctgatacagcctttctaataatgcctttggtctaggaataacaaaataattgttctccagtcattccatgcttttctacacctctgtgtgtgtgtactccatgctgctttcaagtgaaatgctcttcaccactttttctgctggaaaattctaactcctcctttataacttatgaaggcagttattttattcaaacctcctttgaccccctccttgccatgggcaaaataatgggctttttctatcatactctgtaagcacctacaacttagacaatacattatactgtatacatgtgagactggcaaaatctcagcatgcaccactgtacctggtatgcagtaggtaaaacaaatgatcactgaaggcttgaatgaatatattgctgttacatatattctttattctgttctacccaggaaattaatgtcacaggcattccattgagcaacacagaaggctatatgtgtacatgctggttcattctatgtgccaatttgactgagctaagagatgcccagataactgataaacattatttctgtgtgtatcagtgagggtgtttccagaagagaatagcatttgaattggtgaactgagtacaacagatatcctttcctaatatggatgggcatcatttaatcaactgaagggctgaaagaacaaaaaggtagaggaagggaaaattcactctctctgcttgagctgaaacattcaccttctcctgcttttggacactggcactcctggttcttggaccttgggcctaattagattaaatcataccataggctttcttggttatccagctttcagagaatagatcatgagacttctcggcctccttaagtacatgaaacaatttcatatatatgtttgtatgtatgtatctatctgaatatatatatatatattctattggttctgttctctctcatatattattacatataaacagaacattatatatataatactaagacctatatatacagtatatattatatatgtatttaatactatattatatataatactaagaccactaaaattgggatctttctggaaaatcaaaattcaacataaatttattatttctttgtaaaaatgcatatggaggagagggaaggcaagttaaccagatatactttgaatgtaaggttacatgttccctttaatcacttgatttactgaaaaaatacatgcttaaacctttgaaaaaggaaagttgtttttcagtagttcattatatactcactgagttttaaattctatcacaattcacgttttaaaatagatcttaacaccacacatatttacattaaaatagtaactgagtcatacttacctaaatagcctaatgactcattaaaacaactttcttttctgttaagtcatatttcttccttcataattcagttctcataactcattagttatttccaaagaaggatgtatcacagtcatagaccacttctgttcttagaacttaggaagccatctctttcagatcaaaatatctaaaatttctatgaaaattttcaatgatttaacatcagtgttacgtcttaagatttattattaagacatggtttctcagaaagtcaactcctggtctagtgtttttaaatgatttgactctgaatgttcagtaactttagttagctctcaattgatttcattatggaacatttttcttcctctcatgaaaatacgtaacaacaaaatatacctgattaacaaacagcttgatccatgcagcatgtaacattcatagatgctaatgcctctttgaagcatacttagtatttagaaatcattttgccttcattgaatgaccaaacaactggtgttcaaaataaaatatatgcctgactataataatatggcaagtacatatttgtcagtaatgggtattgctttgcatgatttatttttgttttcagaaaatgagtcctcgagaaatcctacaaatcactttccttgcatagaactgaattttggtaaaaggaaaaaggcgctatgttcagtccctccgcctttttgagatggagtctcactctgtcacccaggctggagtgcagtggtgcaatctcagctcaatgcaacctctgcctcctgggttcaagcgattctcctgcctcagcctcatgagtagtagagatagggtttcaccatgttggccaggctgctctcaaactcctgacctcaagggatccgcctgccttggcctcccaaagtgctgggattataggcatgaggcacagtgcccagcctgctaaccccttttcacatgccatctcatttgacccttgctatgttttgaatatcccctccaaaattcatactgaaatttaattacaggaggtgggacctctaacagtgattaggttatggtgctctaccctcatgaatggattaatgctgttaccacttatcatgggagtatgttagtgatgttgggaatggctatgttataaaagcaagctttctctcacattctcttgcccttctgccgtccgctcccctgccatgagattaacctcaccagatgctgacatcatggtcttggactttgcagcttccagaatcatgagctgtataaatctcttttctttataaattacccagactgtggtattgttttacaacagcagaaaatggactaagacaatcctatagacagcaaccctaccaaagtcagaaaggctaagggactagctgaggctctgattcctaatcccatgtccttcccattaaatcattttgtcaacttatataggttgaggctatacctatgctaagtgaaaatatccatctgatagattcaacttgagattctactttgccccattatatttgttctctgaggagagtgaagaagaagaaaaggagaggtttttgtgttaggccattatcaatgagactcatcaatactcaactaatctataaaatgagctcaaccttcccctaagaatactaaatactcatagataatgggctggccctttgattttaattctcagaggatcagtgtttttaatgttttatcattagttcctttcaattaagtcaggtaataatgctgcctggacattcaaacccaaatgaatggcttcaattatcccagggtctatttctcaatcaggagccaaggccctgggaccaaatagctaacactcctcaaagtacctctagattattttctgaaaagaattcaaagattattacattttagtgaattttctagagaatgcactgtttttattaaacgggagtttttgctaattttgctcctttctaaagatgttggaaagtctaagaaaactcttactcaaaaacgaggaagtgggaaaatctcaaactaaaccctctcagattatgttcttactcaaaatacatttgatgtatttgaaacacttgatgcctttatgaacaaatttgccttgatttattatgcaaagtcataattagctattttaattcattaactgcttgtttttaaaaaatatccaatttttaaaaacaacaaagcaaaagttacatggtatgacctatagaggttttacagtggatgaattttaacaaatgtatacacacatacaaagctctaatcaagttatcgaatatttctaccactctaggaagttctccagtgctcacctgcagtcaagctccaccactttcatggaaactgctgttctgatttctatcaccaaaaataagttctgcctgttctttaaatcaatataaagtatgtacactttggtgttgaacttctttcaactatttagagaagtccaccatgcacttacaggtattagaaatttttcttcttataggtgaagtatcttttattccatgaaatgaaaatccaacattttatctatgcttttgatggactatcggattatttccagtttagaatctttacaagtaaagtgactatgaacatttgtgtagcaaaacttctgtggatacatactttccttttgtaggggtaaataccaggaaatggaactgtaaaatcataaaacatatctttttaaaaaaaaaaaaaaaaagaaactgaggaactgttttccaaagtgattgtaccatttcatactcccactagctatgtttatgcatttctgttattccatcatcttattcactggatgttttaattttagctcttcaagtggatctacagtggtatctcattcctgttttgaatgtgcactttcatgataaataatgatattgaacaccttttaatggacttattggcatttgaaaaaacatatatataaatatatttatttctttgggcactctgttgaaatatttcaccttttatgttgccttaaattgggttattatgaagcattttagaaatatatatacatatatacacacacatatgttctgcatacatgtcttttgtcagatatatatatttcaagtattttcctccagtctgtagcttgcctttttattttctcaactgggtcttttgataatcagaaggtttttattttaatgaagttcaatttattaacttattttttcttttatagctagtgctttttgtgtgctctttaagaaatctctgcctgagactgtaagatattttttctctaatttgttatagaacttctacagtttttgcatttatatttaagtgtgtaatacatctcaaaatagttctttttcttagtcttttttttcctgtttagataatttctattgatatggctcaaagttcactgaccttttagcatgcagagactagttggctgttaactccattcagtatatttcaatcatggcacttttcttttctctttgtttttttttcctgagaccgctcactctgtcacccaggctggagggcagtggcatgttcagaactcactgcagtgtcagcctcccaggctcaagcaatcctcccacctcagcctcctgagtagctcaaatcacaggtgtgcaccaacacgccttgctaatttttttattttttgtagagggggtctctcaccatgttgcccaggctggtcttgaattctaggatcaaacaatcctcccacctcagcctcacacagtgctggaattagaggcatgagccaccacacccagccatggcactttttgatcctagaatttctatttgatttttatagcagtttttaggtaagattcttcatctgttcttgaacagcatccatgttttcctttaagttctttaacaatattattatagctatggtaactctaatatcttggtcatcttccatctgtttccagtgactgcttgttttcttcattagttgtcttcttcacttgtataataattatgaatgatatatcccaaggtgtctggattatcttttcttcccttaacatattgagtatttttgtggcagttaaattattggcagattctcttgatcctttcacgcttgcttttatactctgttagagtgggcctatttggttttattcttcattttagattgtgattctcctaaggtaggtctccttctatagccccaactgagcttctaggctgttaagcaagaccttctacactggctgcgacaggactccaatatctctcagcattgtgtgaccttcagtgcctctgttaagcattcagttctgcagaaggcaccctctactgtgtcttacagagtcccactctgtgaatatacagcctagccactggccaatggcacacaaggaaccctcattaaaccaatacaaagacaagttcaacagtattttacagaaaatcttttaagccaaagagaaaaacagtcatgattaactatgttggcaataattttaaggtacataaaaaaagatatttgtaacatatctgtattatcctaatagacaaaagtatccgctataggagtacatgattcgctgcctatgtccgagagctttgaatctcaattcctcacacctggtgccattttactcataatatgtaaaaggaagagctgctagaaaaacttacgtcacctgtgttaagtttatagatatacacttgaattaacaatatttttggccaagattcataaatacactttatgttttatgaagcccaattcagttagaacttgaggtcaagcaaagaaatcaagtgtaagagctgacataaaaacaggtttccttttcaatacactttcagctatcttagaaattaactgttcggagtgtttttctattcatactccagaacctctcgcccaataaaattatctcctcccagggctttcactagtgtcaattcactaaagatgcccgtgtcaacatttcaaggtcgcgcctcctcaagagtttaaatattcatctagatatccaccttgaattcaaaaaccccacaacagaattccttctcttgttcccgcaaaaatctgtacctcttcctgaatctgcattctggctgcactatgtacctagtcaccgagaggtggacttatacccctcttctctttcaccctttcatctgtctgatgcatcactaagccccaagagcttcctcctttaattatatctgaagtttgtccctctgtttccatctctgctctaatgcaattttttaaaaatcactcactctattcccacagccttcaaactggtctcttccctcctatccattcacaacacagcttctaagtgctcttcttaaaatactcatttgataacatagtttcctgttttaaaatgtactaagtattcccacacatctctagaaaaaagttcacattgcttttgtgcctctcactgccttttaattcgcttctctaataatttacatcctagttgcccagctacaccaaaccagttgaaattgcttggacgtgtcatatggtttcagaacctaagccgtttgcacaaggcaaaccatccacatgctcatccttgggtctcagatcaaacatgaacacctgagacagaagactctggtttttctgaccgctgtgttgttccaatctgtttattttactggactctatttgaaatgatccatttgtcctctattagactgtaaattccctatgtggagggagcataacaaatatatctttattctcctgtgtctagcacaatgcttcaccatatttgcaataaatcagtgtaaatgtaattgggatatccaccaccttaaatattcatcttttttatgctacaaccattttaattattaaatattttcttctagcttttttttttaagagatggggtctgggctggagtgcagtggctattcacaggcgacatcataactcacggcaaacttgaactcctgggttcaagtgatcctcctgcctctgcctcccaagtagctgagaatacaagctcatgccactgaacctggctctcaagtagtcggtttttaactaaaaatatttacaggttactacaaggctcttctttttatttttcaatcttactggaatgaaaagcaataacttctaacattagagttatcattctgctctatgatgtaacttagaaaatataataaaactgcaaatctatttccaaagcacatttaaaaaatacccccagatagctgagcattcataaattgattttatggtcatttgcaaaggtagcaggacattggggaagtaaagagagagagcaatgattgattatttgagaagttaacctcattttagcagatttttgtggggttttttttttttttttagctcaaaatgtttatctaacagataaatcaaatggagctttctgtacatacctcattacaattctaatttattttcccaacagaatcttcacaattatgtaaaaattggcacggtcctgctagtgacacttcctattctttcataccataaagcctgagcttataaacaagctgcagagagaggcattttcattacatacatcactgcattgtggcggtatctccagaatggcttaaatgcatcatgtacttttacccaaatggtctctgaacaagagtgttggaagagatgtcagttcttgggccctgacaatgttgtttcctagcctaaaaagtctgagaaatgtggaatattcctacctccttctgtgagaagtcagaaaatgaagagacgtattcatctttaagccaaccttccaaatttacctgagcatagagcaccaccccttcaccaccaccctcttttctttcctttggaaattcttattaacattctataggacatcattggaaggttaatctgattgtggcacatccataatttggctatttagaacattatgtttaaaaacagagttaatgtcatgagtctgtctgcttatctctatctcattgtattttccgcttatcttcctggtttctttttcttcctgaatctccaacacatgcccacacttggattttaaattattggtccaagacaaaaagagtcatgagtacaagttcgggccgatctacttcaatgaacaaacaatcgaaagctctttacttcctgatggcaaaaatatataaaattagtgacatctacttcagtatgcattaacctctttttaaaaagctgcctcctttatcttccattctcaatttgctttaggatgtcttttatttcttccttatctatggctcctactttctcacagactttttttttaaaatgtatttggaggctgatatgatcagtgtacttcctctgaaattaaagtttcttttgatattgagttcagtatattcagagtggaaatcaaatgacttaggctggttacaaagatttaagttaatagagatgaatttaatccactggtggtgtgttcataatcaaatgaaggactcatttctgttctagagcctaccaaataaaaatgtcaaaataattggattaaaatcatatgaaatttatttatttattcaacaaatattaaatgtttttatgtgccagacaatattgggtgatggacatactgatgttaacactgagaccctaccttgccttcaacagcctctagtttagcagagaaggcacacattaattctgtatttgtgtgtgccatgatctgattgtaattgtgataaatgtcatgggagagatgatagggctgatacagcccagtccttgggtggggaggctgggtaaggatagggtcagagaaggatgacctgagaaagtgacgttgaagctaagatataaagaatttgaaaatggcttggtaaagttctagataaatgaaacagcatcaaatgcgaaggttgccacatttgagatgagagcaggtcagtgtggttgcagtacagagagcaaggcacgatagtgtgagactaggcagagaataagcagagccaccatcataggagctcagaggccatcttaggacatcagaactttctgttaaaaacaatgggaagccaagaaaggtttttaaagcaggaaatggacatgatcaggttgagtgtataagccgtctccctagctcagtggagaaagcagactcatcttggtggtagtagggagaccagcaattgtccccaaaatgtccagtcactactggcaaaagcacccctaaaaaacatacaattgaggaatgcaaggtgcaacttcattagaagcccctcggcttacaacgtctatctaaccagaatgccattcttaaatcgctcctattcctatttcaaacttctggttcaaacagctctagtagccatggaagaaaagattaaaggcagaaagactggtagcagaaaagccaataaggaggttttagcctaggcacttggttctggtggttcaggaagtagagaaaagtcaattaaaacaagctacacagaaggcggaatctctagtatgtggtgaatctggttattgcaattactacatgtatctttttaaaaaagtaatggttttggttcctcttgaaatttacatgacactggaatatcctcatttctctgaattatttttcttacatataacacatatatgacatttgaccttgtcagatgcttaaaacagaagaattaagccaagaaatatttctatcaatctcaagtcttttaggaacctaactaaaggagaattaatagtttaattataaacaattctttcctgatcattttaaaagacccactgagaatgtgtgccaggcaaaatagtctagttttagttactttttgcaacctaaagtaagaagtctctatttttttaaacaatatttgatgacttagggtgatccagaattaatttcctccgctgctaatgcaattctgtaagtttttactcaattctactctgcatcattaaacaggactaaaagctttacatttagggaagcatatcacttggaaaaaaaacacgttaatgtgaattataacaacaaactttggagactaaaggcatgactagtaggatcttccaccccagattttttatatgctaagaaaatgaagaaagaagcacacacacatactagattacctacaacacggcctcttaggcaaagcattgacatttatgtagaaggacttcaagcgtggagctagagaatatgcatattcaagtaataatttgattttaaaacctgtgcagcccgaagtcaagatcaaattgcatactcaatttttccaccaacatttagaatattttctcaacgttgagacgtgataatagttgtgtggctgtgtgttttttaaaaagtctattaagtagaagagactgctaatcactgaaccagcccttgcagttttctttgctgctctacagtcagttaacaggatattacaaaataaattaagaataagaaacaggccaagttaatgcacatgataaagagttgagtcagggaaggtttctgcaatatttggagcctgaaaggagagactctaagggtagcagtggtgtatgataatgagaagagggagagaaaaatggtaaaatactttatgctcttcaagaatcattccttttgctccttttgaaaaaaaaaaaacaaaaacaaaaaacaaaaaaaacactttcacggtagcaatttttaaatgcttttcaataattgtgagtgccagattcatgattctgtataggaacatcttaatgtaacatccttaagtagaaacccagtagaacttggttttgtatcattacatcaatattgaaagtatagcctgggtgtggtggctcacacctgtaatcctagcactttggaaggctgaggtgggaggatcacctgagttcaggagttcgagactaccctgggcaacaaggaaaaaccccatctctactttaaaaaaaaaaaaaaaaattagccagatgtggtggtgtacaccagtaaccccagctattcaggaggctgaggcacaagaatctcttgaacccaagaggcagaggttgcagtgagcagagatcacgccactgcactccagcctgggtgacacggtgagtgagactctgtctcaaaaaatatatattgaaagtataaatactactataccattttaaagtacacatacatagaggagtagcaataccattctgtgaagacaactggttagttgtagttactttcatattctggagctgtcttctgcctggactattctcccctcaatcacaaattttcactgggtcagtgcctgctcagatatcatatctaggcttaatcaactgttctgtagaaagaccttcccagatcctatagatgcaatgctgtcaaacagagctctctacaacgataaaaatgttccagatgtgtgttgcccaatatggtagtcatgagccacatgtgaccactgagcacctgaaatatggtagtgtgcctgaggaagtgaacatttaattttattcctttttaattaattcaaatttaaattaaatttaaatagctacacgtggttagtggtttccatgcagaagcagaagaagacagctcctgttcttctatttcattcatattctgtgtgtccccttgtaggacttggcatatttgcagttacatagtgtttaaaattatttgtttaatgtccatctttcccactaaattattgagattttaagtagagtaactaggtctgtcttgatcccacaaaagcccatgcttgacaccacaagcccccatgcttgacacatagtgtctattcaaagagctgctgacttaccatttaaataaagcttttaattatcttaaacatataatatcagatattaataagttggttaagtgaataccaaaggttcatgttagaagactggaatactgtttacaaggtgtgaactttctggaaaagtccagaaaatgccaccagaaattataaaaatcagtggtaaaatgtggttgccacagatttttcataaacacaaacatacatacacacacacattctcaaaacacagctgccttcagcaaaagagtcttctattttgctctaaaatctgttgtggttgtgaaaatgatgacacttctctgcaaaagaaaaatttcaatgcaaaacaaactcacaatttagctcaggatgtatgaaaaagttgacacaaagaagctgtcctttcctggtttaaatgacacattttatctttagattttggtagctaatttttaaaaaaatcctttaaaacgtattaccttttccagggacaaatgctctataatgttattctctgccatctttgaaaatgaaataaacatttattaaaataataccatacacgacatagatatttttaatacccccattggaaatggtggcatagagaagtggacagtgtgtataaagctacgaattccagagaacactggttataattcagtgggaaatacagttagtttgtcattgtttggctgatttgttcatccatccatttatctctctctccatatgtaatgtttatcctttcttactttactaaaataatatctttcatcatgaaactcacagtatgctaggaaagttgaaaaaatacacaggtgactgaaatataagcccctaaagaaagctgtgttcaggagaggcatagagttcatccttggaggagccatttatatgaaaacagttctgtttacatgcaacagagaaagccattaagcttttttttttttttttaatggagttttgctctgtcccaggccggagtgcagtggtgcgatctcggcgatgcctcagcctcctgaatagctgggactacaggcacgcaccaacacgcccagctaatttttgttttagtagagacggggtttcaccatattggccaggatggtctcaatctcttgaccttgtgatcctcccgcctcagcctcccaaagtgctgggattacaggcctgatccaccatgcccagccaagaattcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggcccagccaagaattcttaagaaaatatcctagtgagagcctttctttttaatcctgaaatgcatctgattgaggacacagggtttagggagggggcacaaaggaaaactgaacagtacatatgtgttgcataaattcatggactaatgattaggacaattaatgaatggtttaaatatgttagacgaaagctcattttgtaatgttctgaaacacatgaagcaatgtgagagactattattttgtttgtttgtttgtttgttttttgagacagagtctcaccctgtctcccaggctggagtgcagtggcgcgatcacggctcactgcgagctccacctcctgggttcacgccattttcccgcctcagcctcccgagtagctgggactacagacgcctgccactatgcccggctaattttttgtatttttagtagagacggggtttcaccattcacaggatgatctcgatctcctgacctcgtgatccgcccgcctcagcctcccgagactattcttaaaaacgcccatagtttccacacaaacaggctgattatgaagagtgacagaaaagccaacaattgtaacgtttgcctaaattttcttcaggtatgttcctggtttttcaggaggcactctgccttgcagatagagcttacaaaccaagaccatcagggtacatgtggcactttcatttttcttctcagagtagatctagagacatttaaattaatcatttggaggttgaaataccaattccttggtatttcaaagataatgtgccaagtcctattatcatttagcaataatttaaggaaaggaagtatctttcaaaagtacagaacaacctacacagatttaacatgtcaaactaatatgataaaattattttgctactatggtaatttcaagatgggtgtgacattttgcttttttgtcttctaaaaaatgaaaaatgtctttgaatcttgttagcaatgcctgaccttcagacacactggccatgccagggatgcagagttcacagtgattactcctacatgtacctgggcccaaaggccaagcctaggaggttcatttcattatcataaagtaaggtgaaaaaagatcaaacgtggattcaaaaaaaataaagcactaacaaggaggagaatatagcccgttgcaagcactacaatcaagtaggtggtacacatccccagtccttgaagaattgctcatgtgccctgtctaaaactggttttgtagactctgacttttgtctttggttgcacaatgatgaagaatcaattttatcccagaccagtgaaaatgagagcacattactactatgaggagaaccgctaaaggttaattgggttttagatacttagccctaattgttcaagattttatcataatatcaatttctgcattaatgcaaggcaccctgaggccatatgaaatagatttcattctaaatttaaatacatccttccatccaaaaagagaagcattcttcccagataattcccacaatcagaatccaacttcctagatgaaataggtcaaattaaccaaacctcccccaaaatattgctttcagtcagtgatgactgacataattatctagttaatcctaatacttagatacttaatgtagataatctgaaacattaattaaatatgaaaatacgttacatgatttttcctgggaactatattttagtaacactaacacttctgtttaagaagttagagatagttttctttccataactggaacattgagtactgttggttcaacaggaacaagtttggtatgccatttatttcggtattcagagcaggtcattaccaaaatgaaaattaccttaagtattgttaagccattagggcacagttttgtataatcagacaacatcttaatagatactcctatttattgtcacaataaaccatctgttaagttttagagatccatttttgaaaaaaggagatacctagttttcagaacacctggtataggaaactcttaatttacaaaataaatgaaattgagggagactgatgtgcgttgcaaaagaatacctaggttgaagaaaaaacaaaacacctacctaaatattctttgaccagtagtatctctagggcttctgtgtttcaatttacaattttgtttaacatataacctttaaggtattcaaaaacaacagcatcaataataatagctaaaatttagacaggaggttatgtgatccattcactattctagaaactttacatttattatctcacttaagcctcacagcaatcctaaaaggtaagtgctgatatagtttggatgtttgtccctttcaaatttcatattaaaatgtgatccccaaagttggaggtggggcctggtaggaggttttaggtcatgggggtagatctgtaatgaatagcttggagccctccccatggtaatgagtgggttctcactgttagttcacacaagaggctggctgtttaaagaagcttgtcccttgtcactctcactgcctcttgccatgggatctcccagctccccttttgccttctgccatgatactaagtttcctctggcctctgcagaagctgaacagatgttggtgccatgcttgtacaccctgcagaaccatgaaccaaacaaacctcttttcattataaattacctagtttcagatattcctttatagcaacataattggtctaacacagtcagtgtcgttattttcattttacagcgaggatactgagactcacagtaacttctgaaggttgtacaaccttatgggaaaaagagggtacagattttaaaagcaatggattaaaatgagtactgctgtgaatatctacatgtctccgtacacgtccaagtttagttgtctcactgcatgagtattttccatcttttcagacctatattaaaaatgcaagccaaatatcgattattatcattaccagtttctaacacccctgagcattttgacccggtaaggcaaagatgaatatttcttagaccattttatccatcataggttattctaccagtgaatagctgtctgatatcttggtctcaacatgactagaggctttacaagcatttataaatcccagtaatagtacatcttcttgagtggctgcctggttccactatgcgaacatcatggcaaccgcgtaacaaaaaagccacacagagtgttcctagtacttactgatatgaccaagaccttgtagcctttgaaactccatgatttttaacataaccaaaaagttcatgaataagagcttggtgcttcatgtcacatataaatgattttatattacccatatattgtattcccgcgattagccccaaagatgcctccccaatttagcagaagtatattgcttaggagggaacatacaaacaaaacaggctgggcacggtggctcacacctgtaatcccagcactttgggaggctgaggtgggcagatcacctgaggtcaggagtttgagaccagcctcgccagcatgttgaaaccctatctctactaaaaatacaaaagttagctgggcatggtggtgggcacctgtaatcccagctacatggggggctaaggcaggagaattgcttgaacctgggaagtggagattgcaatgagccgagaccgtgccattgcactccagcctgggcaacaagagcaaaactccatctcaaaaaaaaaaagaaaagaaaagaaaagaaaagatcattagacataaaacaacaaaaaaaagcacatataaagctgttctattgctcagataatatttcaaagaacaggaaagagaacatatttaaaagtatatatctgcattgactgccaatctctctttcgatagtagagatgactatgtttgatattaagcttctgtaaatcaggctttcctactttaactttctagtatcaactggtatatacaatcattactctttctttccttttttgttttttttctcctatcctctacatggatagactagaggcttaatagtgtgatgataatggctctgtaactctgtaactctgggtatggcgtgttcagaacacccacagtaaacaatcccaaatccaaacatgtgtctcagaaaatgtgtctcaaaggcctagtgctgtgctgtccaatatggtaggtggtaactacaagtaggtatttacattaaaattaaataaattaaaaattccattccttagccacatttcaagtgttcagtagccacatatggcttaatagctactatactagcacaaatatggttccattggacagtggctagcctagagtaacattttctaacttaccaccttgaccagggtttaaatcaagaccagccaatggattgtgcctcacatgtacacctacttaattttaattggcatcctggagtagaaaaaaagtacagtgtttggaatagacatctcttgcggacatagaattgcggagtggtgcccacatacaccaaacatggctcataagaacttgcattagcagcagtataaaactacaaaatactaaaaatgcaacaagagtgccacatctcataaattacacgtgtctttccacgtgccatttcaaaataagccatgagcgaagtgtttttcttcaggcatacagagttaaataaagtcctgaatacgatccgtaatcacaatctgggtctaatctgagacaattcatcttcttattcattaaaccagaaaacttgtatgaattggtaatacaagtaacaccgataatttttttaaatgtccattttacctacatgtgaacctgatactctgaaaatcactgttgattcttgtcaagtaaacaactatgccactgataaagctccattcttgagtccatattattccctgatagaacccaataatctaatcagaggtttttttacccccacttaggaattgttttttggatactgtgactccaatagggctttcattaactaaaaagaactgtatacaacatatcaaatgcagcatctggtctagtctgaatttctaaatgacaagcacagcatgcatttggaattacatagagaacgagaaatcagacctctatcattagcaatctttttccccaaacactgcttccacttcatgcttcaacacctttaccttccacagacctcttggtaatgtcacgactagcttgtcaaatcaaattcagcagcacacaagcatctgtattaatacttttgcattttcattcactaggaaaaaacaaactctacttagtaggcagattagccattatctactgtaactctaaaccatctgagttacattactaaaatgaattggcattgaaaacagagcgacagaaatgtttaccgatagaaaaatatgtagggaatgggagtttcttttgcgcttacttgccagtgacttcctaaagctgtaatgaggtcaaaataagctggtttatttcatctgtgaccactgggtgagatctcattttataatggccttaataatttgccacttatgattacgataataacaatattttttaaaatcactggaaactttaattaggtatttccaaatcgctaggggttattaaccaagggtcaattttgctcccccaacccccacccagaaatatttggcaatgtctactgatatttttggttctcataattggaggtgagagtgctactggcatctagtgggtacagaacagggattctgctaaatatacttcaatgcactggaaaacttcctgcaacaaagaattatcccacccaaaatgtcaacaacgccaaggtgaaaaaaccatgccctaaagctacatatgatcactatcatttaaatgattattccaggacttctatggacatgagctactgaaaaaaaaaaatcattttgtctttcacagatgtcaagcttaaccaagtccatgtgaccatttagagagttaggaggtacatctactataaaaatagcatttttcaacagaggctattttgttatttgtttcatccttattcatcctgtctctctaaacaacagcaaaatttttaacccatcatcaacctttaaatactgttgggtcaagttctcactgtcaaaaaagacatattaattgcaaaaaagcaaaaacatgaccatctttacagtgctaaatcacttctggaaaatgtttatgtcaaaaatcagcttaaatttttggagataggacaggcgcaggtggcccatgcctgtaatcccagcactttgggaggccgaggtgggtggatcacgaggtcaggagatcaagaccatcttggccatcatggtgaaaccccgtcgctactaaaatacaaaaaattagacgagtgtggtgctgcgtgcctataatcccagctacttgggaggctgaggcaggggaatcacttgaacccgggaggcaaaggttgtggtgagctgagatcacaccactgcactccagcctggtgacagaccaagactccgtcttaaaaaaaaaaaaaaaaattggagataatttttaatagagactattactaatctaataataacttccataatatcttaagtttcacaacagagatgatgatataaagtagaattaagtggcagcctaattattaatgatgttctttgcctttgagataatccagttatacactttaaaggtttggtatctttagccccatgcgaggagagagtcgtatgtttttctttctctcacacacactccaggaaaggaaaagcaagcacagtagttaacccctgatagtttattagtcattcttgctttgtcgctttattaccacgaaactggtcagtcatggacataaacaaaacgtgcaaggataaggcaggctttcactcacataaaaactgccaagggccaaccccattgtgaatcactacagaaaatcattacaaaatcttaaaacaacaacaacaacaacaaaaacccagcactttgaatcatagtatctcttcaacagatacactacaaaactttatcagaaacactatgtgagagatgaacagagctaggaggtattttcacattagtaaaaaaaaaaaaaaaaaaatctcagaaatcatttatataaaaacctattgtgagaagtctaaatttacgttcaatgccttccctttctttcgctctatacagttttaaaatatgttcattttgttctaactgcacagtaataggcatggccttctaagcagaaaaaatatattatggcaaggaaaaatgaagagatacgttgctaacacaacagacttttgttaaacaattaagaggaaaaaaatgcatacaatatagcatttgctatataaccataacctctcccattcctggtgtcccactctgaattctacttgattcaacaacttaagatgcaatggaaataataatgtctattccagcagattaaaaaatacaaggcagcagtaaatgttatgaccaccagctaatgggctatggtggagaagcatccactgtggattaagctctcaagtactcaataacttttaaaaatgccttaaatcacccacaaaatgcagtatacatggctttgtgtatacaactgttaagtgtacaaatatacatcaggtgcaggaaatcaaaagcagcctttgtgaaaacttagttttatagtacttattactacaaactagacataaaggtgctgaataaaataattaagaaaaaggaaatagcaactttgaacaatcttataaatcattttatataagttagttatccttagagtatgtatactataattctgagttaaatatttatataatacaatttttgtaactgaaacaggatctcactttgtcatccagtctagagtgcagttgcacgatcatggcctactgcagccttgatctcccaggctcaaaggatcctcctgcctcatctacctgagtagctgggaataaaggcatgcaccgccatacccagtgaatttttttttctggtagagatggtgtcttactacattgcctagactggtcttgaactcctgaactcaatggatcctcctgcctcagcctccccaaatgctggaatgacatatgtgagccactgtgcctggtccatataagattttagagtattactctaagagattaaccctaccctggggaatcgatgtcaaaagttgggaatatctttcctaggtgaaataatagaaataacgaactctttagagctgactatgtagcaggtgcttctgagtgccatacccagggtaactgatccatgggttacattagaggaaattgaagcataaggcaagtaagtaacttggccagagctgcagagcaaccatgtggcagaaccaagatttcaagatttgagccccggcagtgtggttccatagacgctactcactggtctcttctgcctctggaagactctctccttccctgccttcttgtcacccctcctcccacccactgactaccactgtacagcgagggtcttaagccagagatcctatgagccgcaaccaccatctgtgagctgcacattttttgaggaattacctttccggcagcacatttgagggattcaaggacttagaacaacatgaaacaattcaacaataatgacaaggcaatgactatcgaagtgcagcttcacctcacaatatctataaaaacatccatggttattgcaccatccacttgttcctcttcctgtactcttgtcattgtttcaatagaaaccgctgactaccctgactgctctcatatatacccagaggacaaggtttgagcatcttctggtaaacagcaatctttcttcatgctggcatgacctcacactccacttcttgcctcttctctaaacaatttcttctgttgtatacactactataatcatagcacacatgggtcaaaatcactagtctaatctcagtactctacctgcaaaagagcagtacctaacaaagaaaccaacctacactctcatttgtgaagggcctactgtgtgtgcgttccagacgatatgtggtaggtgctgaccactttacatgcatcaactgacctttaaacagaactatgtccactatagcgtaaacacaatgagggctcagagtggacaagcaactggtggtccacaattccatagcctgttagggttaaagctgggattctaatctggtctgctcttgaaagtccccacttggtaatatttctctttctctgcctttgcctaaggaaattctatttattcttttttttttttggagtgcaacagcgctatctcagctcactgcaacctctacttcccaggttcaagcgattctcctgcctcagcctcctgagtagctgggattacaggtgcctgccaccacacctagctaatttttttgtatttttagttagagacagggtttcacaatgtcagctaggctggtctggaactcccgacctcaagtgatccacccaccttggcctcccaaagtgctgggattacaggtgtgagccaccgtgcccagccaacttattctttaatgtctcccacactaatctgcattctccctgcaggcagggaccatgctttgttcacctctgtttctattatacttcctaaggaatggacacttaaaacttcccgaactgatcaaaataaatgtgagaggacagtgcctagcatctaacaggctccttggtggttgcggtctaagtggacatgtacaggtgggattactcgaattctaagaatggctggatttaacacaagtcaaaagcatttggaaacaataatcatcatcctgaattcccaattctctcccccctcacctttctgcctctgctctaccccttcttctccaaccctatgtctcagtctgtctgtttctccactctcttgacttctctctctgtccctctcacaccattattgtcaccacaggcctttgaagcgactataccctcaaacacaccatacttatcttccacaatcacatctgaaatattttggctatagtttgcttatggtttgtttggccttgctgagtctcatgttgaaatctgatccctaatgttggagttaaggctcgatgacaggtgtttgggtcccaggggcggatcccacagagatggtttggtgctattctcaaaggagtgagccctccctcttagttccttcagaactggtggttaaaaggagcctgacacctcccacccttctctgtcttgccatgtgatctgcacataccagttctccttcccctcctgccatgagcagaagcttcctgaggccctaccagaagcagatattgttgctatgcttcttgtacagcttgcagaacaatgagccgaataaacccctttcttataaattacctagtctcaggtattcttttacagcacacaaatggactaagacaatttctaaccacatctgagataaaattaaccccctaaataagcacacaaatggtattgatatgatgaataactcacctcaaatgtacttcagatagccttctgcacaaggcacgtctcttgagttaacaaaccctagccaggcatggtggctcatgcccataatcccagcactttgggaagctgaggcaggcagactgcttgagtccaggagtacgagacctgtctgggcaacatggaaaaaccccatctctacagaaaaaatacaacaattagcagggcctggtggtcacatgcctgtagacccagctactcaggagactgaggtgacaggatcataagcccaggaggtggaggttgcaatgagcagcgatcatgccactacactccagcctgggtgatagagacccaatctccaaacaaaacgaaaccaccacacaagacctaaacctgatatccagatctgagaagacagaaaatattttcaaatctctcacatatatatgcattcatacattgctacttactttcctctttgtgtgttactgatgtcttcaagtaatcacacagctctctgcacatgccagctcttgtgttccaagtttccatgcagcatctcatggaattgcctcaacaactccagggctagggactactgtcatctgtatctaacagacaaggaggctgtggtacagagggctcgtaaagttagcacagtggagaaggcaggttgctactcagacatccattcctagagcccacattcttagaacacacagcctgtctgtccctccagcaccaccctgcctacttttagtcatcctggtgtcgtctggctgtaagttcctgagaattaccctagttgctaatgtactggaatggcatcttccttattaaaggcactcaatttagcaatgcatttgcattccctgattggttttccatataagtggttcacaaaatatggtccctctgcaccacttgggagtgtcttagaaatgtgtattctcaggctttatcccagacttgttatgttagaaactctggagcaagggcctacctgcctgtgatttcataagccctccaggtaattctgatgcatgctgaagtgtgaggcttactaccctgcatgatatttatggcaagttttaggtaacggtgcctttgaacactaactttcagaaatagaagatagaaaatgtgcagtaaggcatcttgcttcagtaacacccaagggcacattctgtctacagttcctcactctgtcatctgtcctcacacgtaggctttctgcttatacactccaaattacaactacctaacagcttctaaaatgagtgtctggcttggaagatttttaaatgctatcagagaatgtctgtttcaggatttaacttgtccagtgcaaagaagtgaggctgggccacaagtgacccatcacttcacctgtaagagcaaattaattacccctcaacataagtgttatatttatgtgccaagtatggtcgataatgaggtctttaccgtgtagccatatttcaagccattgttcacttaagtaaacacattttaatcactgtcattttattatttattcttgagtctactatacacctgtcagaacattttgtgtttgactaactgtcatctccttgtatctttcctgcatcatatataaaccactgtccacctccacatttttccctcttactgaagtcaagcactacacaagttcatggggacttagaggcaagtgtgacggctgaccaccccaatagtttgcaaagcctttcatctgctcctctgaaaacgcttttcacacattccttccatatatctctctgctgcaatctctctgttgcaaaactgttgttgatgaagtgacatttatctaagcattgtcactttgaataataccaaagaaagaaaatgaaaatcaatgtaattgcaagctatcaacctcaaattttattcacttgttttaaatttgtcaaatgaaaataatttgtttatctgagtaacaatatatgggtatcagtatatggataacaatttttaaagcttgatttcaaatttggatttttaatattaaaaagatgaaaaatttttagtccaattttccctagagaactctaacaatagtcatgtactgtataacatttcaataatgacagattacatagatgacagtggtcccttaagattgtaatggagctaaaaaaaaaaaaaaaaaaaaaaaaaaaaaaaacccgtaccctctagtatttattacaaggtacttttaacgattattttagagtctacttcttctatttataaaagagaaataaaaatgtaaaacggcctcaggcaagtccttcaggagttgctccagaagaaggcgttgttatcacagaagatgacagttccatgcctgttactgtccctaaagaccttccagtgggacaagatgtggaggtggaagacagtgatattgatgatcctgacctggcgcacgcctaggctaatgtgtgtgtttgtgtcttagtctataacaaaaaactttaaaaagaaaaaaaacaaaatctaatatttaaaaataaaaaaatacactaaagatataaagatagaaaatatttgtacatagctgtacaatgtgttttaagctaaatgttattacaagagtgtcagaaagctaaaaaaaaaatttaagtttataaagtaaaaaagctacaataagctgggcacagtggctcatgcctgtaatcccagcaatttgggaggctgaatcgggaggatcacttgaggccaggagtttgagaccagcctggccaacatggtgaaaccttgtgtgtatgtgtgtactacaaatataaaaattagccaggtgtggtgggacatgcctgtggtcccagcttctcatgaggctgaaggacgagaattgcttgaacccaggaggaagaggttgcagtgagctgagatcacaccactgcactccagcctgggcgacagagtgagaccgtctgacaaaacaaaacaaaaaacaaacaaacaaacaaacaaaaacaaaaaagaacaagctataataagctgagattattgaagaaagaaaaatatgtttaaaatttatttttgtttatttattttcttttttagagacaaggtcttgccctgcaagcccaggctggtcttaagctcccagcctcaagcaatcctccttcttcatcaatgtttttaaacaaatttagcatagcctaagtgtatcatgtttataaagtctacagaggcatacagtaatatcttagcccttcacatgcactcatcacttatgtactgactcatcctgagcaacttccagtctaagctccatccatggtaagtgccctgtacaggtctaccattttttacttcttatactgtattttaactgtaccttttctacgtttagatacacaaatacttaccattgtgttacagctgcatataatattcagtacaataacatgctgtgcaggtatgtatagcctacatgtgcagtaggttacacccatctagatttgtgtaagtaactatgatgttcatacaatgatgaaatcacctaaggacacacttagcacaatatatccccttcatcaagcgatggatgactgtattcataaaaatctggatattgaggggctgcctgataatgcattattatatgtattaaaatgtgtcttgagccaaatgctaattaactcttggctggtgcctttccttaatgtttctttcttctttttttctttttttaattctgattactctttgggacaaaaaggtggtgctgaaacaagatatcatttatgatcaactcaatacagagattacttaatatttatcacattatgcagaggcttcaataagttcatcaaaatatatgttccaaaatcctatgcatagatttcaaacttttcttccatcaaaataaattcatactaacttgttgtaacatgtctgagtaggatctagtttgaggcactaagaagattaagacatcagtttgaaaagatcccgtatcagagcaacatgaataacatgaattctgctaatgttgaggcaagaacatgcatcaaatttatggcgaagcttggatggaagaatggtaaagtcgctgatgctttacaagaagcttatgggggcaatgcccaaaataaaccagcaatttacaaatggataattcattataagaataaatgacaccatgtcgaatatgaagcctacagtggcagaccatcaacatcaatttccaaggaaaaaattcaccttgttcatgctttaactgaagaggaagaaggactgatgattaacagcagaaacaggcaacatcgtagacatctcaactggttcatcttgcaccattctgactgaaaaactaaagctgaacatactttccactcagtgggtgccaaaactgttgcacacagatcagctgcagacaagagctttctactgaaattttaaccaagtgagattaatgtcctgaagcattcctcagaagaattataacaggagatggaacctggttttacccgcatgatcctgaagataaagcataattatagcagtggctaccaagaggtggaaatgggtggggcccagtaaaaccaaaggtggactggtcacaagtaaaagtcatggaaacagttttttggtatgctcaagacattttgcttgttgactttctggagggccaaagaatgataacatcttattatgagagtctttcgggaaaggtggctgaagctttagcggagaaacagctagggaagcttcatcagaaagcacctctccaccatgacaatgctcctgttcattcttctcattaaatgaggacaattttgtgagagttttgatggaaaatcattagatatccactttacagtcccgatttggccccttctgacttttttcatttcctaattttaaaaagtctgtaaagggcactcatttttcttcagttaataatgtaatcaagattgcattgacccccaattctttagggatggactaaatggctggtattattgcttacaaaagcatcttaaacttcatggagtttatgttgaggaaataaagattttttttgagaaaaaatttatctttcaattctattttccacaaactttttgaagtcctcttgtactatcctcaaactttgtgcactaattgaaaaaatatatatatttttgtaaaattatttataatgttacatatataatatataattttacatataacttatgtatataattatatataaatttgcatgtaatttttacatatatacacttctacaaaggaaataagtgaggaccaattttttctaagtggcttaggaaaagctgaccaaataaaagatccttcctcacacactgtggagtccttccattgaagaatgtggacaacacactccatagcagaagtcaaaactggtggctgctctccatcatattttatttcttcctacgttttttttatttaaataaattgtcaactttaaaaattcaagatcttacatctaaatatctggatttccattacctcatggaaaaaatgaggcctctggcaaccatgaactcttatccccacatggcaacgattgcatggtactaaataataatgccacctatgccaggcttggattctcttcactccagtaagttctctgtctggctcctgtgggcctctgcatttgccaccctgctctgcgttcagtaataactgcaagagagttcttttgttcccagcttggattgatccaggaagatgtctaaagaaagctggaccaagagcaaactctggagaatggacgggaaagaaaatgagtaggaggggaaaagaagagtctctcaggataggcttatggtgtaagcaaagcctcaggggtgagggtcagggtatgggggaaggatgtgtaagatagagtaaaacactgaatgtactggtttgactgggtcagaggtgtaggaatgggaatagcaggtgaaaaacttcagaaaattcattgaagagagactgaggagagccttgagggctaatccaaggagtttctgagacattctctaaattacagttcttaactttctattgagaaacagatcaacccactctctatgcaatttcaggtaagctaaatgcccacttaaagcttaggcagcatgccctgcctctccttactttccattctttaaatcaaaaaacagtacctacaaatgttatgttaatctgggagcaacatgcccaaaatcaaaaggactgaacatgcccaaaatcaagaggactgaaagcaggaagaatgctttggcacagaaggggaaaggatgaagcggcagtggagagccatggttaaggacacaggtacctgcctgggttcacatcctgaactgagtatatgcaccatggtcttctgaaggttacttattatctctgagcctcagttttttcatctccaatggaggaaatactagtacctacattaaaggtctgctgtgagaattaagtgagttgatacatattatatatgtttagaatagttcctggcacaaagtaaggtctccacgaacattaactgtgctgctgtcagcatcactaccactgttaccactatcatcatcacttaaaaaactgcattaagtccagaaggatagtggctgagagttcatctgcagccgtggccataaaaatagaagtaaatacatgacaaagaagttgtgaaggaagactatataggacttggtaactgcagaaatgtggggaaaagagctatacagaagtatttaaagatcactgcatgaatctgaagctagatgatacaataaaataacatggacaaaggtcaaaaagaatgtggcttttggagaagtcacatttaagatgaaagcagaggactgcagtgggactattcagaagtagttgaaacggcagaaatagaattgagtagaaaggtcaggctagatgcagatttgacagctggtggtgctttgtgaagctgataatttctgcaaggcaaggggatgaggaacacagataagccatatcatcatgatcattgtttttagataccactgcctggacactttctatgttctaggagctgtcctgagcattttatatggactgtctcattaagccatgattatctccccattttatagatgcagacactgaggattagaaagtttaaaatccttgttcaaaggcacccagcttttaggcggtatgaattaaaaagtggaatccatagccttcactcttaatcatttactatattcctttccacagtaaaagaaaagtgagatgtaaggaaagggaataatctaagaagtcgagagacaaaagcgaatgagtcatgcctctgaggaagaaggtaacgagtttatgagctagatagagagtcttccaaaggctaatttgtgcttcatgaatagagaaaggtttttaaaaggaagaaagaaaggggcctaaaagggaaggagttacatttgatcagtcaaatactagacaagaaagtaattcccaagatcaaattccaatttcagtttgaatgcaggacaagtggcagggtttcatttgcttggcatcaccaaagaaatggataccagaattctgatttgacattcatttacaatagaattttgcaattatcaattgccatttttccagcttggacagggttattaactttttcttggaaggtgattagtgcttagattccatccttaaaaagacacagactacagaggtacctgtccggtggtggtaaataatgtcaactccacaacaatggctacaaacaccacatcacagatcaccacaccaacagctaacacaccaagccttctacctaccaggcaccacactagctggggctgataccgcacttgctacccagaactacccccatgtgacaggtattgtcactcgccagttcagtctacctctggtgcctactgtctggccctcttgttgatatttgggtaagtctcctagaatttgaaacttccatttactccctcaaaaaataaagaacggattatgttttgatagctactgcagctttatatagttgatgcacactctgtgtatgttctccgtcactcacatatagggatctagagaaaacagctatataacgttaggggaaggagtaaatccccttgttttctgataagtttatgagcgagtgacaaaaaggaaaatctttcttgtgcttcagaatgagacagcgatgaaaaacaaaaccacttctgtgcagggtgaaacaaacattattgccaaggccatttttgattgggaaatgaacagaagattaaatcatagtggctaagtgaaagaaaccagacacaaaaagttaatatattgtacgattccatttatatgaaatacctaaaatagataaacccatggagatagaacacagattaatgcttatcatgggctggagtggatgggagaatgaggagaaactgcttaataggtaagaggttttactttgggaatgttttggaactatataaaggtggtagctgcacaacattatcagtgtactaaatctaacagaattgttcacttaaaatgattaattttctattatgtgaattacatctcaataacttatttcaaaatgaaaaaatagaaagtttaaattcaaggatacatataaagaatttttttttgctttttccccagaacatttaaagaatcactataaaaaggaaactttatcctcctcatatctaagtttaatttgggaggatgtgggaaggggctttattattactgttacttctttgcttttcattgtccacaaaatcacatataggaatgcaccaggcaatcaagcattttctctacctgggctgtagccactgatgtaaactacatagaaaatgtattatacagataagcaaattcttcactgtgaaggtagtattctctctactcaaaagttttcaaagaataaactgcaactgtagaaaagaagggtaacttttaaattaatttagaagcagagctcagcttgccctttgcattagctcaggttctttgaccaaaagacacaaagtcagcattagacacctaggagattactgggggaggaaagcagggtaggaaggaagaacttccagaccatgatgctaatgcttgtgaagcagaggaagagataggaggtttgggaagaaggagtcttaggctccagggtacttccaagagaggtctggcaggccaactaggagtccttgagcccatgttccagtgagaaagtctcacatgtaaaaggaaggagtctatgctaacagctcattcactgactataggaagtttggacttgccatgagacagcagtggatcaaggatagcagtagctgagttcttcagccagttatgctcccacaacaagagacctcagtggcccatttttatggtgccacatcagcctactgatagcgacaggaggcggccaaatgcctaggcatataaaggcaggtccccagtgcaaccccacttccaagctgaaaacagtttaaagcctgaaaaccaagctacaggttaaatgcttggactggattgagaacttgtcttcctgtttggcacactttcctctgattgatcctcacctttcacctattttacatatacctaccctttcctaattagttgtctacactgccacgcccacctttgagtagcgtctttgctttaaccttttttgcatactcacagaccaatcagcacacactccctttactgagcccataaaagccacagcctcagccatattagagaattttcccactttcgggtaggggaaccgctccccacatcccctctttgctgagagctttcttttcacttaatgaattctactctactaactctccagtgtccacgagcctaattcctcctggttgtgagacaagaactcggacctagctgaactaaggagcaaaaaaccctgcatcactatttttcaaagtctctactatagatctggcagtacattaactctctttctcctgtagctatgaggaatgggaagctgtggttatcggaaacctgaaaataatacctacttttattttaagcaagagtttctgcaacttctctcctgaaaatctttgaggtataatgctagaaagggagaggaaataaaagactcataaaggacaatgccagtgtccatgctctaagaaaaatttcagccagcaagaaactaactagatgagaaagtaataatcgtgtgtgtaacccaaaaagggcaaatctgatcctgcctatcaagtgtgacagtttattaacattgattggaaatttaacaaatacacagggtcagtcacataggtattaatgccacacccaccctccacaatcagttataagcctgttctgttaaagcagtatgaatactttataatctgtattcatcagttttgcagaattgtaatgtttgtctgaaatctagggtgatacttagtaaattacacacttaatatgttagaaaatattaatgttaccatattacccaataatccaaattttgtggaaggaataaggtacctggaaggaatctatttgatttcataggagttaagaaaataatatatataccacataggtggaaaaaaaatctatgttttgggaaaaactgacaaactctggatgtgttacaagaaaatgttttaaaaataataaaaaaaatttatgtatgcatatacacatgtaatcttaaaaataaggaataaaaggtggaaagtctatacataagaatgaaattttattatatattgaaaagcaagtactgtgattaatagacttttttgaaagatgctaacataacctatttttgggccagataatcagtctcttttagaataaaatgtgctttctatcagctttttggtcactgtaacaataatttgctggccaagaactaaataagtggcttaaagtacatctgaaggtatttataacctataaaaagtttcctcttatcatcatatctgctttattaacttcaagggtttttctgcagaagttctctcattttctttttgcactgggattttgtccttcatagttctaaaagaaatatcccattttctccctttcttaaccctcaggatagaagaagtagtatcttctcacagtgtgtgaagactcattctcccaaaagatgagcacaaaggaatagatgctgagaatatcaatgcctgtgacatttgctgtctcccataatgactgccatgggaggacttgggaagcggactgcaatctgatctcaagtcttctgactcacactctattttggactgcttttgtcttggatctggagtatagaaacacctatttcgtggtcggtaggcagtttaacaatcacatacacaatgaagcaatcagaaaggtgagcaggtgaatattctctttcagaggataaattactttttctaggaaaatgattattggctgacaatgaggtggtaatttacttccctctagactataataaacaaaaatacaaagtaggacaccattttcaacagctgtgtgggtgattataatcaccttttagccttgaaactagtccctatctcattagctatgatacataattttttaaaaaatcatgccttcaaaaagaaaaggttttctgtggctgagttaggctagctgtccatagtgccacctattaccaaactttacagaggatgagatttcttttaagtaaaccctgcttctgaattcagagtatcctcttgctcccagcctccaggaactagtctgaggcagtcagttctattacaggaagaggacacaagaggtgcattatgtaagttagcaatgactaagccgggtgctctatggggatggcagtactctggatagtgaaataagtgctcttttaggtaggattgctttagttggtctttgagttacttaagagccaagcctagagcagaagaggttgcaacagaatgtgacatgagttggaatctgtagaacaggaattcaggagttgtccctagatactatagcagggtaagaaatggaagcggagagcacatcatggagacatggagaacagaggaggtgaaagaagccctgtaatgtgaagcacgggatggaggaccctggcagcagcctggggcctgcagaggaaaaagctccaagaggagctccatataagagggtggccaagttcgtggcatcagactttccactggaaatggattcctgctttgtcctataattaccctcttatctctatacctccaggaaaagaatgttctaacaatgttggtgttagaaacaccaaccttgggttagtagagcactggggcttgtagggatatgtaagaaacatctgctggtcaccaaggggaagagctgagcagaggtgctggcatgcacacagaagcaggaatccagagcaagagatggcagaagagcacaacagaaactcacacgtgtctgaaagtgctggggtagacagttggtctccccatggtaagcaggatcacaccatttgcacttagatcattagagaagctgaaaagactgaggaacttagggagtacgaaatctctctaagtgaaatctcagtgcgaaatctcagtgagaggattttgttagtctaaattcaaagtctctaaaaaacaaaattgaattagctgccaacatttaaaagtgagatcattttatttttcttaatccaaattctttggttaaaaaaaaaaattagacaacctgaaaatgttaggcttaaattccttagtgctgcatagaaattggtgcctttacagagaacagttcaaaacagacctaccacctagatcaatttaatcattgatacggctggcctgcccctggagacacccaattctgcagcccctggtagcacctgatttaaaggatctatccatgactaaagacattatctatgcatttgtaaaggttatttttgctttgcttgtagtgattgctcagaagatttttagtgaattccttagttatgtactttgaagtgaaatccaagtttcacctccatatacatgtgatctccaaagtggtttcatgctcatgaaagacagctgtgctggttattcctcattttccaccagatgcattctctttccttcctgatctgcatcctgggaagttatttcctgtgtacctgccagactcactgatcctctgacttactgttaggttcggccagtgagaattatctgcaacagaatggaggccaggagagaagagaagatgggtattgactcactgtcatggttctataaccctccacccccacaactcccattgtgaccccttggataaggtcagctcttatgtggctctgataacacatgatcccttctaggtttagaggtgatgccagcttccctccactgttagtccccggtgcttccccaccccatgtagtttccttaaccctatctataccttataagtaatcccattactaaaatacctcccattaaatctgattatacaatctgtttcctcctggacccctgactataagtcaaatttgaacattccaaattctggtacaaaagcagttggacagaaaagataaaaggaaatagagtaaatttcaaatgagtcttgaaaacaatttggacaagcataatcttgcagattggtccttacaagccctacttgccttaatcagatacctcaacagttgagtgttctgggtcatttcttctctgaagcctttcatttcatgcgtaattagaaacatgccagtctgtaatgatggcagcctttaaaatggtcagtctgtcacttccatggccctaactccagacacaaaatgcatgcttgattactaagagtcttattaaggggctattgtttcccccatccctgccagctcctcctacctcctgatctttatcatcttgcattctacttaaagaaggatttaaagagaaaaaaagaaaatctcatagacactcacatcagattgtattaataagcaaggtaaactacatctgggcttgtcactcacagtttttcttttcctctctaaatctaagaataacatgcagtcagttgcaaaacagggagcaagttttccaaagagcacgtgggtgggagaagccaaccatgaagtaaattccaacatcaacagtctggttggattccactgtggcccccactaattttcccaactttttgggccatgaaatttattattatcaactccaggtatagttataatccttggtaaaactcctctcagacctggcagatagtgtcctttaaagagtacactaattctaaaaactgcttatttctatattgactgagataggaaaaaatagccttcattttcacaagtgattcactctaatcatttaatacctattactgcaacaacatgcaccagatttctgacagacacctgtttgcaaattatctaagtttcagagcagaaagcctggtttagaaatacaataccatctgtaataaagtagcactagcactcatctggactattttggactaaaaatagtccaaaaatgaaacacaatagaattttagtttcttgaggattgggaatatcagtcactgtatagtcattgcttcaagaacagtacccagtacatagtagatgctcaatccacatttactgaaataaaaagaatgccttaatagcccactgtcttggcagactttacctactctcattccagcacttggaacaattacctactttcaaggaccacctttgtacagtcatgctcatgcccagaacaaaattcttatttcacagagataccaatagtgcaaaacaaaggttttgactggttctctgctttagcatatgaataatacactctagtctacagagaagataatggaagccaatagtccaagcgttcaagtggtacttacttcatttaaaagtaaaagcccgggatagacaaagacagaaaaagcagcattgaaataacctgtgtgagaaagcagaattttaacaacagagctgggcaaaggaaaaagcaattagtaggtttgtcttcatgcagcttcaagagtactggttgttaaaattatcttaggagctggtggtgcttggatttcctttcaacagaccctgaactatgcagtgcttaacctccttttctgagaactatccagggacaccaaataggaatggatgtgcacatcgctgctgtcagggctcagaaagataatacccaaaatgaaggcctcagaaacaaaagactcttggaccttctccagccctcctctctctagcctctaattttctccccataggccagccacaaaacctaaaaatattattctaatccctaccaccttcctgcataataactggccatgaagaaactatctgacctaccttgcttaattataggtcattagacccccattccagaaagcgtcctgccccatacccagaagcaaggaatgctgctgagaggcaaagatgaatgcagacacaccttgctgggttttctcagtctaccaggattagatcacattttttgtccaatcatatttctatatggctctctgtactttgttgagcccaagtacaaaattggacaatttcccctgtatctttgggtcatcattctgaaggctcccatgtcatgtaaaattatgatcaaataaatttgtatgccttttcttctattcatctgcctcttgtcagtgttttcagcaatccttcatagagtgaagggatcgtgtattaggattctctaaaaggacagaactttgcaaacccccagcttttctgcgtggcagataggaaattgaaagtacatctgcttggttgctgtccacaaccaatcagactgattgtgggccaagtctgcctttgcacagaagtgcaactttgtaaattcactttagcttctgattggttgctttccacaaccaatgagaatactttcgttttcaaaaaatccctactttttttgcgtcattctttccttgctttgtgtgttttgtctaattctttgttcaaaatgccaagaacctggacacactccaccagtaacaagaacaatggagaaggttcaaaatgtcagattttaaacaaaaatttcgaggctatttattacctagaaaaacaaacaaaaatgtgcagtttaaacaaacccaaaaagagacagagaatctattatttcaggtcactgagtatgtactactcagttgtctcgggatgtgacagtagctaagaccctctttctgacctagagaaaaatccttcattcttcaaaataaggtttgaagtcacttcctctaggtaggcttccataaacctagtcagatgctcattcacaggacttttacagatagctctttgatcctctctccaccatagaacttgtattacactgctcttacatttgattctaatgagactataggcttcaaaagaactaggaccacacctgtcttttgaattcccagccctgcaacagggcttggtttataggaacactgaaagaatagcctttggatttgttgaatgtaagtttttaaagtcagggaccaggctttacacagcccataatacaagctcagtattggagatgtttccagtattatgggtcctaactcaccaagacagaaggaaagacctcacttttccaagttcccattcagcaagggcaaggaaggagtaggaagcaatacaggaattcagtttctgaacgatcattaaaagaaggatgtccaggttgcagcagcagcagaaatcctataatatatttttgtttttcttctcaaatgagctagaaaattggttctcaaactggtgattttgtcctccactcccatcccactgatggccacaggaggcagccaaatgcctaggaagatgggataggggtaggtaccaggtggaaccccacttccaagccaaagacagtttaaagcctgaaagcctagctacaagttaaatcctcggactggactgagaatttgtcttcccatttggcacactttcctctgactgaacccacccttcacctatttaacatatagctaccctttcctaattggttttctaaattgtcatgcccacctttgagtggtgtcttcactttaaccttttttgcttactcacacaccactcagcatgcactccccattctgagtccataaaaggtcccagacccagatacatgggggactttcccgccttctggtagggggaccacccgcatgacccctctccactgaaagctgtttcaatgctcaatgaaattcttctctgacctcctcacccttcaatgttcagtgcatcctcattcttcttgggaataggacaagaacttgggaaccagtgtgcaagccagacttggcccaggtgggctgactgggcagggcgccccctgtggcaggtagagtgccccaagagaagcctcctacatcgctagccagaggtccccaactggcaaagagaccaagaaaaatcctgcataccaccaaacatctagcaaagttgggagacattttgggctatcacaactaggagggtgctacaggcatctactgagtagagggcagggattgtgctaagcattctgcaatgtacacagcagcccccaacgacatcaactgtgctatgcttgagaaaccctcagctagacaactctttgttgtctgcagctaaaaatgaccaatctcctttctaagctccaattttcccattggaatcatggcaacaataatcaaccacttcttatatgttaagtggtgaggcttaagataacaaatgtaaaattcatagagtatagcctggcacataactgctcaattattattagatatttgtagtaatcattattataataaaagccgcatgtctgcacataatatggaggtatcaggtactatgctaaacatcttttaaaaagctgatattatatatgctccaccactcaaaacatgcttggtaaaagaataaatgttgacatatgcttgcttattaaatgattatgtgcataaggcaaatataaaggacataaaagtgtttatcagggcacaatactaaaaacaataaattaaattccttttattccattaagaatgcttttctctaagaagttcctgatcctgagaaccaggcaatcttacatgcaaactcaaagctgttttatccctctcttcagacaaaatacaatcaaacaaggcgtggctgaaacctattactgctagcctggcagaccactggagccaatgctgccactaattctgtcctgctatatgcaggaaagcgaaagagacacacggcacttcagagaaatcaatttcctttattagcttcctttctttatcgtttgctttcactgtatgttttgtggatcaagttaatcattttcatgtaaagatcaatcttaatatggactttcatttgaaagttgttgtcagattttgtggagaagccaaattctagagaaggatggtggggggtggtgtggggtggggtggggtatacacctgacttttgttgtttccagcagcccaaccattccatgaatttttggtaatagtatcccaaaaccttcttccctaatgttggcaactgtttagttcagatgtgtcgtagccaaaattgggcacatttcccaattcaggccaattagatatttctccctaaattctgaatcttgactaaaataaacagaagactgaaaagaactgaaaattatttctttaaatcgtggtgtccttataagactgttcagtagcacttgctatgcataaaccccaatctactctgctttctgtcaattctcaagtctcattctcctatatcctttagtctatatagtgaactactcaaagcctgccaataatttttttttttttttttttttttttttgcttaagctaaatagaatctacttttgtttgcttataatcaaggcaatgctaactgttactggtaaaaacactgtaacacactactgacaatcatggatctggagccaggatatgatatttctgtttctcttttatttagtcatttatttaatccaccttgtgcttcggttgctaagtctgtgaaggaaaaaatgtcggaaaagcctaccaattacagatgcctagtaggtccagagggttgctattacagtttcttattcatcaattcaccccaaaagataagtaattgaatcttttttaatcccctgagatttatctagctcacccacttgttaaggaggatgcatgtaacttctgagttaagaaatataggcaagtttagataatattcaatgggaataggatatgcaaatgtacatactatattttttaaattttatttatttttatttattgttgcccaagctggagtgcagtggcatgatctcagctcactgcaacccccgcctccacagttcaagcgatcctcctatctcggcctcccaaatagctgggattacaagtgtgtgccaccaggcctggctaaattttttgtatttttagtcgagacagggtttcaccatgttgaccaggctggcctcaaattcctgacctcaaatgatctgcccaccttgggctcccaaagtgttgggattacaaatgtgagccactgcacctgacccaaatgtacatatttatgtgtaaataaacacacataaatttttcaaataggagcccctacatttctcttccctttgatgaactgttgaaccctaataaaatgaagagtatcacacaaccattactggaacctgttaaagccactaacagagaaagtcatatttcaagtatcagttgcatactaaacgaaggctctaccaatgacagcacatgcctcattttaaagctatctgagaaaattttcctcaagtcttttcaaccagcactcaccatgtaacttttgaaaacataggtcagtttatatgtgtgtaacacacaggcacattaattctataaacattcttttcaaggaagctgcctggacaagtgctaggttgtaacggcccactggactaaccaccctgcacgtgctgcccagtttcaacacacttcctcagccgagacttgagatgcaaattgagggtaaactcagcttccaggcatagacttgaacatttaatgccaacaaagtcccattgtcagacccctcctgcaactcctaatccacatatgtctatccggcatccactaggacaactacctgcgtccacaacattaacatgatgtggacaccccagaagtccactaaaacccagtggggcaaggaatgactgtactagaaatgtgtgaaaacaatgagatttgagggtctttactgatcaatgatagaggatgaggaaaaagaagaaaggaaaaagatcagtgaatgtctcaagaagacaaaaataaaggagattaggagagacaatcagggagagaaaagaaatgttgacggttaagaggagaaataattgacaacagaaaatgaaggtcagtcatctgggccaagtgtatcatttacttatcaacttggtatttcctaagatctaatgtgataggagatactacagaaattagaatgaaatatgactttaatattgattaagttctatcctggcacttgccctcaaaggaaagatcaattaccataatcagggaatagacttttttaaaaacaaaaaacaaaagccataattccagtggctttcctgagagaatttatgagtattgccatagattaaagaatggatatcctccagcagatgacagcaaaaaattctgtagcacagagtttagggactcgagtctggagtcagactcgggggctcaaacgccaactttgcagcttaagagttgggtgactcctgcaagttccttactatttatttgatcctcagtctccttctcagcaaaacaggagagtacagatttcattggattcttgtaaatactgaatatgatagtgtatgttacaaaagtaaatcataagcccaaagttcttttacttggccttgattaaaattataattaaagcattggctattaggttcagagcatttaggggtaaacttctaagcaaagaaactgttaacccaagcactactgaaaacataaatcctggagtaatcataaccctttgtttagagagaagaaagaaaaggtctaaagactatttaaagtaaagtgaaatttgagaccaatctgtggagttcgtgttcttgtaaagctgaatataggcatcatttggtttaccagagctggcaatgatctatcgcacaaattgaaagatttactttaactgtgaatctgtaaccttggactctggatatttatagctgtaatgagaaattacatttgttagaatgtttgtattaacttttttccccacaggaacttggtttgccaactaaccttgtaataaccatagactaagatgtcagtgatctagttacagtttactcaagccatttgaaaagctgaacattttcttgctgaaagtaatacatctaaagtcatacttccctgagagaataagtcattttggagttaatcaagaaagggacagattatcatcaaaatacaatgcaaaaatctcaatttttcacaacaatgcaattcattcagcaaatctcaatactcccatgctacacgaaccttctttagattttctcctgggtgtatctttgaaggagcatgaggaatatttgctatggctcaaaaaccagatatgcattccatctgtttaaaagcttatagggtattatagatgaagcaagcttctaaattcaaccttaaataatgggaaaatcgaacaaaaacaacaccctaacagatttattttaataattctggcaagaagtacaaatctaaggaaacagaagcaaaatacaggataattcagaatactaagaacctgctattgtttaactgaaagcataggtaaaagttacaaaaagtgatgccacgttttgatgctgcttactggctgcatctagagagaggcaaggaggtatcaggcatttctgccaaagctaggtgaggtattaaccactgagaagataataggaatagatgagcaagttatccagatggtacaagatggcaggtaatgtatggataattgcaagcctctccggagttaagggtactaaagaaaagaaagtctatgtctaaagaggagaaaagaagacagacaagctggttacattggagatttttatttataagactgacacaggttaatttcattcccatcaagcaattattaataaattctcacaaggttttatcgtggataaaagaattgtaatacgtgattttaaatattttaattgccaaaaataaatttccaaagtattcacagcatttttttactttgaaaagtaattagcataagcaaataacacctcctgggtgactacttaacatatatactggctactattcatgaaattgtatttaaaatgcagagtcaaatttccatatgtaagataaacagtatattcttcatttcatttttaaaaatataagagattaattagctaaataatttccctggaaaactattaagtaggacagaggattcaagaccctaaaattaatttttcaaatgttaagaggtttatacatccaagctcacttccattctcatattgcttatttaatgacttcctgcaaacacagacaccacagcccaagatctttctctttcctatatggagtaataagacagagaacttaaagttttggtctttgcaaaatatgtgtactttcttcttgaccattaattcttgagccctgaggcagatagaaaaattggagtagtgtgccaaatgtcaatgtaaaggagacaaatttgacaggagatggagaagcattaaccccttatacctatatatctaaaatggtatgttatatatgttaaatacacataaaggatttctgtctgcaccatcatagaacgatctaagattcaagcacccaaaattacatgatactgatgccagtattctttacatattagaaaaatcttgaactagttcttaaatctgatgacttgggtctccccagtctgttcaataagacattttgactcctattaagaagaaacactcttcttatttcaacttggaaattaacaaagaaaacagcattcattgtagggaaaaatggcacattattttttataacctcctcttacttgagtagaaaaataatccacttaatgtgtctagaagggcagtaaccctacattaggggagaacagactcccagggaaaaagccatttacaaaacattgaggaactgccaaacgttgtagggttcatacagccacagctaattactatgtatattgtatttctggacctactggcaatatattggctgatctttctggattgtgtcttctcagctgaacgttgtttatttcccacatcatgcaaatgacagggaggatgttggtctattttgtgattggcagggtaaaaacttaaaattgtgttttagattaggtcacaaaaaagtgtgccagatggttgttaacaaaaaagaaaatgctttcaacaaacctcacatgttgtataatcttggacaaaatacaaaagatgtaaatgtcctgccacaaatatattggagctggatccacctgacaatgctgaaatatctagtagaaacaattcccaaagaggtatgaatctgacttttctctctagaaaaactgctggatgacttcttagaaaagttaagtcagaacccatgtttttttaaaaaatcatttttcagtggtacctttgtatttattgtctactctagtattttctcttgcctggggtggggggaaacattttttcacctgtattatcttcagagaagataatacacctgcagtgttttagcttggaaagttttaaaaagtaaacaggacatggtggcacatacctgtagtctcaactacttaggaagctgaagcatgaggatggcttgagcctaggagtttcagtctagcgtgggcaacatagtgagactcccatctctaaaggtaagtagatacataggtaaataaaacaaaggcagtatattttcatttccttaataaaaatcttgaggaaggtgggggaaaaggcatgtactagcttgcgttcctcatagtccattagcagataattttctcaatagtgtatgaggacaaaaataaataaataagaccagtttcacatttaggtccctagagattcacaatcatcatctcccttctgtctgccaggatttaaattttatttttaatgtggcctctcttacgcatttccctctctctgcagatttcctagtctctcccaagataactggaattgtactcagtattagtcaagtgagagtgccatttattgaccaccgaagaaaagccaggtactctgcagatctcacttcattcctcatagccataccaggaggtagcccatttgcagatgggcaaactgtaactcaaggtttctcacctaggaagggactgagcagagtctcaaactgatatggtttggctctgtgtccccacctaaatctcattttgaattgtaatttccccatgtggagggagagacctgtaatccccatgtgtcaaaggagggaagtaattggattatgggggtgggtttcccccatgctgctcttgtgatcataagtaagttatcaggagatctggtggttttataagtggtagtttttcctgtttgcacatgctttctctcacctgccaccatgtaagatgtgcctgcttccccttccaccatgattgtaagttccctgaggcctccccagccatgcagaactgtgagtcaattaagccctttttctttacagattacacagtctcgggcagttcttcatagcagtgtgaaaatggactaacacacaaacctagatctaactctcagacatgttgttgatgttgacagaaggtaaaagagtccataccaaatgaacattcttttagctacatacagcaattaattttcaccagcccttgagaaaagatttgaagcactagtcagaaggaaaatttattaaatagaagggaaagacatcaaagagttaataaattcagaaactgtacaactgagccaggtgttgaacagaggactagacatggagttagggtgagtaagagggagagagagagggagagaaacactaagaaaagaaaggcagagaaccatgcaacgacttccctgattttaacaatgaaagtagctcagaacataggagttacttggccaatagagttaaaggtcttacttaagaagtaccatgcaaattccatttctggttgccagaccctgatataccacatgttcatttctcaataagtgcatgttaggtaaattgaccactgtctcttctgaaatggaaatgtctatagtggtaaaggcattgccattggatttgaaagctgcaaagcaagttgactgcagggaactctgtgtgtgtgtgtgtgtgtgtgtatgtgtatgtggcttgtaaattattcttttaaactgcttacaaattagctgtgaaactggtagtatgtagttgtccatgtcaataacaaaaaagcaaacacacaaaaaatgcagatcagaagaaacataacctcagtcacttcatattaacagaccattcactcatccatttgtttaaatatttatttaataactaccacatgctacgcactgtgctacatgttaggggatatattggtgaataaaatagttatggttttagcaattacaaagcttacaatctagtcagaaaaacagacaaaattcaagtacaacagaaataactatgtaactacaaattgtgatagaatatgaaggaaataaatgaggcacaatgataaagactggaatgataggcgggtggatgacagagaaatgcatttacatacagtggttaggaaacgcctttatgaatccaaattctaggatctagatggagctctaacttaaacatatattggaatcacatggagggcttgttaaactagattgctgagccccacccaccaaagtgtctgattcagtagttctggagtcaggcagataacttgcatttctagtaagttcccaggtgatgctgatgtcaccgaactaggaagcacactttgcagaattaccggactagagcatagtgcaggagacagaaaggggcctgagctgaggttggaagagtaggcagggaagctctagataccctgacacatgctcagtgacaatatcagtgccaaattcagaacctgtctaggacttggagtgagtctaatgatcaagacaactatgaccactactgttatctttgccaaaggaaggacctctattactccctcttctaagctaagaacctgaaagcaaatttatcaaggaatacaaagaaccaactctaaaatcaaacaatattttttacaaagcattgctatattaacacagtatctaccatccaaagaacctgatgttatcagagcatatttaatagagaagataaaagagatcaaaaggtggcatctgccttcaaacatagagcgttctgaggattacggcaaggaaggcatttctgttaatagtagaagatgtgagcatgcaattattgtaagaatgatctaaattataagtaaagaagatacccttgacctcatctggtttgaaacatttaactggcttccaaaggaagataatctttattagtatttgaaaagttagatagaaagctaccagaattttgatagtttcgtagctctcaactttagtcttcccccaaatcatttgggagcttgttaatggtgtagattaccagagccatcctcagagtttctgatggaatcagatgaagtgaggcccgggaatgtgcactttaataggcatcctcaggcattctgatgctggtagattaaggaccacagtttgagaaatacctagttaaggcatggtaccctgtaaatggcaaaacccagatggataatctcttatggattttgatagagataattgaagttttactatgtgccaggtactgctgggcacttcttaaaagtactccctttagtttttaacaatttaaaaaaataatactcaagtgatgagaaaatgggattcagcaaagcaacttgtctgtagttgatcatgtaccaaataatttatagagccagaatgtaaactgagggtttctgactccaataatacatttatttcaatgatactgagctcatgattgctaacctttgtgaagctacgacaatcattaaacgatttcctggcaaccacagcttctcctaaaagcattatgtgatttggccttttaaaataaagagaaacagagtgtaatcatatcttgagactctgaaaaatccttagatgtctaaaaatattcacaggtgctggacaaccaagtatatgaatcaataagagaatccctaacttaaagtcttgtccactgatattacactggacatatctatccaacatcaagctcagagacagaatgtttagcagtgaagggtagaaactgaagacaaacgcctgagttaaaaaaaaaaaaaaaagtctctatcatggattagctatgtgaaagtgggtaaatgatttgatttctctgagcctcactttcctcatctataaaataataataattactttgggatttttatataagatattattatataatactattatatattattattacatacaatataattatatataacatattaattccattaattataattatagtgtaaaatatattatatataatagcttacatatttttgaatcatttggcatagtacctaccacacagttgttcaatacatgttatcttaattcttattaaattattacttttaagaggcatgtgatgcagttaataaaatagtggaaaaaacataaaggcccaataaacataacaagatggccaatctaatcagaattttgaaaaggcaaataattaaataaataaatcagcaaaatatcacaaaattccccataagatcataaaaaagtcaatattcataggataaaaatattggtgaagaagaggagaaataggtattctctctcataaaccataaattgatacaaccaataaaagggcatttgacagtttgttaaaaaaattgttttaaatgctgtgatacagaaatcctattttttcctattgattctacactcagtagaacagatttcggtaaccttttcctgtaaagggacaaagagtaaatattttagagtttgtgaaactttttacagtctgtcatgataactcaagtctaccacaattgtgtgaaagcagtcccagacaatgcatacatgaattagcttggctgtgttttaataaaattttatttatggacactgaaagttgaattttatctaattttctggtgtcaaatattcatatcgtgattttttttcaaccacttaaaaatgtaaaaacatttcttagcttgcaggctgtaacaaaacagcagcaggcatgatttggcttagcagctagctgtagttattaactgctaccttagagtgatacctactcatgtgcacaaggaggcatggacaaagacatttactgtagcgttaaaaatctgagaacaggccgggtgcggcagctgatgcctgtaatcccagcactttgggaggccgaggcgggaggatcacgaggtcaggagagcgagaccatcctggctaacatggtaaaaccccgtctctactaaaaaaatacaaaaaaattagccgggcgtggtggcaggcgcctgtagtcccagctactcgggaggctgaggcaggagaatggcatgaacctgggaggcggagcttgcagtgagccgagatcgcaccactgcactccagcctggtcgacagagggagactccatctcagaaagaaaaaaaaaaaaaaaaatttgagaacaactattagatcatcaatagagaaatggctaaaaaagtgtggctacatccataatctggaatattatgttattctatgctaatactatgttagcaaaaagaataatttatcacatacaattgtaagagatactcaagaaacttcatggtgaaaaagcaagttgcaactgttcagtaaaaatgcaagctatgctcggacttagaggttttagtacttgcaccattatggcagtgaaaaaattcgttagagaatgaggtcggtcacttttggttcatcattctgtgatcacagaacacagtgggtccatttgctgagacggagccatttgctgttcataaatgtttggatttgtctttcaacaactagctgacaaaggcataggcttaaatgagaaaagaggcaaagaaaatataatagaaaaactcaaagaacacataattaaaagcacttgggggactcctgaacagattcctactgtgtttttatactgaatgtcatcattctcaatgatcaggaggcagatgacagcatcaagacaatatggtgtcaagtcacatttcagaatgttcccggggctctgatcagcattagcctgactaaccagatcagagaagaaagtggtcacagcaaataccctgtctcagttcattactcaacacctgttaactgtgattaacggccctggctaattatgtgttaagagcatctcaggctgtaatggatcccagaggtctgcaaacttgacttcatttacatgtttgtctcctttcagaaggtctcagccaaacatggccgaaatctcccgagcattttatgaactcccatgtcatcaactcagagtttcaaatacaccagggtcttcctagaaaggacaacgaatgtctgagatgtacatttgtttcacagataaagcaggcaaggtttagattttatggcacataaatgggcctcttgttgcaattaatattataaaaggctgctaatctgtgtgcattaaactaattgttacattttgtgatctcggctaaaagactaaactgtatttagatggcagaatgcactaaaacctcgctttatgtctcaaactaaaactgcaaaagtcagaaatcaaaaaggcttcagagaagctttttgtctactcatttttagttttaaaaatatgtattaacattaattttacataattatgtcatgctatattcatacattaaatattaatacatatacaaacctatatatatgtatctgaatgtgtgtatatatatatatatatatatatatatatatatatatatatatatatatacgtgtatacacacacaccacagacgattagacagcccttaccaaggtatttttcttgcttttcttaaatggtattgaacctaactcttcctacagttaactgaaagtcaactaattaacatccctcccaacttttttttttttttttttttttagtagaggagcagagctggcagcagacattaaatccttcttcattcttatttgcttagtctagcaaagtaatgagaaaaaagtaaatccactaacaattgtgtgtgatggaatattatgcaacatctagtattcatgctactgcactccagcatggggaacaaagtgagactgtcaaaaaaaaatatattgaatgtctacatgtactgatatggaaagacatctatgacatatgaagtggaaaaaatcaagctgctgaacattagatagcatattatgatgcaaataaatgtgctataatagcccaactccacatatgtgcatctttagattcctgtatacacaagaaaggatctgaaaacatatagaattacaaggtcttacaagcaatctggttctgccttttttagcccgaatgggaagtacctatcccaaatgaccttcatcatcttcacaactagaaagagattttcatggtcccttctacccagtaacagcagagcacagtggtttggaacatgtgccgtgcagtcaggcaagtgtgcctcaaatcatatctaccacttactggccaagtcatcttagacaagttactacattttccagtacttctgctgttttctcatttgcacaacagtgcccgtctcataaagtttcgtgagggttgtgatttaatagccgtatagcacatgccttagcaagtgtcgtcaacactcacctctctatcattcttagctagtactttcttcatcttgcctcagttattatttgaaatgtgcttgtttccttagtcattacattttctaatttgccaaatgttaaacaagggcaagagttggcactttctgtgtctctctgcttcctcccaccaccactgtaagccccaaataaaataattgttttttacatttctgaaagcttttcactctgttacaaatcaaggggctccaacatgcccttgtttctaacaattctcaatgcagtttaatgctaggggtgaggtgggctcattgacttttgctcttggctgacatttccattagcacatgtgtggtgtgtattttcctccagtattctttttgctaagagttccgtctttctctaatttcttacttttaattgtcttttcttattgatctataagttgctgtcactttgatgaaacctaagggcttcaagcacatctctgctatttactagctggaatctttaaaaaggtatcaattaggttcagtttcttaatgggtaaaatgggcataatatcatctatactttttcttcgttttgaaataaatttggcttttaccacttagagaattcatgtcaattttagaaaaacaaagaccaaaaaatgaaataaacaaagataaaaccattcataatcccactacagatgtcaaaagtctattctacatccttctagtccttataaatgtacataactaaaggttctgggtcaaggggtctagacaattctgaatcttgctttatttcttattctctcttcccagaccactcaaaatgttaagtctgatgtgttttaattgaatacctttcattgtgcgtaaatatacacctaaaatcacaaatataaaggcttttttactgaaggccatcatgctttgcatatttcctgtaacttgctttgctaactttacaatatatcatgtgcaatcatccatagcagatatacattctaattcttaatgacctaataatcatccatagcatgtataacacagttcattcaactagtctcaagtgatcaaaattctttgttttcatttttttgccactgtgaacaatgctgcaataaataattttgtatatatatttttatctatacagaataattcacaaagagattactgtgttaaaggctatgtgtattttttttatttaaaatgatacagccaaactgctaagcaatatatatagctcctagcatttctccacattctaacagcattggatgtcatatattattaagttgtgcctacatcccaggggaaaaaaatctatcttattttacttagcaattctctgagattaacttttcctttttactggctatttctctctggcaaactgctcattcataatcattgcccagttttcatgtggttcactttcaaaaaacttgcatggagtgtcttggtatttaaatggtttaagtattggtttgtcatgtgtgttataaatgctgcttcacctagctcagtgtttgcatttgcttactgtccaacacacataatgaaagtctgtttaggaaaatacatgctttcatacatctttgtttctggcttgccttccatctctccaccccacatcgtattaccatcatttctcttcctggcctctcttgctttcaaattctaactttctcgtctttatctcctcctcaccagttatcacaattacctctgtaaagaactaagatttctcccactactttttttttttttttttctaaagagagaataaagctttggccgaagacagttttgatgagatggctagaaaaactgcttttcttcattggcattttggaaatattgctcagtggtttgggacccatttatttctactgcctctatccatctttgctttatggcttgacttctgctgctttaactccacattctgttttgctccacttcaactgtttagctgccaggtttggtctggtttcactgatttactgtatctaatctcattccctccctggattctgaaccccatcctagaaaaggcacttccagctcacagactcgcatgtttatcgattgaaatttagttcaatcgataaacattttagcatacttgggttcaattccaatagcacagatgttttcagatcatttcagatggtgagacccagaaattttaattatttttccaaacactgctaaaaactgacattaaatttcatccatgaactgaaaacatttttactaggagaaaatcatgatgctgatatatgcaattatgctataaagtattattttattttgttaggtattccatttaatactatagaagtattatgatatttattacataaagcattattataataaaatctcagtaccacccagaaaaattaaaggtttgaccttaactttctccaatttttccctattaatatcaatttgcttttcttgttaagaaaatattaaggtggaaaacttgaaacaggacattctgttctattatttttatgttgagaattgggaaaatacagcttttgttgtatagaatgtggtatgtatgtgatgagtatggaaaatgcatacttccaacggaagcagagagacttgttcaggggccattgcaaaactccactggcaaggcgctatcagcctgcagcaaggttgtagaggcaaaggtaaaagattagagattgatttttagagggtgagctaaaaggacatattggagagctcttaggcagtgtgagggcatattctgacatcttaaatgcctctgcattttaaaatttctgaccagctgtcaattttgtccatcaaaatctcagcctggttatccttgcttataagcagcagattttttgagtgcccccatatgactccaggtttcaaatgtttgctttatcgtatgtcccaaagtccaaatactggagagtcatatggaaatattccaaagatttgcacacagaagtgtgacacataaggtgagaacagccaataaagctgttaggtataagcagttgtgcaaaagaatcagttgtatagccagccctgcaatgcttggaatcaagcagcatggacacaaagtgtctatgtgtacccaaacagggcatagacttcaatgctttttcctttcatgactagtctaaggtttttgaagctcttctcataccttatcacattttacatacctaaaaagaatcaatattttcttgttctttacaacattcttttttgttgttgttattgctattgttgaaggacaatcaattctgatttacataaactcaagggtaacttaaaaagacagttgcagtaactaagattgaagctggcatgcctttcccgagtgaggtgttagacataaaaatggctttcatttcgtaatggagaaaaaagacttaagtctctgggacacaccactcttctcccctaatctcttccacaaatagcagcctgggtgatctttttgtaatgaaaattctatcacaaactccaaatattaaaactttctcatggctttccatcatcttaagaatgagatccaaattcttcaacctagtttaaatggttctatgccagggctctccaactctggtagacccaaccctccttaatacaaatattttgtattaccctcttcactctcctgagatgaaatctactcttaagatactctacctacacttgtatttttaaaaatgttataatatcttaactttaatactaaaaagaaatattagaatgggacagaatatggttatagaagttctcattcccctagacatacccaacggaacaggcagcctcaattgccaccagcagcctctcatggcaaagcgagggaccagcctcaagtgaattaagcactatagatggtagagtagagagacagaattcaggtccttgagtagagtagagtatagatggtagagtagagagacaaagagaattcagatttcactgcactggtgaatcaaccaaccctgaagcccacattacattcagactttttaatgatccaaaacaaattcctttcacagttgaactttctacaatgggttttctgagtatgacataaaacattataaccaacatacccagtcaaaaacagagcgtgagaaacagtgctttctcaacagcttgtctaaagcatgcttatataattatcaggagaatatgtgaaaattagtgaggtttttttctgattgatatgaatgagatatcttagacttcatagagatgatgtgtttaaagaacagcctaaactaaatgtttagtaatgtttcccctaataattcttaaagtttaagaatgacattttctaatttcttatgtattaaggtctaacatacttctcaggcatttaaggcaatggcgcaataatattcaaaaattgttaaagctactcaccccaactccttctaccagtcctggtgcagctaagtaatgcagctgaccattagcacacctgaaactaccacactaatgtggcttttcagggcaggatgaggaaatacagtgcccctagctaacttcttgcagcaaatatttgtttcaattttttaagtgtagttttcctaataccataacaaaatcatttcccccaccttttctcttcattctttcccaaaagtaatacagctactaaaacactgatagtataacaatttatgttgtacttctttctgcttttatcctagattataattgtactacagtaactatagtgataaaggtaaacacttacatggaaccatttgtgtagcaggtctttattccaagcactttgaaaacattaactcctttaaccctataatatccctacaatggtgattactacttttattttactgatgagaacactgattttactgatgagaacgctgaagttcagagaggttaaatcacttggcccaaagttacacagctgtaagccaaggtttgaacagaaggtcagtgctcttagccactagactaccctgcgtctcaatacagagagcagtctggggaaaatactggctaatatcggagaacatgttttgagattattagaaaatgaactcacatacatctcaaagctcttagatacagggagataaagactgcttttcaaagagaaacaaaagtaaacaaaatgtatttcttgaagagcttacaaagctaaagtcagaaatgcatctccactctgtcctgtctggtcatctttaaacttctacatcctaaagctttggtttccaatcagtcacaatctcttgtgctctgatgcactccacacactcactcacacatgcattgtgcatttcacacccacacacacacaaacatgcccaaaatacatggaagaaagataaaattagctgtcttctctttgttgttgatcaaatgtagctgaagagtcagcaggggataaatatcttgatgcttacctcaggtacaagtgctttgaagaagaacatagaagagcaacttttaatgtagcattgtgaaaagaaaaaaaaatgctataaaatccaacccccattgtggggtgtcatttctaacaatgaggtttgttttctttatctgtagtgcatatagatgatcaaacaaaaataactgatccacaggctctgaagtttttatcagtagtcaccttctgcatggattaataaatcaaaaagggattttaatcctatcttccctttaacattatggcacatacttttgcaataagcgtggggcaaattgggagcctttctgagacacaggtaggcaagtaaaaaccacattagctgaacgtgccttcctaggtggtagaaacacatggatcaagggaggatggttgcaacacatccctatcaggaacccactgcaactatctgaagcaccctcctacaggaggggatgggaaatgtcatcctgcagtggaagtgaatacagggctgactattcagatggaaatggccacttggctcaattatgaactgtggttggcactaatagagaagcaatgattttgtttaattctttacaaagacaaaaattaaaaaccagaaggagataaagccaagaccactgccaaagatgatctttctctccaatgttcagtaaattctactcaactccatgattctctcccaccctgggcctccatcattcaaatgtgaaatcattacctggatggtgaagtaatctgtacactaaacccttatgatacacaatttaactatatagccaacctgcacatgtacccctgaacctagcagttaaaaaaagaaaatgaagattttaacacaacccaaagggccaacagggaagcatcccttttttccttatagaaaatagttctcagaactatgatgtattcatccactttttaaaagtgaaaaattttataaagcaagaaactcctcaaaaaggtcacagatttatcatgatgttaaaagtcataaaaattatagttacaggctaagtagttaaatcagaattacacaccacccaattaattttataatcaatagagattaaaggaaatgaggaagtaaagtaaatgataggatcccagcttaaatcaaatcaatatatatttattgatagccatcccatataagatgccatgaagaaggaaaagtgttatggaaatatgtccttgtctctgagcagctcaccacctggctggggaattgatatgtaatatgcagagaatttatgtgcacagcaataacaatacaaggggtgtcacaaggcctcacacaagtcatgaccaacagaaccatgtagaaaagagcatttgtattaatgcaatggtcaagagcctgggctccagagccagacttcctggatttgaatctcaactctaccacttataagctcattgaccttggactagttatgagtctttcagcaggaataaaatagaacctgactcacatgatgattgtaaaaattaagtgagtgaatacttgccaagtgcttgcaaataaggcctggcatacaataattgccatggaagtattaaatgggcaaaatacaattgaaagaagagaaagatctccattgctctaaagtctcccaaagtcctaggacggtttaagcagtgacggatgatatcatgttcattttccccttcccacgaattccctccctactgctacaaacattcttaggtctagaccatactaaagattaaaaatgataaatagtctctactttgtaaactccctgtaaaaaatgttagactcttctacatatgcatctatttatcactgctcacattcattcattcccttatagctcaaaacctgactccaacccctaccattctacagaaagcactacaaaaaccctaaaatctaaatccaactcccatttctccttagtcaacaccctctctagaacattacaaattattcaccgtttgatcatcacaattttctacttcctaggctctgtcattgccatcagaattttggcttcgagaagtaaggactgctcttcctcatacctacatctcttggcatgcagtagcatgttcaattaaattgctttactagacagtgctctctacgacttttggtcagcagacttctgagatgtccctcaagattcttgcctctggtatatgtaacccatataattcctccctcttaagtatgggcaacacttgggtaagacggagtacacttctgtgactaggttatgttatacaacaaaggtaaggggatttctcggatgtaattaggatgccaaaatcaattgactttgagttaatcaaaagggaaattatcttgggtgggcctgacctattcaggtgagccattttaaggggctgaggcttttttttcttcctaaaggaagaaataattcaaagcctaaaagaaattctactgctggccatgaaggagaaagctctcaagttgtgagagggcttcaagagatagccatgtggcggagacctgagagcagcttctaggagctgagaatgaacgctgcgcagtagccgaaagataatgggtgccccagtcctacaatcacaaggaaacagattctgccaacaggagacagctcggaactgggtatttccctagtcaagcaagcctccagataagagcacagtcaactgacaccttgatttcagccttccaggacctttagctgaggaccccagctaaaatatgccatgttccagcctaaatattccagcccatgaaaatggtgagacaataaatttctgtggctttaagccactacatttgtggtaatgtattacacagcaatagcaatctcccgtaccctctgccttccctctgtcttttcctctggctgttttttcttgatccaacacctaaatgtgggttaatttttcctggaatttcttctttctcaacactctccaaagtgattatgcctaattgagttactttaataaccatctatatgtgattattgctagatttttagactgctcttctctcttaagtcatgtcctatttttcctactgcctgctggtcaattccatgtgggcactaccaaactcctcatttgatatctcccaaatctaccttattattgccccatctacctcttgctcaatatctctccctcctagctgggccagtcctgttaatgtcttctccatcctcccaatcatttagtttgtaaacatcactaggacattcttcctctcctgtttccattagaaccaataattggccaactcctgttttaacaagtttatattcaaggcttcttttctattcccaataggtactaggttggcctttttcttcctaatttattaaaaccttagttcaaaatctctaagtatttacaagtaggtcttccaaagttaatgaaattggcacaaccccaagagggctctcaaagtccaatacatgtaagtttccaatctcagctctgccacttaattgcaatgacctaatcatatttttaatatctttgggtctcagtttcctcattcaattattggagaaggtaacatctatctcacagggctattgtattacatgtaaaggaatccaatcaatgataactgttcgaattattacctggaatcgtggcaataggacccatttccctgtcaatcggacttgaaagcttaacaaggccttcaattcttcttcctatatccctttactgaaccatcagggtaaactgaatcaatgtcctacttggtagcttcatcagagcacgttttgagtctgcatccagattgttaactcttggaaaacattagcaatattgcttgtttatccttctttctgtgaacactgactaccacattcagcaataaacattgataaagaaactgaagagttgttaaaatggaaacttgacagcataaaggaaaaaggacaaagaagcaagtgacaggggtaaatgcaattggtaggctgcatcttagctaaactcaaagtgaagcaatgatgccccagcaggctaaggttactcttaatgagaaagtcccttgggacataaatgtcatcactgagatctgatcttcttctaggacagttagaattttcttacgggagagaggcagatactagtgttgttcacctcatcacatgcaacccaaagaaaatacccaatatgaatgggattcttttgaacaaagggaaagaataaaaataattggatatgcttgacaactttcagttactctgcttggccttaaggtgttaagagttgaaaatctagcttttacctagtgcagctgaaaatctctctatataatgcaaaacttcaaaccaccttaccaaagagaggacagcactgagacctagttatctcttaggaaacttcgcaggctattactttgagtacaaaacaatgacacaactttatttcctgccaaacactgagggtacgacattcataaaaattttggtctagtttatgaaaaataaaccaggaggcatcagttaaaactcttataaataccttctttaagtgattttaaaagatttcactgatttcttccacttatcaatagtaatgaaataaaaaaaagtcctagaaatggttacgctttggacaagatttgagtaagacattaaaaaattctattggaagactgtcccagaaaggagcaagagctaaatatggagacaaaattcaaagaaacccaagcaaaaagaaggaaggaagtcaggaggaatttcctgaacaggcacaacaacttcagacccatgagggatgggaaaacaaaagaagttctagatggccttaccagctagagaacaagcaaaccctggcaagagcctccccaggcagcaggtttaacatggcccggccctgtttaagggtatctatcacacagtgatagatgatgctctaataaggctctgcagggtgatggagggaacccataaacccaatgtggttgggatgaggatggaacaataaagaagagagaataaaaggttactagttgttgagaaccctacatgtaattttatgtataatagttgactttatccccacaacaactttctaaaatatcaatatactcactgtataggtgtggaagcataggtactaagaggctaagtgaggaggtggaagaagtcattggtgagcaagcatttccattctttcctaaacacctatggaagaagcatacctccctgccttcactgttggacttggtcatgtgactcgcatgaaaaggcaacagaagaccatgtaccagcttaagcccgtgccttaagaagtttctgcttgtacctctgggagatactgactgactggagaagaacatacactttccaggcaaacacaaagccatgatcatggcaccaaaatgagacatatggggcagagccgtcttctgacctgcagatttgcagtattaaaaagatgccctcagctgctctgtggagctgtgaggatacaatgagactgttgcattccactggagaatagagcgagtaaccagtttactcaagtgtctaaaagtgattttttcactaagtacctcttactagcacttaacactgtgtctaaaacacagtagccattttctgaacaaacattaccttttttcttccacagagaggaagaaccacagaagtataatacagaaacccacttctgacttccacctcaaaattctaaatatagtacctttatgaggtgtcttacttctgagccaacttgattcttacacagcctatcccattttgttctggttcattgtgggtctaagggcaatatttttttttctgccataaactgctttcttgcactgttacttttacaaatcacattagctaaaaatactgcattttattctcttatatcattctctctctaaggcaggatacttcactcttcactgtatttttataactctcatctggtatttttttatgtctgttttctgcacttatctccatcaagtttagataacagtcaccaacttcttgatgactctaagcttttactgaactttgggagattacatctatgtaaggttcgatgtactctactaattaaagatctctttctattgcttccagcagttttcattccttgagattaagccaatagttgcaagggtggtgagattcagggcagtgataattctcaactactctaaagcaagattgctcctttttctcagtcctggttttgggccaggtgcggtggctcacacctgcaaccccagcactttgggaggccaaagtgggcagattacttgaggtcaacagttcaagaccagcctggacaacatggtgaaaccctgtctctactaaaaatacaaaaattagccagccattgtggtgcgcacctatggtctaaactacttgggagctgagacagaagaatagcttgaactctggaggcagaggctgcagtgagctgagatcgcaccactgcactctagcctggatgacaaagcaagattccatctcaaaagaaaaaaaaaaaaaagaatgaccattaacttcattctatcccttacatgcaacattcttgctccatcatttctttttatgatgttggcctaatgatttagtatttaagttttctttacaaactggataacaattaacaattttatagcaaagcaggggctctcccaactcagaaccactgctcgctcactcttatccgtagaatcaattcaggatgcttagtgtagctgtcgctggctgtttcactgacctatctcttgccgacagctccctcaaaactatctccccacctcccacacatacttgaaagggaactaatgtttatgctttcaatattatttaagtatatattttaattatttcaaatcatttagtattttactggtgaaggacgaaggctcaagttctatcttgtcctcggctacacatgcagtaaatgacaaagccatcttaccaaagtcgggagtctgcatttcctaagcacctcactgacatcctgcaacttggcttacaaacttccctcagctcaaaacgcctctcaaacacccccttctggtgagcacttacagactctctcatgtccagctcagagtcttctcttagtagctttttatggccaccctgagacaaaattaactgttgccccatgtgtgtatccgtggtctcctgcatagttttattagaggaaacatgcaaatacactattcctctgctcaccccactgacctacagctccttggcagtagggcttttatttttgtttgcttgggtttttgttctgagacagggtcttactctgtcacccaggctagagtgcagtagcgcaatcttggctcactgcaacctccgcctcccagactcaagtaatcctcccacctcagcctcctgagtagctgggactacaggtacatgccaccatgcccagctaatttttgtattttttgtagagataaggtttcatcatgttgcccaggctggtcttgaactcctgagctcaagcgatgcacctgccttggcctcccaaagtactgggattagaggcatgagccaccatgcctagtctgggcctttatttttaattctcaggactgactatagtttttgacacattgtaggcactcaacattcaacatccaataaatgagtgttggacctaatctagatagctactacaattattaatgaaaaggaaagagctctgagggaacatgcttccatccatatgcgtcatctataatatactgatagtgataaaaactgagtgtatagtgaaaccgtggtaaatatatcactatatagcatttttatcttaacacagaggttcttttaaaagcttctgaggatggcttatcagtacttcataagcaagagactactagcatgcaggcaatttacaaataaacataattctaattttcacagctaaacaattgagaagggtcataggatccttaaaaactgtttatgaaaaatagctcctgcctcaaatagctcacatggatctactgggggaagcattggtgacaggagtaaaattaacatgttgccaacctaccaatgtgcttttcttggatgttgtcacctattaacatcaaatcacctatacttgtttatatttgattatggtttttgaaaacacatttttgtgtttgttttttacttataagattaaaacacatcaaaacatttgctagaagaattgtcttttttttttttactgtgataacacttaagatacatactcttaagaaaattttaagtgcactagataatattgttaactgtacacacattacacagatcatctctagaactaatagttcatcttccataacaaactttatatctgtcagacagaaactctctattcatccctgcccccatcactatcccctggtaatgaccattctacttttttgaatttgactgttttagatttctcatataagtggaatcatgcacttctgtgactggttaatatcatctgacatgatgaccttcaggttcatctacattatctcctatgacaaggtgaataatgttcatatatatatatgtggggggtgtactatacatgtatatcacattttctttatatatccatctgtggaaggacatttaggttgtttatgtattttaactattatgaataatgctgcaatgaacatgagagtgctaatatcctttgagatactgattttaattctttaaaatactcagaagtggtattgctagatcatggggtaaatctattttcaaaattttagaaatctccatacagttttctataatcattgcatcgttttattttcccaccaactgtttagaaggattccaatttcttcatacacttaccagcacttgggttttgggtttgcttttgtgacaacagcccatcctaacaggtgtgaggtgtcctctcactgcggttctgattcacagttccctgatgattagtaatggtgaacatcatttcatatacctgttggctattagcatgtttctttggagaaatttctatttaagtccttttgctcattttgtaaccaagttgagtggatttttttggctattgagttataggaattccttacatattttgcatattagatgcatcagatgtatggttcattttttctcctattccataggtggcttttccactctgttgactgtttcctttgctgtgcagaagcatttcagtgtgaggtagtttcaattgtctatttttggtgcctgtgatttcggtgtcctatccaagaaattattgcctagacaaatgttaaggagatttccccatttccttctacagacgttatagattcaggttttacttctaaatctttgtttcactttgagcttatttttatgtaccacagaatacattaaaattggacccttttattataccatattcaaccaattactttaatgacagtgggtggttactgtataccttgtctgtaccgtttctctcaaaatttgcatttccctttgggaatcttttgcagttacatcccactatctacctctcagcatttagaaaataaatattttctcttccaaatcactattgacagcaaaatctcaaagtaaatccatatgtgaatagtcacttttaaagaataggcaagttaaatactcagcaggaataaaaagtacaactctgtctttctctttctgacacattttcttccctgctttcctccttcatcctgtgagatgagggatggcagggttgcataggggatacatttgaggtttacatcaatctcacacagcagggtgagaatgatcacactatcctagtcccccaccaggacctctggagtaatgtcacatttccttgccactgaaaatgctacctgatgtacattaccttgtctctatttcaggttttaataacaaattcaaactgtcttttcaaaccattttcttaaatgtcttgacagactggtactagtgttaccgtagataaatgcctgctttataccaaagagatatcagaataatttctcttcaatttcctcctgcattttgcctaattattttgaaacattttacagtatattccttggtcccattaaattaaaatatctctttcattctttacccattgctgcccacccaccaaatcatagtttctactctttgggttgtcattttggaaataacatcttactaactacaacattcatagttaaaccaaagaaaacaggtatcatttgtaacagtgttttttctccactgtggcatgtatcaaagatcttcttttttggtttattttacattgtctccaaacaaataaatctaaagttaaaatacaaagtatccttatcagaccaccccttatcagccacttcacagcaaagatgactgtgtgctgggccagcagcaggccattagcatgcacagccttttctctttgatttgtgctgaaatgtaggctatccagttcatactagccttcagccaaagccctgtgggaagtaactgcaaaccataaacttccagtcctttacagacatttgtaatagaaaaagtatgcaaatagagccaccaacattactagggagtctaacttttaaatgacttagtgttattggacttgatttgtaaatgaaaaattcagatatgatggcaaggctgtttttaacaactctcctgatgtgattgaggagttgatgtactattggggaattatatactttataacgtaataaaaatgatttttttttttaccagcaacttgatttatgaagaatggtgcacacgtctgctgaaatatcaaagtaaactttggttacattggcgaggaagctaaaaggctaatacctccagggcacataaaagcttaggccttcttttggtttcttttcagggtgaagataaatgccagattgagttactttgttttttaatacttaaatctaagactttaataacttttatattgtaagttaaggggtacatgtgcaggtttcttacacaggtaaacatgtgtcatgggggtttgttgtacagattatttcatcacccaggtattaagcctagtactcattagttacttttcctgatcgtctccctcctctcacactccgtgttctgacaacaggccccagtgtgtgttgttcccctctatgtgtccatgtgttctcatcatttagctcccacttacaggtgaaaacgtatagtatttggttttctgttcctgcattcgtttgctaaggataatggcctccagctccatccttatccctgcaaaggacatgatcttgttctcttttatggctgcatagtattccatgtgtatatgtaccacattttttcttttttcttttctttttgagatggagtttcgctctgtcatccagactggaatgcagtagcacgatcttggctcagctcactgcaacctctgcctcctgggctcaagcaattcttctgcctcagcttcccaagtagctggaattacaggtatgcgccaccacatccagctaatttttgtaattttagtagagatgggagatttcaccatgttggccaggatggtctcagactcctgacctcaagtgatccacccacctcggcctcccaaagcactagaattacaggtgtgagccaccacacccagccagtaccacattttctttatccagtttatcaatgataggcattcagattgagtaacttttattcaacaatttttcacaagtatatgcagtgtgcccatcatgccagccactgtcctaggtgctgaggacacagcagtgaataaaacagaccaacagaagctctaggcttttatatgtcctagacatattagccttttagtttcttcaccaatgtaaaggaaatgtttactttgatatttcagcagatgtgtacaccattcttcataaatcaagttgttggtttaaaaaatcattttttattaaatcatgaatgtaatgtctgtggccatacagacaaaaaacgctgccttcatggagtctatattctaagcaacatacgctgctcatcttcacagatctgagccaaaagaggtttctttttatttctaaggcattaatattaactcaggtcaaattttattcattttttacaaagtatggatttttaaaatgaatcatcattagaaaatgtttacctaatgtctaggaaaaacattattggtctgaggttcttttaactacccatctacttcacaaaatgttttgctgtgaattaaactacacagcctacaggaaaagataaaatccaagtataaataaagtaaagaacagcacctaacaagcacctcgtattttgtactttcctatttgatttgattatgttttcaatctcttccccctgttcacaggagaggccaactaaaacctaaagtttagtacaactttctggaaattctgcaaagtggcaaacaaactgagaaaatcgtatgccttaaaaacccatcactgatgttcttgatcaatagttggcataaataaatcgtagacatgtgggcaagactgctggagccaggcaaggatttttcttaatgtggacagtgatgtcactgaggcagagagaaggaaggcatatttacaataaaagggagtgattatacaatacattaaaaccataaataaatactccattaagttataaaattctctctatatgttcttaggaggccttcctgtcaggcacttaacttagagaaaagcaagtaaagctccatttatcattcatttagccaaaacttgctgaatcctgctctatgcccgccatgacacatcatcatcactactgtgtattaagagtttactacatcctatgcactgtgctcagagattacatgcatcatctcattccagcaatgatcaaccctataagctgggtgttctttttaataatcattatatagattaggtaaacgatactcaggttgtgttatttatctgtggtcacatggcaattaaataatcagatgtcatatgagggtatgtagttctaagatataaattcatatttatgttactaaataaaggccttctcatgcaaaacaatcaacatctaaattcaggggaaatccagacctatattctaaaaatatggagttaataggtgtttggctgacatactttaagatattctctaccccatgcaccaaaatcatgactagtcacttgaattaatagatatctacacacttcaacaacagctacctagaataatgtatcatggtaatttacattttttaaaattaagatacagtatgattgtataaacatatgtaaactttcatatagtcatattatataaaaagattctatataattacatgaggcaggataagtagtcaaggaagtaatcatgtccttgggatatggcaactgtggcaaccgtacagtcaaaacaataagccccagcatttgcaccgtagtccagctcactcaagcaaagctatctccagtagggaacttcccctggagggagcatgcacatgtgatttcacctgtcctcagactgaccctgtgctgatgataatagtgaaaaacacaccgatgggtggagatttaagatgctaatgagacatgtggcacatggacaagcatgtacagctactgcacatgtgcgtccagacgaccacccagaacatgcttactagtaacactgctttccacctccttatgaataatcatgtaaaactccccaaaactccctattgccagtctttgctgtctcatccttacaagcagcccaccctgaattctctgtctctcagggtgtactgtctattccgcacttaactttcaaaatatgcttttcttttgcagtaaatgactctgtgctgcatatcctttgctgtgtcttgtttaatttcttttaaactaagaagaactgaggtctcacaacagccttcaaaaattacacactgttaacttaaataacaacttgacagttcaaatttaaagagaactattcctgtttaataatcaatcccctttttactaagacaatgggaaaataacattcatgctgatcaccaactaaccacattgttgggttaaatcaaacctctgcaattcctttgagaacataatgatgtccgtggtacccagaacaccaaaattgcctagactaccttctagaacactgtacaatctagttccatcacctcagttgtatgtttaccaggaaaatatcaattcccaaacccatcatacttttagtgtatttacatgatttaagaatataagagactgatgaaatatgcggaagaaaatagagccattgcttccattacttttttcgaaagatgagataaatcgaattggtgagagtgattggctttatattagatggagaaatctttacaaggtgagaaagatgattacaaaagcccagaagaactgtgccttagactgctttgcaggcatccaagtttttactccactttgaaggaatcatcactggtgcacagtgggtaacatttatttgagaaagtagaggtgagactccaaccagtcaattcatatttaaggaggtctagaaccaagaattaccaaacagatgcacattataatgtcctaaaaacatttaaatagcatttttatttcttggtaaagcaacatttgttgctctagccaagagtttcaatcaactgacaaactagaagtcctaactgatttgaataaagggcttctactgtgctctgtgcaaagccttgggtagctagaggcaagattctctagcaacacaagctctacccaccccggttacccacttcagaaccctgcttttagttttgggtacggcctcgaaggattacaggtgatcagatggatgacatcctgagtcatcagtcagtgattcctggtctcagtcagtgattcctccaggcacatctcccttctgatactcctaaataccagaacagcagcctgggaaaagagcaagtaacactcacttctctctgggcatcatgtgtctcccaacccttgagtgtcaagaatcactcttttctaaactcccaggctcctcaaagagcagaagtgcaggcatatatcattttagaacggaaggaatattccagacttgctgctcaagaaacaaaagatgcaagtgtctttgggcttgttcaaaagtacaccccttctttctttgtgctgtgggcaagagatgcacatgccagtctaaatgaaccactgctgtgtttatgttcatgctgcgttccatcatgtttccaatcctttactctttctcaccatttactgaggtactctcacccctacttcacatcgacagccccacagctggtcatcctcagtcacagtcttgccagttctaagccaacctagcccccagagtctcattttatatgcacaacagaggtaggcgcattgtccattagcaagtcaaagacttcttaaatcactgaatggttcctaggcttcttggaatgatttcaggaacaacttgctgcccttggtccacttctcttccctatccaaatttcaaacaagtaactggtatcttcccagtcatcagttcccaagactagacttttctcccaatcagggaaattgggcttgttacatttccatgacatgtcattctgagtgccctgttacccgtctctatctggaagatggtatataaatgaaatcatttacacagtgccattctaattttgaaaggaattgtaggcatgtcaaatagggctcataccaaataataacattctaaataataagagaggccaccaattgaggtataatatgtaccaggtcctacgcctgtaactttacctgcactatcatttaattcgctcagcaatcctataaagtactattgatatcttaccatgaggaacctcagcgttaaaaacttgcccaaagtcacaggtcatgtaaactcatttatgtcaaatttccaatccaaactatataacccaaagactccccaaaggtaaccaaacagataaaatttatataaatccaaagtttttttcttgcctgtctttctgcaatattcagtggggcaataaatctctggaatctgtcatttcagtatatttttaataaagtagactctttcacacactctcctggaacctctctccagttgctcagcttggaggaactcaaccaaagtacaaataacatagggcaataagtgatacttagaatttaagatgctttgggttttatgttggcatacgattctgatactctaccaaattacaacccagcaagagaaatgtattatgaacttgtgtgatataataacaagttaaaaagagtcatcctttcttggaaatcagcatgttcaccccttttgtttttgcttttgttcttagaacttgctgctgtacctcttgcaaagtcccataaggtagaaccaggtgatatcactatctttacctgatacaggagacagaaaagaatttaaaaaaaaggccattttacacagaagggacctaattctgaatgattcaccaatattcgatgaatcactgatgagctatacctttgccctcttcagattccttcttggctgtactaccagtaagtttgaccatgtcaatgcagggagtttactcacataactgtacaagtttctaaaaatgtctagcaataaatatattattcttggaagttatgttctcgggaaaaagaggtgtctccacttacttaacaatgaagtagctcactgaatcatttaaatagtgggctgaagaaaacaacaaaatctttaaaaaacaatttatcatctcaaacttctccttgaacaactgtttcttttttatttaccttagagaataggcaaaggaaaataaaatcacttaacacatagagaactcaagatagagacacacctttagaaagagtcacatacaaactggttagtaaattaggctattgtcttataaaagttgttgtaaatcttaggccaatacattcttgaagaattgatatttgatgcatctgtaggtatttatatatatatatatatatatttgtatttatatatatatatttatatatataaaaatatatatatatttatatgtataaaaatatatatatatatatatatatatatatatatcaggtcatttttcctcccgctcattctttttttagttgtgtttttttttttttaattttaagagacaaggactcgctctgtcacccaggctggagtacagtggcatgatcatggctcactgcagcctcaaactcctgggctcaagtaatcctcctgccttagtctttcatatacctgggactacaggtgcatgctaccatgcctgactaatttttttaacttattgtagaaatgggatctcactgtgttccctgtgatggtcttgaacttctgggctcaagcgatcctcctgcctcagcctcccaaagcactgggattgcaggcataagccaccatgcccagccctggtcactctgaaaggaatgtcattctcttttttgaaaagagatgtgatttcattataatgcctaattgttttgccacatacctaaggttcctgattcatcctcctaagtgacaaagactttttacatagaatcaaaagaacttctggtggtgggaagatggtctatagaaaagaaaaactccccccatgcctatgtcctgaatggtattgcctaggttttcttctagggtttttatggtttaagatctaacatttaagtctttaatccatcttgaattaatttttgtataaggtgtaaggaagggatccagtttcagctttctacatatggctagccagttttcccagcaccatttgttaaatagggaatcctttccccatttcttgtttatgtcaggtttgcctaagatcagatagttgtagatgtgtggtattatttctgagggctctgtcctgtcccattggtctatatctctgttttggtaacagtaccatgctgttttggttactgtagccttgtagtatagtttgaagtcaggtagtgtgatgcctctagctttgttcttttggctcaggattgacttggcaatgcgggctcttttttggtcccataagaactttaaagtaattttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttcattgagcagtggtgtgtagttctccttgaagaggtccttcacatcccttgtaagttggattcctaggtattttattctctttgaagcaattgtgaatgggagttcactcatgatttggctctctgtttatctgttactggtgtataagaatgcttgtgatttttgtacattgattttgtatcctgagactttgctgaagttgcctatcagcttaaggagattttgggctgagacgatggggttttctagatatacaatcatgtcatctgcaaacagtgacaatttgacttcctcttttcctaactgaataccctttacttctttctcctgctgattgccctggccagaacttccaacactatgttgaataggagtggtgagagaggacatctctgtcttgtgccagttttcaaagggaatgcttccagtttttgcccattcagtatgatattggctgtgggtttgtcataaacagcttttattattttgagatacatcccatcaatacctaatttattgagagtttttagcatgaagggctgttgaattttatcaaaggccttttctgcatgtattgagataattatgtggtttttgtctttggttctcttcatatgatggattacatttattgatttgcatatgttgaaccagccttgcatcccagggatgaagcccacttgatcatggtggataagctttttgatgtgctgctggattcagtttgccagtattttattgaggatttttgcatcgatgttcatcagggatactggtctaaaattctctttttttgttgtgtctctgccaggctttggtatcaggatgatgccggcctcatacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaagaatcccatcaaaaactgggtgaaggatatgaacagacacttctcaaaagaagacatttatgcagccaaaagacacatgaaaaaaatgcttatcatcacttgccatcagagaaatgcaaatcaaaaccacagtgagataccatctcacaccagttagaatggtgatcattaaaaagtcaggaaacaacaggtgctggagaggatgtggagaaataggaacacttttacattgttggtgggaatgtaaactacttcaaccactgtggaagtcagtgtggcggttcctcagggatctagaactagaaataccatttgacccagccatcccattactgggtatatatccaaaggattataaatcatgctgctataaagacacgtgcacacgtatgtttattgcggcactactcacaatagcaaagacttggaaccaacccaaatgtccatcaatgatagactggattaagaaaatgtggcatatatataccatggaatactatgcagccataaaaaaatgatgagttcatgtcctttgtagggatgtggatgaaactagaaaccatcattctcagcaaactatcacaaggacaaaaaaccaaacaccgcatgttctcactcatagctgggaattgaacaatgagaacacctggacacaggaaagggaacatcacacaccggggtctgttgttgggtggggggagtgggagagatagcattaggagatatacctaatgctgaatgacgagttaatgggtgcagcacaccaacatggcacatgtatacatatgtaacaaacccgcacattgtgcacatgtaccctagaacttaaagtataataaaaaaaaattttaaaaaaaaagaaagaaaagaaaaactctgactccattgtcttgaaactttgtttttgccatctaattccttaggcacaattttctggctgaggagaaactgcccaaagaccctagttccgttagattgaaaagcgatgaaaggaacagtgcaatgttttcttgatggggcactatggcctcaccacagatgtggcttagttacctgagccctacctggtaactccatgtggattaccataagtactctaaaatatggtaatcaaatactaatgcacgtaagtattgcttggaaaacagagtaagacagtttccccggccctatctccagagattctgattcactaggtctgggtggggctcatgaatttgcatttcaaataaactcacagatgatgccaaatgctagcctgaggaccacattttgagaatcactctagaggactgggattccaaagcactcagggtaacctgtatcacagactgtatctaaaatgttgttcttggattacagtggtctgtagctttaagaagcaattatgatacgtttcttaccaaaggtcatcaaagaaagcacactgctgtgatggcaagctatccacttttataaaaagaagaagaagaagaaaaaaaaaagaaacaaagtaatggctcttctcttggaactgagagaaagctgactctggtttacgaaggcctatctcattcctgatcgtttatcatttgagagaggtgtgaacagtctatgtcaaaaatgctcattcaacattcccaggaagccactcacagggctgaatgtaattttacttaagcctgtctgaacttgcttttcttatttttccccctgtagacacacgattttctttctttgtaagaaagaattcaaagacaaagacacagatgtgatttcaccaaactagcaaactttaaagcaaaaaaaaaaaaatcatccatttctgtttatagcaagactccctgttatccctctactcatcttcctatgcagagagaaaatgtgaaactgtaatagccactcttcaagactgattaaataaaaatcattcaaaagcctgtgttgataacatattcctatcttttgtgtgcaaatccatattgtgtttcttggaagacctaatatcctagaaaaaatagacctgcttcttactgaaaagcagcagttggaaactgaaatgcctacagtacaagtagtaacaaaattaatggaccaagccaggagtgaagcaagggagggtaggagggacaatggagttcttgagagtcctggcattactgggagaactgcaactaattagcttcagaaaaaaatccaattctgataatgccaattggggcatcattgagattctttccattttttgtttgtttctcttggtcctctttcttgatgtgtctgaggattttaagtagaattacagaagctgtgaatgcagaattatagagactctgcatgatggtatctcccaccaaagaaggttcatcctactctctggcagccagtctgaaatggggcgttactttcatccaatttggaattgagttgactcaaagctggttagtgttttgaaagatgtggtccacctctggtttacacacactccataggtgtggtttaaggcctgtggggtacactagtacacctgtcattcgtggatgtgcaactctacttattttaacctcagccctaggagactatcaaaaacacacacagtggctcacacctgtgatcccaacactttgcaccaaggtaggaaaatggcttgaagccaggagttcaagaccagtctggtcaacatagcaagaccctgtctccacaaaatacttaaaatattagccaggtatgctcatgcacacttatagtacaagctattcaggaggctgaggtgggaggactgcttgagcccaggagtttgaggttgcagtgagctatgatcattctactgcaatccagcctgggcagcagagcaagaccctatctcattaaaataataataataataataataataataataataataataataaaaagccttcaggtataaatctacccaaggcacccatcttctctcttaggtcttggttcctctgaatcctggctgctttggcagacccaaacttctatgcttgtctcttcagccttatgagatcaccaaaaattatgttgcccacaaggtatgattttctagctgcctgttttctcaactgctccttgagccaaaacccagcaaattccctgaagggaaaagcagcctgtggactcccggctcagcactctatagttccctgatttctgggtctcttggttgtcttggcagttctttgttatcttcaaattaggtttacatgtggcttttctattgttttcaaagaaacatcagtttgtcacaagccactctaatttagccaaaagcagaagtcctcaggttaatttaatagagtaataatataattacttccccaagaaataatgtttttattctgaatatgaggttaaattcaaatttaaacttaatccatatgttacataggaattattttgttaagaattagcttcaaatatgataatacacatattctattccaaacaacatgacaactcattcttagttcaatgatctcttttaagacagatatatcaagcaatttttgtaatctgtcagcaggcctcaaagaaacttcaaataaccataaatcagtgttatcatttggagtacttgagatgctctagataaatatttgatggtagatggacactaggcagaggaatagtttcatctaatacaataataaaaaaaatcacaagacacccactagtaagtttatcagggagcaagatggagaatgttgctgacagaataccactcctgcagctgccagtaataattcacccttgaagcaaagagatggagatttaaatggggacactatccaacttaagcctttctgtagaatatagtgtcctagatgaagacgtatgtagtaaagatgggggaaatgaccaaattattcgattaccatgtgttacctccaactgggacttccaatattcctgaaaattcacctgcagaagaaagtaaaagagaaacaacaaattctcaccatgaaatgattttgaatgctatttcagaatattaccctgttagatcatctcatcaatgaattcaggggccctctattatgtaggtagctcaagaacgtagcagaagccttggaagggactgtccatggtggatactgacctcaattgctctcggattataacggactatagcagtggatctcttgagagggctttagtctcttccttaacatgcttttatcccagggtgggattactaagatcaaatgcccaggcattcaaatgatggagatgtagaatggtatcaagtttggcacacatcctaaccaattaattggttttcataattatcaagtgttaagatggagtcaaaaaaaatcacacaaaaaaacttaggtctaaaagcaaacaaaaaataattttagctatgtgtgcagtatcaagtggtatcaactgatgtccaaaaaataaaaagaagagcattttctgtatgtggtaggcactgtgccaaggatattacataaaatctgctcatcttcacagtaactctgaattaaataccgtcataatcctcattcttacggataaggaaaatgaagcagagagtgggtaagtaatttagtcaaggtagtaagcagagagagacaacctgaactagctctctggatgcaacattgaaagctcttaaccgcattgctttactggcctcctggacagcattgatcattttccctgcactttaagaatgtaactacggattatggacacgtgcctttcctagctattcttaaattctgagcttaatataaaattaatgacatcctgggagccatgattcttccctactacatctcactaagaacatggtttatgaaatctttatagctagttgaaatgtgtttactaagtcttgccaggaagctcattttatagggatatcacacacaggcaatataaattcctatggggctaagaagccttcattccaaccagtgcttttcctccaagtaattcggtaggtttggaaaatgaagcatctggtctgctcttttccacaagtttctaagcttgaataaagatcactcacttgatacagaaagggttggaaaaattccagatctggcctctgaaggttacttcccagaatgcggctgttaactacctattactgtttagaccaagtatctttgagagggaaaaactcgctttgattgcctaggtacttcaagctgcaaatctgcatttcagtgaacaactactaagtaagcagacaggaaagagaaccagtgccccggtctgtatgcaacatcttgttctagccttttgtgccgaaaagctatgcaactgtgagaaagtcacactgtaagcctcagcttccttctcaataaactgaagatgatgatgatgttcttataaaggtagcgtaagtgaaagcacttagaagttattcaaatatgacatcatatgcgcatacacacacacacacacacacatatgcagtaatgtggcacttaataatggagctatgttctgggaaatgcattgttaggctattttattgtgccaacatcacaaactgtacttacacaaacctagatggtgcagcctactacatacccaggctatatggtatagcctattgctcctcctagatacaaacatgtatagcatgttattgtactgaatactgtaggtaattgtaacacactggcaagtatttgtgtatcaaaacataaaaaagatactataaaaatatggcacaaaaggtagctggcgtggtgactcaggcctgtaatcccagcactttgggaggccgaggtgggtgcatcacaaggtcaagagatcaagaccatcctggccaatatggtgaaaccccatctctactaaaaatacgaaaattagctaggtctggtggcacacgcctgtagtcccagctactcaggaggctgaggcaggagaatcacttgaaactgggaggcagaggttgcaataaaccgagatcggggcactgcactccagcctggcgacagagctagactctgtcaaaaaaaaaaaaaaaaaaaaaaaggcataaaaggtagaaaatgaaaatggtagacctatatagagcacttaacatgaatgaagcttacgggactagaaattgttctgggtgagccagtgagggagtggtgagtgaatgtgaagatctaggatattattgtaaactactgtagactttaataagcactgtacccttaaggttacactaaatttattaaaaaataaagtattaataattgcactatgacattacaatgtctacgtcaacactgggcaataggaatttttcaactccattataatcttatggggccactgtcatatatgtggttcactgttgactgaaatgttttatggtacataaatatatatatatgtgtatatatccccaagatataaatatgtatatatatctctaagagctgagctgtgcatattatccaggtcctgtatagaactgtatagaactatgcaagtgacaaagcagaaaagaataaacagaaaaagtccattaagccactccagaggaagtgagtttgagaggggatgctggattttcataatgagagaaagataatgcagagcaggaagagagattttaaaaaatgaggagctgcaggtcagctacagaagtgggttccagagagttccagtaatgccagcactgggttaagtggggaatttggggatgaaataacagcagacaatgcctcacttattaatggaaaatcatttgatatagaaaagttgtgtgcaaggagccataaaccaaaaacaccaacaaaaaccatgttttcaagaaggaacctgcttgtaacgagccagtgaaggtatataccaatttaagaattaggtactagtgacttcgaattatttaacagccaggtccatatagagaataaatagtagactatttttctcatatgggctatttaagtgagagatataagcagataaaacttcttaattaattgctttcaatagtttagagttagaataggtattttcaatttgtataatgaaaacttgtttttaggagttcttgggccaacgaagaaggcaatcgcaacattaacatagtttgaattaaacatcggtaaaacaacaactaatgaaaagcccaatatgtttttcttactacttgaaaaaatatttttactttattttttttaaccattttatcaaatggttatcaggggcccagtgctcctgaagtcaataaccaaggttcagaaatctttacccttttgctttttgggaaacgtcctaagccacgaaaaccaacttgccgttgcatatcataaggcccacctccagccttcctggttccctgtgttataaatcttcaccttttctccctcttctttcagaccttcttcatttctgaacatccccccacttcaataacccgaataaactcatctccttaatggactggtacatcttgtctttgacatatttaactgttacaagaattccagaaaactgatactagaaaaaaatgaaaccatatagtacatacacttttggtgctattttccagaagttgtatgaatgcaaaatctcaggtaaacaaaatttcataaaggatattaaatatcagttgattatactagtgccacaatcccaagaaagaatataagtatctacggaaaatctcattttgcacaaagataacttagtacaactaaaactagttcaacttttttagaaaaaacattaagcaagtaaacctgactctccaactatgagaagcattccaaactgagcatgaccccataggtagcactgggagattgcataaggaccagaaggtttctagcaatatgggaaaaaaagaaaatcacagctttagcaaaggaacaaagtcctaactatgaagatgacttaaagatacaatccttaggcccacatgggaccctgaggccacccacttccaaatttgagactcccttaatctcaaatccgagccacaattcagtgggcctaactccaattgatgtctcaagacttgtaattttctacaagtttattgctttccctctgagcaaataaacataccacactttatttctatacttctgtgagatttctcatataaataaatgcccaaatcttgggaggagaaatactgtaaccacatatcttcatttcaggccctgcataaatcaatttacagtgcaactctaaggtaaaaaaatgcagcaatagcagccacactcaataataaaatcacactaatttggactaataattagtaacctacttcctgagcactgcaccaagcgattcatatgctttatctcatttcagtatcaggaaaaccctatgaagtggtttaaagtggccccatttgacagatgtgaaaggttaggaccagagaggctttactgtgtacccaagatgactaaattattggaaagtaagtggtaacatagtaattattaagaaaggattcaacatgcatcaccgttatagtcaaaagacattggaatttacatgagaccaatagaatgtgaccaaataaagatatttaaatgaccagtttaatgaattcaaaacaatgattagtaattaacacatcaatctttgaatgtcaatggataattctaaagtgctgcagcttgcttgaaaagtgccttctctcaagctgattaaatattctctccaaaaatcttgtttacattattaatttgctcaataacccctgtcttcagagaagtgtaaacctctagctggtccctgaagagttagcacatatttttaattaaaatggtcttgaatcaattgagttattatttttccaggttatattactaacaatattaactccaaataagatagattaaaaaacaaggtacattgaaagtatgcaaatgtaagtgtcttcaacaatgaaatatctaaagttcatataaagacctgactccaaattatgaaaaatggaaaattagtcatttctgtagtgtacacgaatgatttgcaacagcaaagaatgtaaggatgtgtcaaaagtttacaagttcaaagtacaaaatgaacacttcctttaggaaatgctaaaacaaaattaaataccattagaaagattttgacactttgctcttttatgagccaaattacagtaacagagttgggaatataatgatgcaattatacgctgtcatgaacagtttaattattttatgcctgagcagattttttttttttttaactcaagtgccctatacaacttccacacctgaatgcttctaacttggctttgccattttctgactctatttaattttctggggacacagaaggatggtccttactttaaaaaatggttctatcaaaattcattctcttcacttttaagctcttaaaggcgaggtaacagtttttcagcatacactctccagagggctaaactcattcattcattctttccaatgctccaatgcctccgccaggccaggcaccaggctaggatgcaacatagatagatgtgggaagtcaagggagatgactgacaaacgaggaaaatgaaaatcaacaggaagttgtaaaacataaaggcagctatgggtcatgtctatgccttcaggtttcaccatcagtcctgttttaaatcctagccctgactctatgtaagtatttcagctctaagttaatctcttcaccacctggaaaatgggggccatgaagatctctccctcacaagttgtgaggttcaaatgagatgacgatgcaaatctggcacatagtatatgcccagtgaatatcagcagctaccgaatgataataattgtatttttattactttttgtattatcataagtgtcacaataagctatataaagcatgctaataagaacactgaggaaaagcaataaatcttcctggagtagctcattccgaacagacaaaagtttcaggggagagagggagataatgctgagtaatgggtcttcaatctctatgagaaaaaaaaataacctaagcattgttcaagagaagatgccatgttcatttaaatgactatttcatcttaagaaagcagtctgagctactaatcaaaccagaaccctagccatgctgatgatgatcattaatgtcatcatccataaattcatttgctgtgtcacatcttggtgtaggaatactcatttgttacagttatgtcttcagtttgatgtgaagagaaagcaaccataaagcaacttcaaggaagctcctccaaataattaaaattctgaagcattcctcaagccaaaagcagatcagaccctcactgagggcactttctattaaataagcaggctgctatttgttgttcttgcagcacaagtccttgagctcacaaatcccacagcaccaaaagtcattattttttaaccaaactttttttttttttttcttgagacagagcctcactctgtcacccaggctggagtgcactcgcatgatctcggctcactgcaacctccacctcctgggttcaagcaattctcctgcctcagcctctcgagtagctgggactacaggcacctgccaccacacccggctaatttttggtatttttagtagagatggggtttcaccgtgttagccaggatggtctcaatctcctgacctcgtgatccacttgccttagcctctcaaagtgctgggattataggtgtgagccaccacgctcagccttaacctaacttttaaagtcctaaatatatcttcttaataaaagggccaccatttcttgtgcacatctggagccctttctgggcactagtcactgtgcaaaagttgttacacacataacctcatttcccacaatccttcccaggagacactacttatccagggttgtaaagataaggaaactgaggcacagagatttttaagtcacttacgcaagttttaccataacaaacttgggtattacccaagtttaatattaccataataaacccaagtttactatcaaacagcagagctctgatatgaacccaactttgaactcaatgtctttagtgactatattatagtatgagtaccttgagaatatatatattttaaatttccttatttttaaaaaacaatactcaaattcaaaatacaaattaagatggggtgggtgaggtagggtgaggggagtgaatggatgaaagaagggaaaggaaggcaaattatccagccactacagtcagatgttaaagtagaattcagatatcaaccccaatcgggttgggttttcattatgatcagacaagactcttcttgaccaaagactgaactcaatttctagtcaatgtcttagataacaagggccctcatccattattagactttgaggtcttttccctccatcattgagcttcagctcagcaatcttacggccatttacaaggtgactgatgagccttcatcataaaacaagatgaaagcaacttgcctacatgcacgtcttcaaaaccaaccaaatgaaccaattacagaacaaaaccagtttagtgtgaggatcaaaatgtgataatgttttgttgagcacagagataggcacatagtgggttgcttgtttatttgctttagtatgaataataattattatggatattatcaggattcctaaaaagagtcatttaactattatgggaacaatataatatactagatgccctttcctcaaggttatgcaacctacatgggaaaataactaaaacaaatgagtagcttctgcaattaaggatcctgagaatgacttccctgcttgatttgtggtagtagctgcatgcccaaatggaggaaaattatttgaataaacattggtcagtggggagaagtgagttttaggactaggctgctttcagagaaattcatcaagaggaaaaaaatacataattttaagaagtcaaagcctattattagaaaaatatgttcaccaaatgcagctctaatacctttagcaatgagataaactgagtctagcaagtggttggactcataatgattcgatttctttaactagcccattaatccaaaagatggccaatccacgttcatgaagacactgccagtgagctagaatatctgaaagagttggcataaaaagctccaccacatgcaattaatccacatctgatcacatgcccctgaataatgtcagcccacagatgggtttgtacacacaagatacagtgttgcctttaaatattcacaaatatttttaaagtataactttttaaaaaacatatatgactcagaaagaacagaagggttgcacaactcccagatatctgaaatgatggttaccgacaaatcttcactgatgctaaagaacatttatttcacacctactctgccacattcactcccacacacttccccaaaccagaattgaattgttacttcactttcatgctgacttcagacataattgtcacttctgcaaggtcacactttggggaacactatgtaccttcttaaatacaacattaattatggaactaacctatttagtctcttgccctaaagacttcagcatttaactcgacttccccatagtttactgtatcatagcaattaagttaatggcagcagcagcagcagagaatcttttaacccctaatgggcttgttcctctgattagactagatcaaagaagctgcagctatttggaggcagattagagaggcttcttttttactgatatcagcactgaagagtggaagatcatgtgtgtgttgacatcttacccaaatccatccatgacagtttacactgaagttattcttaatgaagacttttaatacatcaagactatatggatcaggaggcatgaaagcacccttacattcaaagagaataaaatacctaggaatccaatttacaagagaggtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagatactaaggactttcttcacagaattggaaaaaactactttaaagttcatatggaaccaaaacagagcccgtattgccaagtcaatcctaagccaaaagaacaaagctggaggcatcacactacctgacttcaaacaatactacaaggctacagtaaccaaaacagcatggtactggtaccaaaacagagatatagaccaatggaacagaacagagccctcagaaataatgtcacatatctacaaccacctgatctttgacaaacctgacaaaaacaagaaatggggaaaggattccctatttaataaatggtgctgggaaaaccggctagccatgtgtagaaagctgaaactggatcccttccttacaccttatacaaaaatgaattcaagatggattaaagacttaaatgttagacctaaaaccataaaaaccctagaagaaaacctaggcaataccattcaggacataggcatgggcaaggacttcatgtctaaagcaccaaaagcaatggcaacaaaagccaaaattgacaaatgggatccaattaaactaaagagcttctgcacagcaaaagaatctaccatcagagtgaacaggcaacctacagaatgggagaaaatttttgcaatctactcatctgacaaagggctaatatccagaatctacaatgaactcaaacaaatttacaagaaaaaaaacaaagaatcccatcaaaaactgggcgaaggatatgaacagacacttctcaaaagaagacatttatgcagccaaaagacacgtgaaaaaacgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtaggaatgtaaactacttcaaccattgtggaagtcagtgtggcggttcctcagggatccagaactagaaataccatttgacccagccatcccattactgggtatatacccaaaggattataaatcatgctgctataaagacacatgcacacgtatgtttattgcggcactactcacactagcaaagacttggaaccaacccaaatgtccatcaatgatagactggattaagaaaatgtggcacatatacaccatggaatactatgcagccataaaaatgatgagttcatgtcctttgtagggacatggatgaaggtggaaacatcattctcagcaaactatggcaaggacaaaaaaccaaacaccgcatgttctcactcataggtgggaattgaactatgagaacacattgacacaggaaagggaacatcacacaccacacacaggggcttgttgtggggtggggggaggggggagggatagcattaggagatatacctaatgttaaatgatgagttaatgggtgcagcacaccaacatggcacatgtatacatatgtaactaacctgcatgttgtgcacatgtaccctaaaacttaaagtgtaataataataataataataaaagaaatcaccgttatatatttcaggcaaaggtacccagtagctttaggtttttatgcccatctgctttctcaacacaccttgaccgccaactctagatgtcaaaagctgatacaggagtcatacatcattcaattacgttcttcatgatatgggggctatgtgcattctactatatatatttttaaagacatggtctcactctgtcgcccaggctggagtgcagtggcacaaatcacggctcactgcagccttgaactcctaggctcaagggatcctcccaccttagcctcccaagcaagctgggactacaaatgtacaccaccacacctggctaatttgtcttatttttttttttttagaaacaaagtctcactatgctgctagggctggtttcgagctcctgggctcaagcgatcctcctaccttgttctcccaaagtgctgggattacaagcatgagccacagtgcccagcccatttttatcgttggtggaaagaaaagcattttttataatgtgtttagatgtcatactcaattctagcttcatcaaaatcacttggagcttttacattaatgtttaaaatacaagctacatcccagagctagtgaattagtatattttaagggttgagccagaaatttatagtttaccaaagtttccaaggtgattctaataatgacctagttccagaaatcactggtatatgccataatgcaaaggtataaagatagtatacaccaagtaaataaatgtcaaagatcaattaactaaaacaaagagtgggttgggaaaaatgagactgcctgagactaaaatctcattctccatcagctattaaggtagataaattacagcacctctttgagtttcaatgccctcactttcaaaatggggcagtaatagctaccacagatacataggtacaacgcgcttagcagtggtttgaaaccacaataagctgccaaaaagcatggctcattttgctttttaaccagattctagatcttctaaacaataaagctgattataaagacattttccacaaaatagcctttttcctctccttcaatgcttttcacttaatactgtacttcttgcaaagtcagtaggctgagcatgaacaaattaaaattaaaagctgaattacttaattaattttaaggcactctcagttcattaacagcattcctgcaagttaaaaaacaagaaaacacatggaatgattgtaaaccgcatcccaatttcagaaatgttcaaatatattggggttggggaggtgagcagggcaatctactgccatatcaaacccaaaagcttctcttaaaaaggctatgtacatgtatatgcccaccagacaagatgtccttctctcatgttgcaatcagcaacccaaaagtcctgtaaaatagccaaaggtcaaaatagttcagaaaacactacttcttatagtcctcctctccacaaccctcttttcagaagttcgtaactggcatattcacatatcaaaaaatctgaaattaagaaatgtcttcaacaaatatgtctatcaaacttgtcttgaactttcctcacttacctttcggggggcaaatctgatgaggacttattttgggaaacattaaaattagggaaagtcttttggttatacttattaggaaaatcattgtccaagtgtcctgtcttgccagaatgagaggtttataaggaaagaagttccacggctttggactaataaccaaccatgggaatcacagcttccttccaagggaaataacacctttttttaaaatttgcttttatattggttaaaaaaaaaagaaccatgaggaaacatcaagaaccaatattacttctttggaaaaactttttggggatattgctaaggatttatattgcataattcaactaaacgaattttttagttttaaaaaatcccaataatattataaacctagaaactgtttattcagatccaccttggtaaaataaatacattcaataaacacagaatacagacagctttaattttttacatgtgggtcaggaggatccatctctcccaaaacatgtatcaccccacatgtgctgtgatttacaatcctcaaagcattaaagtttaatttgtgaatctactgtttcagattcattggaattctgatccaatagtcactctaaaatagatgcaggctggaagacaattctctacattttaaagccagatggcccataacagctaaatattttttctttccttgttcagaatataattcatgttggaagtagtgaatcaacttaagtacgtacaaatttaagggaaccttagtcatcagtcccaaacttaggaatctatttaaaggaaatatattttaaggttaagtttaaaaaataacaaaagagaataccatatgtaacaaccctggcacagaacactttctttaagaaaactcccttaacgttaacggcaaaaaaatactcttcccatttcactatggtaactaataaaaattttttcttcacactgaaaaataaaatctttatttaatctaattctgtaagtgccaaaaactctgattattttatcaagttattaaatatgttattcagtagtgagccttattgattttccttttgattagaaaaattaccaaaaaaatccagctctacagttcataacctgagaatggtagaaacccaagacgtagagcacattatgcaacactcttaaacaaatctgcctcttgggatctctctccttttatagaaagagactctccagcagcccctagagacattcccatactaagtgagtcagctaaataaaattaagcaactaataaaacaatatgtcatcttgttctcattgtcataattaaaatcctttttctttaagatgaaaggtggcagctatagagtagccttcaaaatcataggctatgccgaagcaggatcttctctccaacgctgtacagacaacgcagctgtccctgacatcaccacttgaaattattccctatttgatatttttgacattaaaaggctgaagtcttttttcttctgcaagttacttccatgcttgcttattaagcattccaagttggtctctcacccaatagccttagaaagcagaccatcattatttagggcaaaggtttccagaggcagtcagaggcaggataaggatgggggatcccaaacaagccatgctctttcctaagcaaagcacctctattttgaatgtgtttgatacactgagcttccaaataagattgaaattgattttaaaaaaagggaacccccgcccccctttaagccaggtaaaaactataaccatccctgtcaagagcgttacatgaatctgtaaatcctatgacagactaccggttgaaaccgaggttgaagtcttcagttcgcctgactcagtgctggtacacagtaaaaactaacactgaatgggtgccccacagtgagtgaggcatttcagcaggaccggggggatgttatgcaacaaaaacagttatagcccttgtctgcctggagttcacaatctaatggaaggatgatcattacatcaaatattaaagagagctaccatgcagtaagcccattctagacatcagctgccgttctaatatcaactcatttactctccaccacacctttaagaatgaggtacagtgatcactccccttttacagaggagccactgaggcacagagttggcaaggttgctaagtggccaagtttggtttgaagccaacggtatggcttgagtgcccatggctcaaccactcaaccctacctcctctcccaaacactgtaagaacccaaatgtcaaatgcacctagggcaagtcctcgacagaaaggcatggggtgtgaaaagaatgtataattagaggatctgaccaaggcagggagaacaccactgaggaattaatgcaggagctgagagcggaaagcagggtagtgaagagaggagggaagagcatcgaggtaggagcaaaagcaagagatccgccaggataaagggcttggagagcaggaggactagaattcagcccatcaggacagagaacataggagggtggcaaacaggaggttatggccccaggcggacaaggaaagacaggaaggtgccaaccatgctggaccgggctaagacagctggggagccactgagggcatgctgcagggagatcactgggctaatacttgtgagtccaaaagacttttctggctgtatctacacagtcatggcacagtcctcccaataggcaggccgacacaaaaccaaccctgctctgtatcactccatgtattcctggtcatattgtcacagcctgatgtgcactgaccacctctgtgctgtgccacactgagggagcagctgctccagctaatttctacccaacattcaccacctggaggcaatgcattggctcctcaggctttagcatggcaagggaacttcacaaataagaaagtttaaaaatgatgttactctcttcaaaatcttttcttcatttgtaggtggcagaaggcaacagatatatcacatcattgagtaccatgggacatgtgttcacactttaaagtacttaggtgttatttcatgtaaatgttgagaaggaaaaaaaaatcctgtttttcttgtctcttgggaatcagctttggttttctgaagaaatagttcacaaatctaaggaaaatgatatatctatacttatttccctaaagagaacataatttttcttcttttggttgataaggatttaattgcatttagaaggatttaatcacataaggctaaccaatgaaacactaactgtgggcagaactctgtttcagttggccctattggccctaaaatgtcattgatagtgactaaatatacacattactcctctcccccgccatcctttctcctccttccatttctccttctcagaacagagaaataaaacgtctaggaaacccatcatttactggggaaaggaaggggacgtgtaacatttcaaactgtaataaggcatgaacttgccaagctgtccatgtgggaggttatagcatgcccagagaagttgcccagaaaatagacatggtttccaatcaaaaaaacttagaccagttgaaactctggctttgggcaatttacttaacttctctgggcatcagtgttaacttatgtaaaatggagacaatcacaatatgtaccttaccctgttgtggtaagattaaataattggcacagggcctgacacaataaaggttaatgatagcagctgttaattattatccacgaatcagtttaactttaagaaaataacaactactttggccattctagcaagtgtgtggcaaagagggataacagaagctccttttgtggaagaacatgtaatttgccctttatttgcacagtttggaatcatcatcataacatcctaatatgccttgaaatcctgtgaaaaaacagaagtaaacaagtaaaaccaccatagcaacactatggcagaactgagttcactaaaagatcttgtctcttgctcaaaaggcttgactcaaggaaaagaactaggtatttctaggttcccctgcattcatttttttaaaaaattgttgtgggtacatataagatatgttgtaggtacatttatggggtacaagggatattttgatgcaggaatacaatacataataatcacgtagggtaaatgggatatacatcatctcaagcatttatcctttgtgttacaaacaatcctatcatatttttaagctattttaaaatgtacaacaaattactgttgactgtagtcaccctgttatgctatcaaatactagatcttatacatcatatgtaacaacatctgtgtatgcattaaccatctccccctccccaactacccttcccagcttctggtaacaatccttctactctctctttccgtgagctcagttgttttaaatttttagttctcacaaagaagtgagaacatgtgatgtttgtctttctgtgcctggcttatttcacttaacacaatgacctccagttccatccaggttgttgcaaatgacaagatatcattcttttttatagctgaatagtactccattgtgtatatgtatcatattttctttatccattcctctgttagggacacttaggttgcttccaaatcttggctagtgtgaacaatgctgcaataaacacgggggtacagatagctcttcaatacactgatttcctttcttttgggtatatacctagcagcgagtttgctggatcatatggtagctctttagtcttttgagtaacctccaaactgtcctccacagtggttgtactaatttacattcccaccaacaatgtatgagagttcacttttctcaacgtcctctccagcacttgttattgcctgtcttttgcatatcttttcattattttgtgtcctcttcaataagccattttaactgggatattactgtagttttgatttgcatttctctgatgatcagttatgttgagaaccttttcatatatttgccatttgtatgtttcttttgagaaatgtctatccagatctctgctcattttttaatcagattattagattttttttcctatggaattgtttgagctccttatatattttggttattaaccccttgtcagatgaatagtttgcaaatattttctcccattctgtgagttgtctcttcaaattgctttcaaatttgctcttcaaatttgtttactttgctatgcagaagctttttaacttaagctatcccatttgtccatttttgctttggttaactgtgtttgtagggtattactcaagaaatctttgccaagaccaatgtcctggagagttcccccagtgtcttcttgtagaagtttcatagtttgaggtcttatatttaagtctttaatccattttgatttgatttttgtatatggcaagagataggggtctagttttattcttctgcatatagatattcagttttcccagcaccacttactgaagagattgtgttttcctcaatgcatattcttggcaactttgttgaaaatgagtttgctgtagatgtatggatttatttctgggtcctctatagtgttccattggtctatgtgtctgtttttatgccagtaccatgctgttttggttactatatctctgtagtataatttgaagtcagataatgtgattcctccagtactttttgctcaggatagctttagctattctgggtcttttgtggtattatgtaaatgctaagattatttttttctattttcatgaagaatgtcattggtatttttatatggattgcattgaatctgcagattgctttggatagaatgggcattttaacagtattgattcttccaaaccatgaacatggaatatctttccatttatcttgtgtcctcttcaattttttacatcaatgttttatagatttcactgtggacatctttcacttctctggttaagtttattcctaggtagttgatttgtagttattgtaaatggaattactttcttgaattatttttcagattgtccactgttggcatataaaaatgctactgatttttgtatgttgatttttatatcttgcaactgtactcaatttgtttatcagttctaatagttttttggtagagtctttagatttttccaaatataagatcgtatcatctgcaaacaaggataatttgacatccaacttggataccctttatatctttctcttgtctgatttctctagctatgacttccagtactatgttgaataacagtggtgaaagtgagcatgtttgtctcatttcagattgtagggagaaaaccttcaggtgtttccccttcactatattagctgtgggtctgtcatatatggcttttattgtgtcaaggtatgttccttctatacacagtttctgtgggtttttaatcatgaaaggatgttgaattttatgaaatgctttttcagcaaaaattgaaataatcatatcgtttttgtccttgtgttcatatgatgtatcattgattgatttgcatatgttgaaccatccttgcgtaactggaataaatcccgcttggtcatgataaatgctttttttaatgtgttgctgaattcagtttgttagtattttgttgaggatttttgcatctatattcatcagggttacttgcctgcagttttttttttttttttttaatgtgcctttgtctggtttttgtatcagggtgatactagcctcctagaatgaatctgcaagtattccttcctcatcagttttatgaaacagtttgagtagcattggtattagtggttctttacgcatttgctaaaattcagcagttaagccatcaaatctagcgcttttctttgctgagcgacttcattatggcattgatctcattacttcgtctgttcaggttttgcatttcttagtggttcaatcttggtaggttgtgtgtgtctagaaacatatccatttcttctaggttttccaatttattggtatatagtagctcacagtatcttctaatgatctttgaatttctatgatatcaattgtaatgtctcctttttcatctctaattttatttgggtcttctctttttttctgaagatttgtcaatttgatttcttttttcaaaaaaacaactttttgtttcatttaccttttgtattttttcatttcaatttcatttatttctgctctgatctttatttttccttctactaattttgggtctggttttcacttgcttttctagttgtttaaaatgtatcattagtttttctactttttgatgtaggcaattactactataaactttcctctgaatactgctttcaccatatctcataggttttgatacattgcgtttccattttcatttgtttcaatatatttttaaaattttcttaattttttcattgacccactggtcattcagaagcatattgtttaatttccatgtgtttgtataatttccaaaatttcagctgttattgatttctaattttattccatggtggtcagagaagatatttgacataatttttaaaaaaatgttttaagatttgttttgtggcctgaaatatggtctttcctcgagaatgatccatgagctgaagaatgtgtactctgcagccattggataaaatgttctgtaaatgtctattaggtccatttggtctgtactgcagattaagtaagatgtttgctgactttctgtctggatgatatttccaatgctgacagtgggtgaagtctccagctattattgtattggggtcttatctaataataactttacataacatatatgagtgctccagtgttgggtgcatatatatttacaattgttatatctcttgctgaattgacccctttgtcatataatgaccttctttgtctcttaccatagtttttgtcttgaaggctattttgtctgatataagcatagctcctcctgctctttttggtttctattttcatgcaacatcttcttccatatctctttatttttagtctatgtgtgtctttatattataggcgaagtgtgttcttgcaggcaacagatcattgcagctagttttatttatccattcagccactctacatctttcgattagagtttagtccatttacattcaatgttattattgatgaataggatttactcctgctattttgttatttgttttctggttgttttgtagtcttctctttcttctttcattccttcctgtcttccttttaatgaaggtgattttctcaagtgatatgtttttattgcttgcttttttattttttctagatctgttttaagtttttgctttgagtgtactgtgaggcttgcaaataacatcttgtaacccattatattaaacagatgacaacactgattgcataaacaattaaactaataaaaacactatacttttcatacccctgctttttaactttttgttgtttctgtttatatcatactatctatgtcttgaaaagttgtggttattatttttgatagattcattgtttagtctttccactcaagatatgagtagtttacatactacaatagtgttatgatattctttatttttctgtgtacttactattaccagtaagttttctactttcagatagttttttattactcattaacatccttttctttcagattgaagaaagaatcctttagcatttcttgcaggatagttctggtgttttgtttgtctgggaaagtctttatttctcctaaatatacatgtttgaaggatattttcactggatatactattgtaggttagaagattttttttccttgagtactttaaatatgtaatatcactctctcctggcttgtaagatttccactgaaacatctgctgccatacattttggagatctttgttatttcttttctcttgctgcttttaggatcctttctttatctttgacctttgggagttcattaaatgccatgagatagtcttatttgggttaaatctgcttagtgttctattaccttcctgtacttaaatattgatatctttctctaggttttggaagttttctgttatccctttgaattaacttttctctctctctctctgcctcctctttaaggccaataactcttagattgcccttttgaggctattttgtagattctgcaggcatgcttcattgttttgtattcttttctcttttgtctcctctgactgtgtattttcaaacagcttgtcttcaagctcactaattctttgttttgcttatttctgctattaacagactctgatgcattcttcagtaggccagctgcatttttcagctccagaatctctgcttgattctttatatctccctctcttcattagatttgtctaatacaactctgaactccttctctgtgttatcttggattccactgagcttcttcaaaacagctattttgaattccctttctgaaagctcacatatctctctctctctccaggattggctacaggtgacttagtttggtgaggtcatgtttttctggaaggtcttgatgctttgggtgtttgtcagtgtctgggttttgaagagttaggtattcactgtagtcttttcagtctgggcttgtttctgcctatccttgggaaggctttccaggtatttgaagggacatgggtgtagtcatctaagtttttggtcactttacccgtttctactttaggggtgccccaagcccaataacactgtggctattgcaggcttgtacagataccaccgtggtggtcttgggtaacttccagaagaattccctggattaccaggcagagactcttgttctcatcccttacttccctccaaacagatgaaatctgtctctgtctctctgtctctctcccctctcctctctctttctttctctctctctctctctctctccagagctgcctgaagctgtgggaggggtgacacaagcactcctgtggccaccgccactgggactatattgggtcagaaatgaagccagcctaacactgggtctcacccaaggcctacaacaattactgcctggctaccacctatgttaactcaagtcccaagggttctgcaataagtatatgggaaatcctgccaggcttgtgtccttcccttcagggcagtaagttctctctggctctggtcaggtccagagatgttttctgggagtcacggcctggagttgggaaatttagaaatctacttggtgctctattctaccgcagctaagctggcacccaaaccataagacaaagtcctttctgcccttccctctcctttcctcaagcagaggaatctctctgaccaccactgctccgggcacatggagagtattgcctggctaccaatgacattcactcgaggtccaagggctcttcagtgagcttgtggtgaatgctgccagtcctgagtctctctcctcagggaagttgtctttcctctggcccaggacaggtccaggaatgtcattcaggagccaaatcctgaaatcagagatcctaggagcccacttgatcctctgccatactgtggccaaactggtacccaagcggcaagataaagtcctctttacttttccctctcttttcctcaagcagaagggatctctccctgtagccaccacagctgggaatgtgctgttcacaactgaagccagcagggctctgagtctcactcaaggcctgcagcaagtactgcttggctatcactgctgattattcagggcccagtgctcttcggttagcaggtgatgcactctgcaagaactgagtccctcccttcattcaaggcagcaggttctcttccagctcagggtatgtttagaaacgctgtctggaagccaaggcctagaacagaggcctcaggactctgcctggtgccctatgctactatggctgaactagtatccaagttgcaaaacaatatcctctttactctctcctctcctcttctgaaacaaagggaagaaggagctgcctggagctgtgagctgtgttgcctagagttagtggggagcagctcaagcactcccttcaccagctgatatcttcttaggtcatgtgtaccccaggtccactggttctgagctcagtacaggaccaggactttccttgcagtccttgtggcctagactgcctttcaagtttatttagaacttcagagcactttagcctgtggtggtggagcttgccggaactcaggttctgaccattggcatggacaatttgcctctggctagggctggtctaaatgctccctccttgggaacctgctgagttcttcctggtgttgctttctactgtgacagggcaacactgagttacaatacaaagtcccacaatcactgcactctccttcccccaagcacaaagattctttctccacgtctcatggactgtgcaggagaatggcggaatggtgacatcaaccattcaagactgtcttttctaccctcttcagtgcctctttccttaatatactgttaaaaccagatactgcaatcacccacctggtcttttgttcttatgaaggtacttttttgtatgtacagttgttcaatttggtgtttctgccggggaacaaccactgcaggcttcaatttggccatcttgctctgtcttccccctgccaccccacccctctcacattcttgaaatgagtaaaaagccttcacgctaagcatggccatggaatcttcccatgttgaactgtaagatgaacagagtcatatttcaaataaagagattaggctgacatgaatgatcatatttttaataacttattaacctaattgcatgccacaattacatagtgagttttcatcttttaaatcaattttggggtgagggatgaaatactacctattgggtacaatgttcactattcaagtgatgggtacacttaaagcccagacatcaccactacacaatatatccacgtaacgtaactgcactagtagctctcagtctacttttttgttaaaaaaaaaaaagagcaaaaacaacagcaagaggaaagatatatatttaagaaaaaagcatttcaatgaggcaaaaacaactggttcatccttaggtccttaggcccatttattacttcgaactgtatgcccacttttttattttataaaggtttgcatgtcttcaaactacatgcccaccttcattttgcaaagtattgtacaatgctgtatttttttttttttttttgagacgaagtcttgctttgttgcccaggctggagtgcagtggcgtgatctcggctcactgcaagctccacttcccaggttcacgccattctcctgcctcagcctaccgagtagctgggactacaggcacctgccacctcgccgggctaatttttttgtgtttgtagtagagacagggtttcatcatgttagccaggatggtctcgatctcctgacctcatgatccgcccgtctcggcctcccaaagggctgggattacaggcatgagccatgtacaatgctgttttaaaagcagcgctcgtctttgctgcctttcaactttacatgctttggtttctcatagagaaaataaaaattgtttttaatccttaaagaacttctgacaggagagaaaaatgacttgtgtgtcccaaagcccccaatcccaaagacatctaagcaaaaccaagttgggggtgggggtggagaatttaaatagcagtaattatcgtatctcaatttgcaagaaaaacaaatgcctcaaataccattattcatttaagttttctgacaacctgacatttatctcctttagtgctatattatagaaatgtttcttattatattcattttccagagactgagaacttttaaaaccaatgaaatgcatgtcccagagttgatcctttgctttaaaaaaaagtttgaaaaaggaaaagctattatgttgattacaaaccgaagtgagttacagtaaatgatgcaaagaaattttgacaaataggtatatgcacttgaaagtggtactactctgctctcaaggtgttgctgttaagatatgaaccaacgctgaaaactccatatccacagatagctggcttcttcgataaaattcaattcaaatcaaagagtaattaaagcacttaatttgcatgagcactgttccaagattaactaaagggctgaggggagctggaggtggggagctcaattaagaacctattcaacatatttcaagagagagggacaatctgaatttaggatatggatgtggaaatagaaaggggaatgtgagagacattatcaagagagaataaatacaatgtgaagagacaacctgggagaagggagaaaaatattgccaggcttaaaatacatgacaatgaaaaggccattaaccaatagggctaactacaaaggtggtgctttggtggcaaaaaattttctttggaaatactgatttgaggtacttgcacatgaaaacttaacctcagctgggcgcagtggctcacgcctgtaatcctagcactttgggaggcaaaggttggtagattgcctcagctcaggagttcgagaccagcctgggcaacacagtgaaaccccgtctctactaaaatacaataaaaattagccaggcgtggcagcatgcacctgtatagtcccagctactcaggaggccgaggcaggagaattacttgaacccgggaggaggaggttgcagtgagctgagatcacgccattgcactctggcctgggtgacagagcgagactccatttccaaaaaaaaaagaaaaaaagaaaacctaacctcacagagaattgtacctggagatgtatgggggaaagacacattattttggaaacatttaaagaacctcatactcagaactagaaaaaaagacatcttcataaattctgatgcatttttcatcctaataccagcagtgacacaatcaggacagggaatgtgtctgcttacccagcaatcaaggaagatgaaggagatgaagcagacagagggcagggagggtcaaccctgactgcaccagcaccaaaggctagagtttcttctggtatagcaaagcctaaataattttcttcattaagcttattttttcatccatgggaaaaggaacatgtgttcatattacattaacttgaaaaattcagaattaatgaaaaaataagcctcagaatcttaaatcaactgaatatagcaacagagaatagatgaagccccaaagggcttctgtcacactcatatataataaaaacaccagtcatgtttacagttcaattttatagagctaaattgatgagtagttttggagtgttctagaaattctacaatattcattttttattgcagtttttgaatttattaataattaggcaagaaatcattaactacattttcaaaacagtagaagtaaagcttaggaggctcattttcacaaatgtattattttcaacacaatacaattttttttttttttgagatggagtttcgctcttatcacccaggctggagtgcagtggcacaatctcggctcaccacaacctctgcctcccgggttcaagagattctcctgcctcagcctcccgagtagctgggattacaggcgcctgccaccacacccagctacttttgtatttttagtagagacgaggtttctccatgttgctcaggctgttctcaaactcctgacctaacctgatctgcccacctcagcctctcagagtgctgggattacaggcgtgagccaccgcacctggccaacacaatacaattccaatttttaaatagtactacttaaatcacaaatacaactgactgttattaatacaatgaaccaggttgagttatctgccattacttactttagaacttagctcatgtcagaaatatacaaaatactcctttgatataaacagatagcttgggggaaaacgaaaaactcttattagaattactactagttgctgtagcaactgtcgaagtgttttactatgtgccaggcactgggccagagactctttgttcatctctttaatcttcactacatttctataaagtaggtatcttgagatgtccattgtactgaaaaggagacaaagcaaaggttaggggagttaagtaactcagtaacttaaatgtttttctcccttagctgaaatgatgcatgccacaggtttgaaaaacattctttccctattcaatcatttatttaagtgataaacattaatctcaacataaacagaaaatagattgaatactgtgattattactttgaaaccaaagctccatctttagagaaactcatactggcaaagcaaacaaggactgatgaattggaggtgcacttgtgcgcttaaaactgcagcagctgatgtaggcactggaggggctacaacccagggacccaggtagtttgcagaaattcacaaggtgcagggtatcagttttgtcatcactttgatacctgtcaacttcatgggcctgggccaatcagccaacttgctcaaacctcacgtttctttcatgtaaatacaggttaagcacccctacaccaaatacccaatatctgaaatgctcccaaatctgacacttcttgagtgctgagctgacgccacaagtggaaaattccacccctgacctcatgtgatgggtcataatcaaaatgcagttgcataacacagtttattaagagtctccaaggggaaaaaggcccttccagtccccttcagcgtatcttttccactcatgcccagatttccctacacaagcatgccacaaagtattgtgtattatgtgggaaataacacacagggaacttggcacaagaactggcatacaattcccgaaatagtagagctgtcatcatcattactggtttttatagtaactgtgaccccaaagagttaatagaagtgagatagtagaaaaactgatggctgtgcagtcacagaaatcttccaagtctacatctctcattgaggagatatgcaccatttgcaaagttatttaacgtacctgagcctcagtgtccctgagtgtaaaatataaataaaaatatttccctggtatgagacagaaaaatagagctaatgtgtcaaaagtaccacatggagagactggaacacaggaagttcctattactgttagtatgaaggcgctttaagaactcaaactaggcaacaggtacaggccacagggggaataaacgcaaacgtccagttaaaaccaaatccagacataagagaaactttatttgaaaaagtaactgctataaggggagtgagactactgcaatagggagagctctggtcatgagatgtgcaagtagctcaacgattgggcagaaaggaattttcttttatagggaggggtaagcaaggctagaaagatcagctgggagcactgactagggaaagcttctcctgaaggtcagctggttctcaggaggggtattcaaggagaggctgctctgcatcccaatgctgaaggcatggtcaaagttcaagggcctagggagcgagacacacctgactgaagtttggttgattatttgggcactgggtataaacaaatcagctgaccatttataaggcgcagaacgggaatgtgaaaactcagcttctggccttgtcggaggtacttaagtgagcatcatttggtctcgtcctggacacccggggaaggattttttttttttttaagaagccttttccagaagacaaagggtgggggatttcttcacctagtgctattttccaaaatacttggctcaggtaaagctcaacattaccataaacagaacaaactatatatatatatatgtatggtttgtatatgtttaagtacgtatatacagtttcgtttacatgcatatgctgaatatagttcagtacttttaagcaaagtattataatatcatattcaaacaatcaccacctttttttcctacaaaaataagcaatgaattaaaagcaagtctgtcattaacccacggtgaggaaggaggaacaattttaactacctgaggtcttcaaaatggatttttttttttcagttcttattctaatgcaatttcctggtcagaatctttttatacataaccttgaatataacaaaaaccaggaaaatggcttgtacacaaaatgaaggctactaagagcatgagaaaatatttcattcttttcctttgatcatctacttttcttttgagagagatgcagagagaggatttgagtgtttatgcctgcctttggatttcttttgctgggttttctattaagtcttctctgacatcattactagcttatgcatactgaatgtgtactctcttgccaggcatcacactaaccacactatgtaataatttctatagatctccacacagctcagtgagaacagtgctactgttaaaaagtttcatattaatgtctgcattttagatctactgcaaataatcacatattatttttctggtagatgaatttcatgccaaaagattaacttaaccttttatatacatatgtaaacaatcggtataggcatgtagatataaacatgtatagaacacaaacttgcatttgtctcaggaatcaggtagagaccatagtaaacatttttatcttggaaggagggcagagagctcatcatcatcaattcagaacctataatgattttacccaaacttctctaatatgatagggagcaacactttttcaccctgttcatagtacgaatgaaaggtgaattatcttggtctagtttgagttctgcttgctcacccctggaaggagaaagtgcataccatagagaagcgtggagattctttgctgggtaataggaaattggtcttcacagcagaaaataataattgcaacaaaagtactaacaaaaataataacaacaattagagcaacaataaaaactacagcattgacatactgattgctcataatatgccaggcactggataagcgccctatttcactaccaaacataattcttccaataatcagcagtaaccttatgcatcccacttacagatgaagaaatgagacaaaggaagttcacacagctaccaaaattgggaaccaggaattaacctcaggcagtgtgactgcacagccagggcccttccaaacaattggttaactaacctgggtcttttgctggccaatgtatcggggaataatcctagccaacaaattcaagggaaacggaatcaagcaaatatgaatgaacttcatttactgaaaacaaagtaggctttgataggactgtgttaccatctctagacctaactatgattatgtcatttcttagtgcctcttgcggcaaagaaagtgcactttacataaaaaaacaatagaatgcatctggcagaagtatgagaagagtaacgatcatggtgatggtggtgatgatgatgatgatgacagcttcaagagcagcagggtaaggatgccactaaaatcaccaccatttatgtgccaggcattatgatacagtcattacatataacctttttctcccactatattgcatgctgcttcacttaccttgtaaaacattttagacataaaaggtgctccatttttttgcacaaatgaacaaatacatgaaataaaagtatgttgaaggcacagaaaaagtattcataaaagacaaactcaaaattcccaatgacacagagagtataatcacaccacatatcaaatccaagccacatagcacagagtgtgctattgaaatgaaacgcaatataactattgctctgggaattacagatgggatccagtaaaagacactgtattaattatattgttttccatggaacttttctaaggttgcccaggacagcaacactgtagaacattcatgatgaaactgtcaaagaggactagacttgaggggccttagggagaaaagagatttgaaaataatgtactgcttgcccatggttcagacgtgcctttctctgcaagtatgatcacattattgattctcaaaggaagaaagaaaatatgactttgtcccttaactgacatcaaagttacagtgttatgcagtgatgcccaaaagcatttgcaaatattcagaaacaaagttttgagtgtcctaggagatgactatcataccaattgatccaaaacacaatggtcaagaggcatggaaaacctatggttggggagggagaggaagggtcataaatatatacagtcatgcaccacgtaatgacattttagtcaatttactggatatatgatggtggtcctataagattataatgtatctggaaaattcctattgcttagtgacatcctagctgtcttaatgacatagcacaagacattacttatgtgtttgcagtgatgctggtataaatgaacctgtgctgccagtcatataaaagtattgcatattaggtacagcaggggtccccaaccccctggctgcagatcagtgcccatctgtggcctgttagtacagtgggaggtgagcagtgggtgagtgagcattactgcctgagctctacctcctgtcagatcagagtcggtattagattctgatagaagcatgaaccctattgtgaattgcacatgcgagggatctaggttgcatgctccttatgagaatctaactaatgcctgaatatctgaggtaaaacagtttcattccaaaactgtccatcccccatgacccctgtctgttgaataattgtcttccatgaaaccagtccctggtgccaaaaaggttgggggctactgacgtaaagtacataatacttgataatgataatacgtggctatactggttgatgttgtattagtccattttcacaatgcaataaagatattaccagagactgggtactttatgaagagaagaggcttaattgactcacagttccacatggttggggaggcctcaggaaacttacaatcacggcagaaggcaaagagaaagcaaggtatgtctcccacagtggcaggagagaaagagagagaaaaccagcaggggagagtccggagacttatcaaataaccacatctcatgagaactccctcactatcatgagaacagcatgggggaaactgatccaatcacctctctccaggtctctccctcaacatctggggattacaattcaagaggagatttgaatggcaagacagccaaaccaaatcattccagtgctggtccctctcaaatctcatgtcctttgcacatttcaaaaggcaatcatgccttcccaacagttccccaaagtcttaactcattctagcattaacacaaaagttcacatccaaaatctcatctaagacaaggcaagtcccttccacttaggaacctgtaaactcaaaaacaagttagttacttacaagatacaatggggatatacaggcattgggtaaatgttcccattacaaatgagagaaattggccaaaactaaggggacacaggtcccatgcaaatccgaaacccagtgaggcagtcattaaatcttaaagctccaaaatgatctcctctgactccatggatcaaatccagggcatgctcatgcaggaagagggatcccagggccttgggcagctctacctctctgactctgcagggtacacccctctcccccaactccccaacggctgctttcacagctgtcgttgagtgtctttggcttttccaggtgcacagtgcaagctgttggtggatctaccattctggggtctagaggatggtggccctcttctcacagctccactaggcagtgccccagtggggactctgtgtggggactctgtttgggggtgccaaccccacatttcccctttgtactgccctagcagaggttttccatgagggctctgcccctgcagtagaattccgcctggacatccaggcatttccatacatccttttatatctaggtggaaattcccaaagagttccacaagactagagaaaaaagaatgaagaggagtgaacaaaacctccaagaaatatgggacttcataaaaagactgaatctacaactgattggagtacctgaaggggatgggaagaacggaaacaagctggaaaacacacttcaggatattatccaggagagcttccccaacctagcaagacagaccaacatgcaaattcagaaaattcagagaacaccactaagatactccagaagaagagcaaccccaagacacataatcatcagattctccaaggttgaaatgaaggaaagaatgttaagggcagccagagagaaaggccaggtcaccaacaaagggaatcccatgagactaacagtggacctctcagcagaaactctacatgccagaagagactgggggccaatattcagcattcttaaagagaagaattttcaacccagaatttcatatccagccaaactaaacttcataagcataagagaaataaaatcctttccagacaagcaaatgctgagggatttcatcaccaccaggcctgccttgcatgagattctgaaagaagcactaaataaggaaaggagaaacaagtaccagctgctgcaaaaacacaccaaaatataaagaacaatggcactatgaagaaattgcatcaaatagtatgcaaaataactagatagcatcatcatgacaggatcaaattcacacataacaatacgaaccttaaatgtaaatgggttaaatgcgccaattaaaagacacagactggcaaattggataaagagtcaagacccatcagtgtgctgtgttcaggagacccatctcacacacaaagacacaaatagactcaaaataaaggaatggaggaaaatttaccaagcaaatagaaagcaaaagaaagcagagcttgcagtcctagtctctgacaaaacaaactttaaaccaacaaagatcaaaaaagacaaagaaggttattacataatggtaaagggaacaattgaacaaggagagctaagtattctaaatatgtatgcaaccaatacagaagcactgagattcataaaacaagttcttacagacctacaaagagacttagactcccacacaataatagtgggagactttaacaccatactgttaatattagatcaacaagacagaaaattaatgaggatattcaggacataaactcagctctggagggctctggatcaagcggacctaatagacagctacagaactccctaccccaacgcaacagaatacacattcttctcagttccacgtggcattattctaaaatcgaccacataatttgaagtaaaacactcctcagcaaatgcaaaagaactgaaatcataacagtctctaggaccacagtgcaatcaaattagaactcatgattaagaaactcactcaaaaccacacaattacatggaaattgaacaacatgatcctgagtgaatcctgggtaaataatggaattaaggcggaaatcaagaagttctttgaaaccaatgagaacaaagagacaacatatcagaatctccgggacacagagtgtcccagtgttaagaggaaaatttgtagcactaaatgctcacatcagaaagctagaaagatctcaaatcaacaccctaacatcacaattaaaagagctagagaggcaagagaaaaaaatccaaaagccagcagaagacaagaaataactaagatcagagcagaactgaaggagatagagacacaaaaaaccctccaaaaataaaataaatgaagacaagagctggttttcttgaaaaaaataaaaaatagacagcaagctagattaataaagaagaaaagagagaagaatcaaatacacacaataaaaaaatgataatagggatatcaccactgacaccacagaaatacaaactaccataagtgaatactataaacacctctatgcaaacaaactagaaaatctagaagaaatggataaattctgggacacataccccctcccaagactaaaccaggaaggagttgaatccttgaacagaccaataataagttctgaaattgaggcagtaattaacagtctactgaccaaaaaaagcccaaggccacatggattcacagccaaattctaccagaggtacaaagaggaactggtgtcattccttctgaaactattccaaacagttgaaaagcagggactcctccctaagtcattttatgaagccagcatcaccctgatgccaaaaccaggaggagacacagtgaaaaaagaaactgtaggccaatatccctgatgagcatcaatgcgaaaatcctctgtaaaatactggcaaaccaaatctagcagcacatcaaaaaacttatccaccacgatcaagtcagcttcattcctgggattcaatggtggttcaacatacgcaactcaataaacgtaatctatcacataaacagaaccaaagacaaaaaccacatgattatctcaatagatgcagaaaaagcctttgataatattcaacatcccttcgtgttaaaaactgtcaataaagtaggttttgatgggacatatctcaaaataataagagctacttatgaaaaacccatagctaatatcatattgaatgggtaaaacctggaagcattctctttaaaaactgatacaaacaaggacaccctctctcaccactcctattcaacatagtattgaaagttctggccagggcaatcaggcaagagaaagaaataaagagtattcgcataggaagagaggaagttaaattgtctctgtttagagattacatgattttatttttagaaaaccccatcatctcagcccccaaactccttaaactgataagcaatttcagtaaagtctcaggatacaaaatcaatgtgcaaaaatcacaagcattcctttacaccaacaatagacaagcagagagccaaatcatgaatgaactcccattcacaattgctacaaagagaataaatacctaggaaaacagctaacaggggatgtgaaggacctcttcaaggagaactacaaaccactgctcaaggaaataagagaaaacaaattggacaaccttccatcctcatggatagaaggaatcagtatcatgaaaatggccatactgcccaaagtaatttacagattcaatgttattctcaaactactattgacatccctcacaaaattagaaaacactactttaaatttcatatggaatctatgaagacctctgtatagccaagacaatcctaagcaaaaagaataaagctggaggtatcaggctacctggcttcaaactatactacaaggctacagtaaccaaaacagcatggtactggtatcaaaacagagatatagaccaatggaacagaacagaggcctcagaaataaaaccactcatctataaccatctgatcttcaacaaacctgacaaaaacaagcaatggggaaaggatttcttattcaataaatggttctgggaaaactggctagccatatgcagaaaactgaaactggaccccttccttacaccttatacaaaaattaactcaagatggattaaagacttaaatgtaaaacccaaaactataaaaaccgtagaacaaaacctaggcaataccattgggcaaagacttcatgacgaaaatgccaaaagcaattgcaacaaaggtcaaaattgacaaatgggatctaactaaactaaagagcttctgtacagctaaagaaactatcatcagagtgaacaggcaatctacagaatgggagaaaatttttgcaatctacgcatctgacaaatgtctaatatccagaacttacaaggaacttaaacaaatttacaagaaaaaaacaaccccatcaaaaagtgggcaaaggatatgaacagacatttcttaaaaggagacatttacataaccaacaaacatatgaaaaaaagctcaacatcactgatcatcagagaaatgcaaatcaaaaccataatgagataccatctgaagtcagtcagaatggtgagtactgaaaaaccaagaaacaacagatgctggtgaggctgtggagaaattagaatgcttttacactgttggtgggaatgtaaattaattcaacctctgtgggaagacagtatagtgattcctcaaggatctagaacagaaataccacttgacccagcaatcccattaccaggtatatgcccaaaagaatataaatcattctactataaagacacatgcacacttatgtttagtgcagcgtcatttacaatagcaaagactcagaaccaactcaaatgcccatcaatgatagactggataaagaaaacgtggtgcatatacaccatggaatactatgcagacatataaaggaatgagatcatgtcctttgcagggacatggaagaagctggaagccatcatcctcagcaaactaacaaagaacagaaaaccaaacaccacatgttctcactcataagtgggagctgaacaatgagaatacatggacacagggaggggaacaacacacaccaaggcctgttgggggtggggggcaaggggagggaacttagacaacaggtcaataggtgcagcaaaccaccatggcacacgtatacctatgtaacaaacctgcatgttctgcacgtgtatcctggaatctaaagtaaaattttttttaaataaagaaatggacaactctctagaatcaaacaccttgaaattccttgaataattaaggacccacggattgttcatcttttcatatacagaccccaacctataattactaattactaattgcagtgagatcagagaaaaaataaatgaaaagtctactttggagtcaaagatatggttatttcaaagaacagtttccctatcaatagtcatttgtctaagactatattgatcagcatgaagtggcacattatagaagacacttctgcacacctgttacagaaaagcctcctcacaatgcctatttctactaactaatctatgctgtccactctaataggaactgaaaaagacaccatttcctcaatttgatagaggatacagtaaatatttacacaacacttaaaatgagagagtatataaacaataatagaaaacaggtaattcagggctagaatttccaataaaaaattttattttgtttttgttttttaattagaggaagagaaagatcaagccatatgtcagatgtacttcattcttttttcacaaaagcattatctagtcataaaatagaggatcacaaaaagagctgaactgatcataaaaagtctgtatttcctgtgcactacaaacaaccataatcccttgaacaattccccaaagctcctaacatcaaacattaatcagtcagtttaggatccatcagcaaatttaggatacctccaaaggggcctgacaggttaggcaaagaaagcattgcataccatcagttctttcactgatagctaaagatctataggtcagagaagggcaggctctgatgtctcctccattaattattgaaggtaatattccagatgctagtaaatcttaataacttcaaatatcagcttcaaagatgtacttttgatgaacaaagccaaaacacttctccttatcaaaaagacatgttataatgcatattttatctttcaacggatatcctctcaccaataaacgtgatctttgatccaaaaattcttagtaatgccactaaaatttctcaaaacaaagtcagtttaaacgtgcttcagttaaaaccactgccctattgctctaaaagaaacattacaaaatgcaactacagactgtcaatttttcaacaactttgggagtgactgtttagacactgtcaaatgatttctaagcaaccctgccacaagcagactggcttgctataaacacaaggtgtaggatacataagaactaatatttgttaaggaatttctgtgtgccagactcttggctgatctctttgggtttgattgaatcgaatagtcatcacaatctgcagaaaggtttggtgacttgatcgcaagaacctggctagtaagggactgagtaagagacttcactaggcaagttaaagtgctgctctacactcccattgctgtctctgtacccagcacgtgggcacaaatgtaagagcctcgtgaaggaaagcataagcaagaacacactgagcagctctaggaagctccttaaggtagaatgagaaacttactcaggcaggctcctgcagttgcacaattatcattcttcttaagtgtgattactgctcaaagtcagaaacatcaaatgtggaaatattatccaagtaggggatccatccatgaaagcaacaattgagagacttctacattctgctctacgacacctggaaggctcatctccgaagtcacattctttcaagatggtttgaacaaaatgcagatctttggtgcagcaattaataggtacagttatgtatacttcaacaggctgaatgtaatctatcttgaacttgcctttcaattactccgtgcttggagcttcctgcagtgcctgactatctcaaagttgctaacgcagggaaataagcctatcagaaattcaaaacacttcatcatcacattttaatcatacaaaatagtaagtcctgagtttagctcattccttgacaagtcagagatgatgaagtctttaatgctcacctatttatacagcaatctttcctcctaattccgtctatcctattctgttatctcaaagatataaccaggtgacagagttcaagttcattaccaagagaatgtatttctccagccaaagcaaatagaatttcgatgaaacttctaagtacctgttataaatgccaagtattaaaggttctttattcagctatttacaagaccatctgtgaagccaacattctgtgatccaaatgcagatgttctatgaaggaaggcaaggctaaaaaagaaaatcctgacaaggcccgtgcagctacttaaagcataaagggaagtgcaatggtcttacgatttaaatataaacctttgttaaatgatgaggaaaccacagcagcagggacctgctaaacaatcactcgactcctgtgattgagctaaaagattatatttgagatgctcggtccatcgacatatttactgagcccctgttatgttcctagtgtgttccaggcaccatagcattattgtaggcctggctcatgtatgctgtgatttggtgtttaccttcgattctgaagtttagaaaacctcttaacagggcttcaagatacttttctcttgtatctgattccaagtaaccctgtatttactcaaccaacagtcactgtaggactattcagaagtcatgttaagtaaaaggtgggttacctagaagctgacagtgtcactggagcggggtcttgaggatctagacattggttctgtggttgcttagaaaggtctgggggccatgagggagggcctatgacagcagggtaggggatattctcagagcaatagctatgtacaatagaaatatttcaatcttttaattaccagtgtgactaaacagaacctcagcagtcctatgttgcctagtatacataaatatttaagtccaagccctatattcaggcagctctccagctaaataatatgctatagaattatctaactttctctatcaagttcaatagattgagagaaagaccagttatctaacagccagaaggaaaatcaagataaaaacttggtgttaagtttttatgtaaaacatgaaactataatattttgctgaataatttcaatgactgcaaatgaacaaaatctattccaccttttggaatcccttttcagttttaattcatatattccacactttctgctacagagatttccatcatgggtcaaggattgaaccagatgatgtccaatgagttgggatttccaagagagaccatgagcagtgctaaaaagtagacattttgtcacaatatttaataaatagcattcattagaaaaatattatccccctttaagcaaatactattattatttctctctataatagaaacagagttctaacataatagtacctattcgttttactcagaggcatcaatcctaattggaaatttttaaaaatccagctcaagttgcaattcacagaggtggcaaatctcctttagagggcacagaaatgtacatatgatctcattttaaaatgtgtgtgtatactttttatttctgagaaagcaacaaaatcctggcttccaataatgtccaacttaatggagcataacttaaactccttttaacaaagtttaaatttttaaaagcccactgaattaaagacatcatgactaagaccaagctggagtgctctagaatctagcttacaactgtttggcctaaggagcctatagcattgaccctgcatacattaaagccacctgtgctcaagtccacttatcactcacacctgcttacaccatgctactgctcactacaataccaataagaacatctgcctgctttagataaagattctctgcacatctaaattagaataacaagtttttgaactattattgcaaaagaaacagcagtcaatgtggtaatttttggggatctctgcctaggtttcattaggctcaccctaatgtctttttcagttttggcaggagggcctgtgcctgttttcatagccaaaagactgccatactcacaaatggccaaaaagtatgaagaaatccttcaagtttcccaggcactgaacaggaggctccaaaccaagtcatctgcttggagtttttattactccaagttctgttataaactgtacctcagtgctcttcatgtacgacatgacaggcaggaaatcatccttacagctttcacatttaacaaggctacttttgaccaaaatgagcaatgaatttcaaaatacagggacatggcaaagtgctgtaactcggaattaaacaaatcaacaccaagaaacaatattctactagcaattcggtaatcacaggcaaagatgataaatatccataatgtttttataagccacaaacatggtttaatctaatcttacactgtttgtgtttataaagccaagacaagggtgatcatctaatattttcataacatctagtagaaggtagttaaaaagatgttacattagacatcgttactgcttcaaaataaactctcaccttagttaacaaaatgtgttatgggttctgtgcacatctgttataggtaccacagagacactatagctactgaactcgtatgtgtgctagacattccattttgctttttaaaaaatatataacaacctattatttatttaccataattatctccattttacaaaagtgagaaggcttaaatttattttccccaatccaaaactgtaactactccagcccaggtgtctcttttaaacctcttgctccgtctccacagacttcaacatggaggaaattcaggggataaactatatccaaagcagcctcaaagattcaggcagtaatttcattatcatgtcttacttgatttgtaccaaaaaaaaaaaaaaaagattagatttcagtttcacgtcttctgtctcttactaattcaggtactaaaaacagttggtatttactgagtgcttattttgctctaagcccttcacatgatttaacaaattcccaaaacaaccctacagggtagatagtagcatcatgctactttgcaggtgaggatacaggtataaagatgttaagtaacttgcacaggtagccaatttgggcccctaactaaggcagtctggtcgatgctttgacctttgtgctacctttcctctacctctgaagacaaaaggtaattgcaaaataaaagtatgatatgctgagaagcaaataaactagatctggtaacccaaaaagtatatgttgcactcaagccctccttgcagtaccaaacccacaaaaccaaatggtgctgagttgtgcattagaaacaggttaaaagacctattaaataagctcagatctgaaaggtaaacaataagctactgaaatatgatttttattaagcaatagcaaacaagtctatttacatttcaagaaagaaatggcaataattcattagcaagacaaaatagagtcaaccaaaccgatgtagtttctctctccacacacccactcccttacacacatactagcagccctatgaaaaacagggttataatagaaatgctgacacaaccaaccttataatgtttcatacgaaaagctacaattatattttctaattgtaaactgggtgaaaaaaaaaaggccaaccagaacaaaaacataataactacctagaaacagtccatcagaattcttggattatgaaaaatgcatataaaacactattatcttcagccacagccagaagatgtcagacaatcaattcatataacatgccagcttaataaaatctgcatacaaaatttatgaatgcagtaatattcctttatatcacaagttattaatggtcaatttaatgaacatctacagctggagtgctttcgttctgtatgatattttaatcatttttagccatggatttaaacgcatttcattttataaccatcagctagtgaagataagaaaacctttacacaaataactgaaatatttggggtaggccaccaattttgtctttatgttgttatttatttccttaaatttttttttacaacagaaacacaatgaaatgttccattataacaatatttgatttaatatttgtatttagaatatgaaaagtttgcttaaagtagcattacatgtttggctagcataaaatcttccatttcatttcaaataaagaactttctaacctcgtttatgtgaaacaatctcgctcagagctattatcctccaaaaactatcctggtggaatgttgacatctcggacataaatattcttgaaaattaatgtgttgtatttcttaagtatcctatttccactcacttgttcacataatctttaaaaatcctattgtgttcaagtctacttttcccacagattctttactaaaactaaattttactatatgatgcttatgtggaaggaacaggcaacataactgcaagacaacagtagctatctgaaaatacaaacattcagcatttaaaatattgatgtctttctgtggtcacaaagtcaaataattgtttctcacatttgagcattagaatttggtatttaaaattacactcatccttcagagttaattgaaagatttggatatataggaaaaaggttaagaaatctaggtcataaatacttcttaaggtgcaagaattggcttcataaactagtaaatgtgcaataatcactattaaagaatgaaagatggcattttttttttttttttgagatggagtctcactctgttgcccaggctggagtgcaatggtgtgatctcggctcactgcaaccgccacctcccaggttcaagcgattcgcctgcctcagtctcccaagtaattgagattacaggcgcccaccatcatgcctggctaatttttgtatttttagtagagacggggtttctccatgttggtcaggctggtcttgaactcctgacctcaggtgatccacccgcctctctcccaatgacagcaattttttagtttgactgtctatagccttataggacattacaggtgaaaatcagtaaaagccatgtgcacaaaagatttagtgcattcatgtgtctttattcattcactctatcttctgttgcttcactggttccttttgggcttcctactatgtgccagttaatctttatttgctctgggcgagtaactcccattcttaaagacctaataaaacaggacacagtacatgtatacccactaattataaaacagcgtagaattgatggataagtgccaaggagaaatacaaatcaagaattcagagaaaatggttcttacttgtcgagaaaagggcaagggaagactttataaaggtcaactggaatttagaggagtaaaagaaataagggtatttttgggtaaagggcacaacatgaaattgacttaaggacaatacacacaaggacaaaaagtgcctatgacgtgagttttaagtttaaaatacagactttcaacaatgcttaaatctgtagatggtaggcattttccaaattcctctaataagtagaatcagcctatatccaaggaagatcataactcattaaatttcattttaaccttcctgaatctgcctaaattttctcatcttatcaggcaagccaatatatgcttacactgtgaggttaaagaaatgaacctgtgaagagaacctgtcaaatcaaattatcaacaagcaatagtcccactattggggaatatataagctgcaatgtcaattttaaagaagtgtgcttacatttgcattttaattaggtcacaccttcaacatcatgatattaatttcagtttaatgctctattttattgccatttccaaaatgacatttttagacatggacataaagaaaaaaatctctacttttgttttgacaacccataaatattgcaaattgaaacaatgttgaacaaagttcaatatttggaatattcaaacgagagatacgactgtgtctaaaattctaaatacttagaattggatttcaaaaatattccaagggaaaattattagattctcatttaagagcataatggagtgttgaatggaacataaaattcaggttcctgtgagtcaccagaagctaaatatgaatagctcagaaaaaatcattttggttaagactttgcattagaattgagacatgctttgtagttttttcagatcaagagggaggtagacaaattacagaatgtatctttgtccattaataaatgacatatactcaaatacataaagttgtaataacattcacataacaaaattcatcaatcattttaaagtgtaaaattcagtggcattttgtacattcacaatgtcatgcaactttcaccatatctgtttccagaatgttttcatcatcccaaaagaaaactctgtggccattacagccattctacattccccactacccactcctaacccctggtaccactaatctgctacctctatgactttgccaattctggatatttcacataaattgtatcacataatatgcgacttttagtgtatagttttaatttttatttttgtaggtacatagttgtatatatttatggggtacatgacatgttttgatacagacatgcaatgtgtaataatcacatcatgtaaaatggggtatccatcccctcaagcatttatcctttgtgttacaaacaatcaaattatactcttagttatttcaaaatgtacaattaaatcattattgactacagtcactccgttgcgctatcaaatactaggtcttattcatgttttctatttttttgtactcattaaccatacccacacctccctgcccaccacctgtcaactatccttcccagcttctggtaatactccttctacttactacctctattagttgaattgtttcgatttttagatcctacaaataagtgagaacatacagtatttgtctttctaggcctgacttatttcacttcgcagaatgacctccagttccattcatgttgttgcaaatgacatgatctcattcttttttgtggataaatagtactccattgtgattaagtaccacattttttaaatccattcctctgccgatggacacttaggttgcttccaaatcttgactattgtgaacagtgctgcaacaaacacgggagcgcagatcgctctgtgatatactgacttcctttgggtatatatccaacagtgggatgtctggactgtgtgttagctctacttttagttttctgagtaacctccaaactgttctccttagtggctgtactaatttacattcccaccaacagggtacaagggttcccttttctctacatccccgccagcatttgttactgtctgtcttttggatataagccattttaactggagtgagatgatatctcgttgtagttctgatttgcatttctttgatgatgaaggatgttgagcaccttttcatatgcctgttagctatttttagtgtatggtttctttcataagcaaatgcttcaagtacattctaacaaatacattctctaattcttctttaagggaatactcttaaagaagaaatggtcaagtacttcatttcccaactgttttctatttttcttttcccaaaactattccaaaaagtttatggggctttgtgtttattgtttatgaggtaaacaaatatgagtttttactcccagatttttccaaattaaaaaggcagtgacaaatatccatttaaattaaaaatccaagccattattgacattggaacttgattctacatatgcattaaaaaaaagacctaacagggggaaacctacattgtgttcataactggggatatccaacagcatcagtatgtcaaatttccataaatgaatccatgtattcaatgccattcctttaaaaaatttcacggccttttcccacagaatttgacaagacggaaaaaaatcatttgaaagagtcaaggtaaagaacagccaaaatgtgattaaaagaaaggaatgcttgtctttctagacataaagatactctttaatcatagtaatcaaaggactgtatcattaaagctcaaagagaccaactgaactcagtggacaggcaagaaacagattcacacatttatgtcaagaccatggggaaagaatagaatggaacactgtttttccataggaagaaaagtagattcataatttatatcacatataaaagatatccagatgatatcaaggcacatatggaaaagaaaacattaatacattagaaaaatatgaaagtactgttatgatattaacactgggaatatattcttaaggtacagccaaaatgcatagaccaaaaggaaattattaaatttcattatactaaacattttagtatcaaaggcactatcccctgtcccgaccccatcacacatatggaaacccactaagattccaagcgagaaataaaaaaaagtcctgtgatggatatgatcacaaaggatttaaatctagaatatataaaaatactaattattgcaaaagaaaacaatgacccaatggaaaaaattggcaaagaatacacacaagcaattgacaaaaagggacacctgtttgcatccaggagcaaacgttttactccactggataattggagaaatgagaattaatccaataatgtggtaccatcttttacccaccagagtggcaaacacttaaaaagtgtgccaatgcaaacatcatgggaaacagatgttttcacccaatgctatggagtatcaactgacacaagcacttaattaggactatagaactgctctccaatgttggagaaatgtgtaccttacaacatggtgattccactgctaggtaaatattctacagagagactcaccagtacactaggaaacacatacaaagatattggttttacatcgtcttaactgagaaaaattagaaacaacctttaaaaaggaataggaaattaatttgtcttccactcagggactagaatacaatacaggaggtaaaaatgaaagaatgagggcttcatttattcatgtagctgtatctcaaaaacaatgccgagtaaaagaaactgattatgtacagcaggacacagtcaagaaaatattaaatacatcaaacaacatgatttcctttttagggatacagatgcacattaaaaacaaataaaaacaaaaaacaaaaaaaaacatgcaaacctaagcaggtagaaaacctaccaacttcaggtcagtaaacgcctctaaagcagttctcaaaagggggtaactttgcctcccacatgtggcaatatgtggagatattctttgttattcacaactaggagggggcatggtattgtatctggtcggtacaggtagagttgctgctaaacacttacagtgcacaggacagcccccacaagaaagtagttatctggtccaaaatggcaatggttacaaggttgagaaaggcagccctaaaaacagaggaaggagaataagatgacaggtggggaagatgaagtgtatctataacttttcattctaagaaaagatctgaagcatgtatgaaaatatgttaaattttttaagaaggactgccacattattctttgtacattcttatatttgaaatatctctttaatcagttcaaaaatataaaaatcattctgcaaacaaacacagttaatttctaaatttgatgaaaattacataattcttttattagcctatttctataaatatatctttggaaaaacaatattctcacactcacgatcaaacgtatttgcactttttttcagtgtttgttctacacagagctataaaaggaagactgtggaagaacccaggattcatccaggatcacaggatcatttcattattacagtttcaggcaagaacattctaaaaccagctcagagaaagctaattccgtcctttcctggttatatagcagatcataataattccaggcaattctctgaagaagctgatgatctagaacagtgggcttgcatcacacaccccatcatgcttccttaagtacatggcttaggatgctgatttctcccaacctcatgggtttcagtagttcctacaaacaactttgagatcaaccagtgcataattttattttttcctttagttccttagtgcagaggatggcaaactttttctgtaaagggcaagatagtaaatattttgggctttgcaggccatatggtctctgtcacagctactcatctgtgtcactgtaacacaaaaacagccatagaggatacataaaggaacaaatgtggctgtgttccaataaacctttagttacagaaacaggcagggagctagacttggctccaagccatagtttcgccaacaccaagatggacagcaaaaatgcaaccagtttaaatactattttaaatttaaggcatttcctccaatctttgaaagtaaagttttatgtatgttttaatcagtgtaaaaattttgtactaccaaaaatgaatttatataaatgaaacaattcaataaatgatgaaaatgttcatttgttacatttatagcatactaacttctttctggaagtatgttataccccctgatttactaaattattaattataattttactagtttaaattatgctattaatgattccttataagaaaataaacacacatattgtatcttcaactaagggttgggaacgacaaggacagtgaaattatactcccaacacaaataatagctttctattaggtttgctatttcacctgaataattccttataatcatgaataatgatgttattcgacaacctaatgatatcatggtgtgtagcttcaatccatctgtctttgtcaagaaggtcaaatatttgtactccactgcactaggcaaagttgaacaaacagttaaacaacatcacacaccttaattactccttcaaatgaaaccagcaactaccattttacctgattctaggacctgtgaaataaaaacctacttcaaagatatttaatctgtatacacttttacaccaaatttaagctcaacttaaaaaaaaaataaaagtggttaaactcaagaaaaagccccaagattttctaagggtattgttaattggttgttgctgtaaaatgttttgtgaataacaaaatattccaggaacttttaacaaagatctggaatacttcatgtgttatcttgacattggcttaaaggtaagaataaagcaatagcgtgatagatgtgaactatagttcctataaatgcttcatagtgtttgctttgcttcgagattccatgagtgaccaaggagttgaaggggataaaaactccccattcactgtttctacagagcctctacaagacctggacccttggggctgggggatggtgaatatagcaaggtatgatgtgggcatacttaaatgatttgcagcaaaataatgtttatattaaaaatcctgttttccttccttccacccttctgctttttcttaaatctcaccaaagctttattgctgcacaaaaatgaagtccttagaaggccttattaatctggttccagactcctagcatcttcccacttcctcaccatgcttcacccccacaggtcttcgtgtttttgaaacggagtctcgctctgtcgcccaggctggagggcagtggcgagatctcggctcactttaagctcctcctcccgggttcacgcgactctcctgcctcagcctcccgagtagctgggactataagtgcccgccaccgcacccggctaatattttgtatctttagtagagacggggtttcaccgtggccttgatctcctgacctcgtgatccgcccgcctcggcctcccaaagtcctgggattacaggcatgagccaccgcgcccggcctctctgtgtttttttaaacattattgagcatgcaaacttgtttctgcccctgagcctttgttcttgtttccttctacctggacttggctgcccattgtcccacaatgggctggtccctcctcgttagttcttacagcacgtgtcaccggcaaagagaagacttccctaccactctgtctcaagcagtccctcactctcaatcatactcttctttttattttattcagaatagaaaatcatgttgtttgtgatttatgggtttacatttatgggtttcatcttttatggtaaacctctgcacacaagaataaaagtaggatcgttatctgactattcattattgtatacctggggtctggcacatagcagaaactaattaaatgataaatttacatattcattcatttacaatagacaactctgtgtctaatttgaggtcagcaaatgacggccctagagccaaacctgcctgatacctatttttgtaaataaagttttattggaacacagccctgtttgcccgtttaccaattgatgatgttgctttcacactagaatggcctagtggtgtagttacaacagagaccacatggcccagaaaagatttacagaaaaagtttgctagctcctggtctactacacagtatatgttctcaaataaataaaataaagtacagtcattgcttttaaaggagttctggtccattgtgtgtttttattcaaacacttttagattaaaattctatggcccaaaagaaagctcctttaaaactgtaagcatcacctagcaagagttgtattggtgctgtggctgggcacggtggctcacgcctgtaatcccagcactttaggaggccaaggtgggtggatcatttgaggtcaggagtttgagaccagcctggtcaacatggtaaaaccccatctctactaaaaatacaaaaaaaattagtagggtgtggtggtgcacccctgtaatcctagctactagggaggctgaggcaggagaattgcttgaacccgggaggcagaggttgcagtgagccaagatcaccccactgcactccagcctgggtgacagagtgagcatccatctaaaaaaaaaaaaaaaaaaaaaaaaaattgtattggtgctctattcattaggtcagctggctgaaatcataaagaactaacacagtgcctggcccctggtaagtactatacaagccttgattggcttctttttggaagaaaacattatatccggtggctaacacagggcttggcacatattcggttggtgcaaaagtaactgcagttttcacaataaaagtaatggcaaaaacctcaattgcttttccatcccaacctaatagcaagtaacagtcaagatctgttgaactgaattgaagtgaacttgactctttcagccagagggactaacaggctaatctgtgaaattagtgggcaaaaaactgattcactcacctgagaacaagccattctgtaaaataggctgagaaaccatttctcaccaacatttttcagggatgacttgaagtaatatgatccaaggagccagatttcaatatacgtttaatgttttttgataactcgttgtaggtagccactatttatcttatttgagttacaaagatacataaacacaaaatttaaacagtaatttgagtcacagactcccagagttgcaatactatcccctgtaatactcagttctatagatattttttcttttaaaagatccaaactaacccacatttacgccagctcttccaattatgactaaccgatgcatattatttctccaaatcttgacggtctaagctaatgcctctcacagttgactcacagatggaagtcacaattatttgggagtggctggctttttgttttgagttccacttcctggctcctacgctcaacttttgaattcagaatccttagagtgagaaatcatggcagagtccggaatctccattttaacaaacaccctaggtgatgctcggtcctttagaaatctgttattttagatcaagagatcatatatccacattaagaaataccaagtagctatcaacttttggaaccactactttcctctattggaaatgtaacgaagtgatactgtgtgttttacttggagttattcatattactgtatattacgtgcatacacatgcatattacgcactcagtacttgtaggagtgaagtactcaaagaaaagctaaaatgtggcatctttgccatccaggcggttctttgataagcagcatacgcataaatgatgtaaacaaatgatacaatgacccatgactgagagaccgacgagtagacatgcaacaagatttcagagaaagaagcaatcaagggggtctaggttgtcagtgatgtgaaaaattgccttctttggatccagtagaggaggcaggaagtacaaaaagtgatagtagttatcacactctagaggtgtcccaggaccttgttcttctctcagttaagacctaagatcttagaacacaggaagagtaaagcaagaactatggccttctaagttattaatcccagcagcctgggaaagattactaaggctttgaaagctggccaaaagtcattgcatctcagtggtcatagaggaagacctgggccaccatgaactgaaccagtaagaagcccctgtctccaaggagctgtcctgaatgaccttgcacggcacagcattctctttatcttcctgtggcatcagtaataaaaatcattggctggtctcctcatttgacatctaatcaaacacttcactcggaagttacttttcttgcgggtttaggtcttaaccctccaaggatcctgcaaagttctagaggacagagtgtcagcaactcccccagtgcttagcacaataatgtcaggcatcataaaaagatcttgtttaatcatttgataattttttatttattgcctaccatgtaccagacattgtgttaagcactcaatagaacagacagctagatcctaaacccaatggcagtgacaaaaccgtctgtagtcatgagggctgacgacaacactatgactatagtaaaagccattaaaatcactttaaattggtgaattgcacggtgtgtgaagtatatatcaaaaatgctattataaaaaaatcaaaatggcagaaaggaagatggtcaagccttagaaattcacttggtgaaaggttagaaaaaacacatccagaacttagttactcctatttagatggtgactgtgacacattagtaatacttgatggtactgtagctgaatactgaatattaagaaaattggaatgcttctcagaagcaacaaaacaacgaaactacatttatgctgtattggttaagaacataggtgtcagaatcagaaaaacatgtgatcagttctaggttctcttccttagttgtgtgactttggtcaaactgcttacctatctgagcctcaatttcttcatcagtaaaataactttaaaatatagtaatgctcaataattcttagctagtaatcaaataatgcaaattagcataatacattctcacttataaaattagcatatattaggaaaattattactattcaatgagtagtagcaaaatgtttttccactttgcttttgggtacatgtgaaattttattgtatgtccactcattgagatctcaaacatttattatcataacatttacataatttatgtgtatgtaccttatccaagaaggcctatgatagcaaagatgctatgtctcagttttctttgaatacttcactcctacaattactgagtgtgtatgcatgtaatatacagtaatataaataactgataaatgtatgggcacatacattttatattggttgtggcatgacttctaatagtgaaagttatgaaacaaactaaatattcaaaaccaggtgaaataattatagttaatcatattgatgaaatattatgaaaccactgaaaatgaagttaatgaataagaaacattaactttaaacaataagaaaaaacttacggtattaggatcaaaagaaagggatatcatactatatgtagagtagtgttgtgttctagttttatctaaaactgttttggagaagatggaagaaaacaaaacattttaaaagattaacagggattatctctgggcagtaggattatgagtctttttacttcatacttttgtgcatgaaaaaaattaacagtattaaattcttgctcattttatttataataaatacatgcagtattgattttaagaaagagcaaataagccttattttacgtatcaccagattatatcacaaagtgacgttaattttactacacagataaatgaccacatagctcaaatgaccagaaaaaaagaattgtgaagtatattctctaaatataagcatccaaccatattgatagccaccaatgtcagtcacacttaaaaagattttttggccgggcagcgtgcctcacgcctgtaatcccagcactttgggcggccgaggcgggcagatcatgaggtcaggagatcgagaccatcctggccaacatggtgaaaccccgtctctactaaaaatacaaaaattagctgggcatggtggcacgcgcctgtaatcccagctactcgggaggctgaggcaggagaatcacttgaacctgggagttggaggttgcagtgagccaagatctccactgcactccagcctggcgacagaacgagaccccgtctcaaaaaaaaaaaaattttttttttggttcaacaaagctgcttagtaagtagtttaaagttatttattattctaacccaaatgtttcacatcacagtaatttgttaaatataattgtataacatagtaaaacgtgaactgccaaatacaatatattgattgaaggagtctcatgaagctttgagagcttcagcgatagtggacaggctgtattcaaccgcagctccaaaggagaaagtgattaacaaaataagaaaataattaattcaaaagaaaatatgctttagaaatatgtgattttttaattgtgagaaggataaaatgtttccttaaggtcatgtaactgttagctacacaggtagcctttctgcccggtagtaagcccaatgtggaaatgaaatttagtagtgatttaatttataattatttttcaaagtttgaggaataggaacaactacattatgttcaatagtctgaaagcacaaattctgacctttaagttcaaagtggaagtcaaactgctatacgtcagcatgacaacatcaagaaaaaccaacaggtcccaggggacaaggggaatacctgcttccctgcccactatcaccccaaaagttttgtcagaactattttggacatttgtcaaagatgtattttttttcctatttagatcatgagctgtaaaaacagaaaaaaacaaaataatgggcagaaatctatctgaaacccactactttttttccttcctttattttaatagataaaaggctaaaccaggtcatctacctaaacaagactggttccaggcctctgctatggctaagtagttaaggaaatgatttttgcaattaggatggtctcatttatattgggacttcactacttactaggtgggtgagtgtggacagcttacttccatacccctaggcttctttcagcatctgtgtaaagggccattaagtcagaattaaataagtggtagctgttattactaaatataaaagcctcatagaaaagatatgttagttattagaaagaaaattttccctaaaacttcttttaaaacatcttatgacaaagttacagaaatatttttaagccgtttgtaactaatacagacgcacattctctctcatatttacacttttcacctttgcttcccatctggaggagatcatcctccaaggtttcttccagcatattttatgataatcagactatgaattgggaatacatattatttgggctctgtttttgattgctatttttcatgtggtaaatcccagaaagctgcccaaatcccctgctgattatcttggccaagatgttgacaaactcttagatttctgctatcccattggcatccattggtattgcaatggcattctttcatccaacggacaaaacctctttccaaattctgacaacttctatattatcatcattcttctaatgttaataagcttgaatttggtaacattaaccccacagttaccaaatatggcctcctcatgccaacccacctctgctttttgtagaagaaactattaggccatttgtaaaagtctggtttgatgactcctcattttgtggcaatttcataaatatgaccaactttatcattagtcttattttctttcaattaatcaacaaagccatgagtaaaatgtgaaaatttaatagtcttttcccatgatttctcacagacaatataattgagctttccatgttattttacagttctttttatatggtaggcactaatgaaggagtccacaaacactggttacatagcacacatggttgatgtctatttttcacatggtactttgagggtggagggtaggtgggaagggatggatgtattccataggatctgtagcaacaagtataaagctaattttgtaaactgcaactcctgaacactggtgcctttggagaaattatttatcatatattatctatattacagagattgtgtttggcaaatccacggttttagagtcagtacacaaggcagataatcatttgtctgaaaatctcggacaagtgtgtttactatctatagtagatggcaccattttcttcacaaatatttattctcctcttctcctacatcgtgggaggagtatactactttgctttactgatttcaagatggtcatgtgatgtgctttggccaatggatcacaagtggatataacacacggccctcccaaaggaagctttaaacgtatgtgtgtggtctgggttggccttctaacctcctgccctctaccataggagcaaaatgttccagataggggctgcttcttcagcctgcgtaaatggaatgagaagacaatggagcagacccaaagccagctgagcccagccaagaccagcagagccacagctgacctgcagatttgtgaacaagaatgaatgatgttgttgtaaactaccaagattccaggttgttgccccataaaaactgacggatatactatccctaagtcttaattacttcatttaataaattgtgatttagtgtgtgtaaaacatagtgctgaagttactatagtgaaaaaaaagcatatactgcccctgctctcatagtctagaggaagaaaatggaaattgcaccatcattctagcacatgtgaattacaaacaagtaaatgctatcaaggaaagaaatgtggttccattagaacatataataaaggaaagtggccaagactgaggtttcaaaagagcccttctagaagaagggatacgtgagttggcattggtagaatgaacaggagttagcaaggtaaaaagacaatgcaaaaacattccagtcaagagagaaacaacatgcaaaggcctatggctaaaggaaacacgatttggtggaggaatgaaagaggctagtatggctgggcatgaaagaaagagggaggcctggcatgtggtgagattagagagaaagactgaagcaagaccagaggcctttaaaggccatgttttaaaagctagggtctttatcctatgtacgaaaggaagctagcaaaggttttttgttttgttttgtttcattttgtttttttacaacaacaacagcagcaacaacaaaacttgtattttaagctcaggggtacgagggtaggttagttacataggtaaactcgtgtcatggcggtttgttgtacagattatttcatcacccaggtattaagtctagtacccgttagttatttttcctgatcctctccctccttccatcttccaccctctgataagccccagtatacattgtttcctcggcccatatgtccttgtgttctcatcatttaactcccacttataagtgagaacatgtggtatttgctttcctgttcctgcattagtttgctaaagacaatggcctccagctccatccatgtccttgtaaaggacatgatttcattctttttatggctgcatagtattccatggtgtatatgtacaacattttctttatccagtctaccactgatgagcatttaggttgattctatatctttgctattgtgaatagtgcttcggtgaacatatgcatgcatgtgtctttatagcagaatgacaaaggtttttcaatggggataaagtaaggagttcttcatcagtttgtgtttgataaagctctgactgctagctacatggagaatgtattgcagggaatgtagagtgaagacaataaataagctgagtgaggaatgctggtggcttggattagggcactggcattagaaattagagaaatagatagatttgtgaaatttaggaagtaaaaccagcaagatcagcactgtgaatacagtattgcatgttagaaaaagaaggatgttctatagtactactatccatgaagcgatagatcttacaataaagaaggaatctaagaaataatgtctctggattatgaatttgacttaatttatcaattaggtttgactacttgaaaataacccataatggtaggtaatttcaactccctgccaccacagttacaggtggaaactgttattactgaataatggtgtgagcataaatgatgtttgtcaaacttgtgaatcttaggaaaactctttggacaagtgagtgaatattaatttagacttcattggagagttcaagttttttctctttccatataatctatgtcatctttttggaaaaggtgaaaacaaaaaaatagataatacaaagtacttcaaaatgccaaagactaccctctgagctagcttgaattctattccttctatttatttggatcaattcttatccaaatctgtgagatttgtatattatgagggtgttttctttgacatcttaaagttcaaagatgtgtttcaacaatctttagagtaggtacttatggcatcacagcttagcttctcaaaaagccaattataagacacagctgttaccatgccaaattcctatatatttggttttaaaaaaaactaattctacacctggctgatgaagtaaagacgaacgtgatagtataaatgtacagacacaaatcactgctttaagattccctctctagacccacatagtacatatctgtggtgtctaccagctaagcttctcttcctatattcccacccaaattcttttggggtacctgcaactcccccattgcaagcagtcctggtaggctatcaaataaaacaccttatctaccaagcaagagatccaggacaggccaaacagatggcgtgctccaggaatgtgactcttggcgattccaaatgataccaggacatgtatggttggagctacatcacttcaatggcagcatcctgaggagactgtcattaccgcaaccaggatacccagagctgccccaacttctattatttctgaggcctgtttgtgcttagctttcaaatttcagtctatgacctgcttcccatagctttccaatcttgtgtactattacataagtagaagctgattctcagataagacaagttgtccaaaatcacacagataataaatagatgaattaggattcacatctctgttagactgaatccacattcataatcttaataaattcattatactgttcctatgatcacatctcaaatggaatttgtaaaaagcccagtaacatttgtttattgccttagcctaccacttagaaattacaatgaaatgttaactatatctgctattttgctattcgcaagtgacagatgacttggaaagcatgtccactttagtcctctaagcacatttacattttcatattgccttcacatgacatttctgtggctacacttgcaatccagactagtctttcatcctctgttgacaatgatctgtttcattttcagagaaaactacccaataagtctctttaacgttatggatatagtctttctaaggaataggaagaaaatattttttcattgtcttacagtttttttgtttcaatgaatacatcacgtacctggtaaagaaaccttgctaccgtctcaacctttgccaacattatcattcacagagattccaatgagtgatacaaaccctagcagcttcagcctacagcttggtgaggttgactacaaagagcgcccatcccagagttactagtactcttattttgccatctttatttttgtctctggaaaatgaataaaatgtcagcttcagtagcaacatactgtggaattcataaaacaaaggtcaggtatgaagaacacaggaaaccaatggtagcaaaaggaaacccaatgcctgagctggccatcttggcgagtggggaaaactagaacagcactgaaaaccaagcatagttaagccaggattgatgggtaacagctgcactttgcaattcacctgcaattcagatccaatttcacatattctgcaagcccaaaaaaggccaattattgttaagtttctataagagtttaaacggccatgattcatttttgttttcctttaggaattttaggaccccctaagaagtattctctcttctacatatcatttctaggccttgaatttgaatggagcatctgctgagtataatggacctatttggccttttatctcattttttgtgaagctagtcaaatatgtatccttccactagggtcagcatcgactagatggactaggaagaatttcattagaaaatgagatctcatgggagacgataaagaccaggcttccaagacagagatgtgagttcaagtctctggtatttactagctgaagggctgtgggcaatcatgttaccttcttgaacctgctcccccacctccccccacacacacaatatagaaatacctaatttgtacaattacgaatccaaaatattaaatttaaatttaaggttttagcacaatggcacataggaatgactatagtgccattattaaaaatccagtaagtgcatttatgcaccatataatgtagtatatgttgtaaattcaatagtacataatagaatcatagtctctaacctcggaggtcttacatctaatgttaatgacaaaccaagaataaattccagtaagggggtgaaaagtgttctgatgatgggggaaatgcaggtaataatgagtagctattttattattaaaaacgtaaaacacatgtacagcagagtggtcaagaatctaaactctatcatcagaatgcctaggtgtgagtctcatgtctgcccattactttcagtgagactttgcataaggttatccatcagtgaaattaaaatgataatattaactatcttaaagggttttcacaaggattaacagagaaaatatgtatcgtactgagaatggtgctggagatatactaatccttcaataaatattacctataattaccaccattatgccaattccatcagtactgagctatacagaaatggtcgacacccttcagaatgtctccttctacacagacaaacatcgctttatgtgttttaagacaatcaagctataactagagaaaaatctaaggtatctctaaagacactttcaactcagaccatttatctttaatcaaaaatttggaaattttgatgttaaaattctgaaattattttgagggtactatagggtcttagaataaatagaagagaaaaataaacataaaatgagaggaagcacccccatagtgctggattttaatggaggtatcagcatcaatccatgatttaaaatatatgtatacatattttccagtcctttctaacagaagggcctagaaacaatgtcacctgagtagccatgagcacacttaatgcccagatcttggtttctaattatcttctatttaaatgaaccatatagctaattccagatctgaagcagggaaagtatgttatgccaggaaatgaggacagcttatagataaatagggttatctcaaaagggcagagacatctgaataaagggacttctgctgtcaaattgggcaaatttaatcaaaatgatataataaatggattctaacaccttgaattaaaagtgatctcagtttactagatgagagagaaacagcaacagacaaaaaggggctaaaaaaattgaggagaggtaaagttcttccttacagaataatgtctgtaaatatatgttgaaagaacgacaaaaatagaaagctaacatcttatatatcccatattataaatgactcaagccagaatcaccaacaaatgctaaaacaaacaattaggggaaatcttattgtggaacaagacatgtctattaattcaagtcacagcaaacctaggaaaagattgactgatatgtagccatggtaataagtagcatcctgaatcagattaaagtctatttaattggcactttctagtcaaccaatcagtaacagccctttattgctaaaagacagccagtcagcaacagactcatacatctctaagtgccaattaagcaacctgccccactcctcacctgaatcaacatgtttccacatatgtcagcttacttacttctgaaaatctacttaactccatactttccactttggtctactcagactgaactcgaccagcatagttctcctttacaataaattcagctttgtctttgaatttcagatgaatggtgaactgcattatcaccccactatataataattaaaaagaaaaaaactgtgtcttttacagtggggtaatctggcagtcatcaactaaccaaatggtgaaacttggcattgtcattagtgatgccaatagcctgacaggatgtactgatgcagaggcaaggggacaacataacctatttggtgtccttgccaaaaatggtttaaatgaaccgaatcaggagaaaacaatgagatggatcaagatagtaggctgttgcatgggccatatggcttggaatcttcaaataatttaatgtcatgaatatccaagggagttagacaattgatatatattttaaaatatttaataaccaaatgcaatttattaatttatgaataaccaaaagcaatttaggaaccttgactggatctgtgtcatggaggaaaaaaagccaactgagaaagcaaattgagaaaatctgaatatggaaaatatgatattactgaactaatgtgaattttcttgggtgcagtaaatggggttagttgtgtaggaatgtttccttattcttggaaaatgcaagctgaattatttaggagtaaagcatcctaacatctgcagcagactactgtttgttagagggtttggcacaaaggaagtgtctacagagacacggcacagatatatcaagatgtcaaagttaatgaatctcaatgagagataaacaggtgatcactgaactgttctttcaactttactgaggttgaaatttttacattctatttacttttattctgaatcttatatacacagaccacccatggaatttcccaggtatttttcttcagcctcaatttctcacttacagtaaaaataaatgtgttgtactctgtttttgtaagtcagctcaaaactttattggcagaaacagtggtccaaataagcaaagttcaaaacatttaataataattttcccctacataaaaaaggcaaatatttttcagttaaggataacaaagataagattccctttggagtttaaaatcctccaatctttcagctttgtccatgtcattatcctcagcaaacacacacaggaacagaaaaccaaacaccacatgttctcacttacaagagggagctgaacaatgagaacacatggacacagggaacaatacacactggtgatatggacaggaagcaggagggaagggtccctggtgagggttctactctcaagcctggacccatggccttaaatgagaataggcatgcttgtttttgtgcccagatgttgccttttccaaaaccactctgacctgccctgcaccctatcctgtgcccataagaaccccaaaccccacgctccatgagcagaagagcagcagagcggcagagcagagaacaggagagaagaggagagaagtgtctgaacgtggagaggacaagaggcagctggacatcggagactaggttggggagaagtttggccagggacagccttactccaagggaagattatcttcccactccattccctttccagctccccatcctgctgagatccactttcatcacccaataaaatcctctgcacacactacccttcaatccatttgtgtgacctgattcttcctggatgccagacaagaattcaggaggcactgggtgtggaaacccaaaaaggctgtcacactgactcttcactgagctggctaacacttaagctgtctgtggatggcaaggctaaaagagcattgtaacacacttggacgctgccatggggcatgcacagggcctgcttctgctggagagaagcagccagcagttccagtgttccttcactccggttcccacacccgtttccttgcacgctccctcccgtggggagtggccagcagtgggctgagtaaaactagcagcttcagttcctgccagcgaagtggtcaagggagctcccgtttcactggggcctgtcgaggaggtggggagaaggagagcatcaggttaaatagctaatgcatgcagggcttaacaccaggtgacgggttggtagatgcagcaaccaccatggcacatgttgacctatgtaacaaacccacacatgctgcacatgtatcccagaacttaaagttttaaaagataataaaaacaagagttataagtggtggaacaacaacaacgacaaaaatcctccagtgtttatcataagccattttgcctccaatgtcagtaagacaacctagaagtctctgagaggagagaaatctttccagatccatcaggagacacagaagtcacatgaaagcgttcctacagacacatgaaaatgctaagggtatctttggacactgaggactctcccaccaacagccacactgacaacagcctttggtgtctcactcagaggagtccctggtgggaagccaggctgtaatctgtcacaagagcatgtgagcagaggccaccttactagataaaatgcagctggttaccgcattccctggagggacagtgacctccgacagacaaggtgaggcaggcagacaaaacagtgggcaccgcaaatgaacaggcaggcgcggagtggtgcctggaggaaagcctctgacctggagccgagggagagctgctagataaacaagccattataagagggtaatattccatcctagtgtgagcggaagctgggaagaaaaccaactgtaggcctgatgtggactgcagctggcaggaaggctgcagagctcggttcaaggcaggagatcctgcccctgtccctggcacagaacacaaacagcaccactggatgtggtgggaggaggaggaaggaaaatctatacatttacgggacgtgaaatgcaagaaattgagggaattcgtccaggaaggaggaatgacaccattaatatcagtatttatgggcttacaagaagataaatgcatttcaagagtagcctcaccccaaagagaactaaccacacaattaagatcaaggctactgtcatagacctggctctgctttgaaaaacaagctacaaagggaagtttgggctttaatttaaaaaaaaaaaaaaaatgttcacggaaataagagaaactttaagaaaacttgtagaacacaaaaatcacattagactcttctataattctcataacaatagaaacttaacaataatggagcttatatttgaatgcttcatatggacgagagagagtttaagcattttgcatatattaactcacatgatcctcacaacaattccgctgggtagatactattaccgcccatttgaagcataaggtaactgaaggaaatctaggttaagtaattcccagggcttgctcttgtaagacaactgagcttggattcacatccaggccctcagctgcaaagcttatattcctcagcccatgaatactgcctctgggtatgcaaaaatcacctttgccttcaggaaataaggctcacatttttaagtgaacactcaagttgatatagtggggaaggcggggaaggcagggaaatctggagctgagacaaaggagtggggaaacatactatgggttcagaggacctatccacaaacctgttggtctctgtacctcttcacgctgttgaaaaattgactacaccgaagagcttgaatttatgtgactatatttgctgatatttaattccaagttagaactaagaaaattctaaaatatttattcatttacttaaaataataaacccatatgttaatgtaatattttaataatattttctaaaacaaaaaaactagtgtgaagagtgacaaatctctaatgaatggcttgatagaagataattgcatccttatttctgcttctgtatgcaatctatcatgagatgtcttcgctaaagcataggaagaagttggcctcatatagacatatagttggaaaaggaactacttcacaaattctgcaaaggtcttggggaccttccggggccccaggaccactggtctagagaaaggactctagagttagaccacctggatttgaaacctggctctgccacttaatagctgtttggtctagatcgatttagctcatattatctcattctctcatctataaaatggagataccaacagtacccacctgataggtttgctcatgagtgctaaattaatatttatcaaatgcctagaacaatctcagagcataaatattatatgttagatgaataaataaaatgacctggctttgcaagaagcatctccgccagagtaacgtctctgtactgaattgtacattctgacagctgagacaatgacagggatcacttgagcgaaagtgatcaattacacccatgttataatagggataattataataggagcttcagtaaattgagaaatcaattgagatacaaacttcgacttcatgggagctaagaaaacataatcatttgaatctctactcctctgaggatggatagcaacatcctttcaaaaccctttcatgttcaaagtcacatcagacaggggaaattctttaatgtaatttctgttgcattttggctataaaaacatgtcgagaagttgttaagctgacaaattccaaggtatctcttaatgacaaaaagtgggtgaatagttataaaggctcaagagttaatgttattttagggttaagttaaatatatttttacctgtgcaaatttttatctatttcatttttaaaaattgataaaggtcattcaggaggtgatttgagaacacacaacttgttgtagatatctttcttatttatattattgccatatatgatgcaatacatgtaaaattcttccatcccatcctactatacctttcacatattctttgacattttattccctccatcaaatatgagttgtcttttagatagcatcggaatcataggatactaagtagctacttcctctgtctctctacacccacctccctaaaactacaggcggctgacccactgatattactatgaattttttgctcttcatcaacggtcaaagggtggtcttcagtccaatggcctggttaactgggaattgccatatatggcttatcatttttaagaaattacaatattgcagaaagcattttatatgaaaattatattaaacataatctagaatgtaaaacagcaccataacgtcatattgaatatagtacatttcatgactcagaagacacattatagttgtgccacaatccccaagatctgtcttttcaatattacccctatgcaggaaacatgtgaaactagcaattaatagtataaagaccaacttaggagttctgtaaagaagttagttagaatgtgaaaacaccgctgtgcttctagaaccatactgcccggttcatcatgacactcctggtctctccatttataaacttggaaataccattctttaccttcttcaagggtggccaggaagatacagtgaatttttaaagcatgcctatgaagttccatgaacttgttggtgatagtggactagcaaaataaaaattagaagaaagaaaactcattcaaaaaaaatcacaagaaaatacgcacaaatatttaatctcaggatagattttgcataaaagaacaggaaaaactcataaatgaccaagttgacaaaactatgacaaaatttctacatgttaataacatcttaaagaaactgaagaggctagggccaaaaaaggaacaatatttgcaacaaatgtgacaggtagagggttaattcgtaaaagatctctaacatattgggtttttaaaaatatcccaatagaaaaagaagcaaagcaccttcataggtaacttattgataaaggtaatgtatatatatgtttaaaagttaactccactagcaattagataataaaatgtaaacagtgagatatgtaaaatctatcaacttggaaaaggttaggccaaaacaaaaaacctaattcttgaagtttatgagatgtgtacccccatgcagtgctagtatacaataacttccgaatgttcatccatttaaacaccacataatattatagcaagtagtgattccagtttaagaaatttagcagaaacattaccaaagatcctgtaccaaaatatttgttacacatatgtcgaaaagtcagtaataactaataaattatagtagatccatatggcacaatattataccatcgttaaaaatttcatttatatgcaggctgggtgcgctggctcatgcctgtaatccaagcactatgggaggcagaggcaggcagattgcttgaggccaggagtttgagaccagcctggccaacatggggaaacttcgtctctactaaaaatacaaaaattagctgggcatggtggcctgtaatcccagctactcaagaggctgaggcaggagaattgcttgaacccaggaggtggaggttgcagtgagcaccgaggtggcaccaatgcactctagcctggacaacagagtgagactgtctaaaaaacaattattttttacatacatattaaaacgtcagaaaaatgtcaacaatgaagtaggttaaaatcatgttataaagtgtttctctttttcaagagaaacatgtaagaacaaagaaaaaagtagaaaggaataaactgcagttttggcaaaggttatttctggaaaataagattatagatggtttttattttgtacagtgggcagatattcttatgattagaaaaaataaatgaaaggtttaaaaatgggttacacttgatataaactagactgcagcttcatagatataatttaaacaaaacgtttatttagtcaagcaattcattagctggttactggtagactgcattaaaaacaccaaatagtttgaatatatttacagttggcccttgaacaattaaggggcaagtgatcctgtaccactccccatctgcatagttgaaaattcacatgtaacttaacttcccaaaacttaactactagtagactattgttgactggaagccttaccaataaacacttgattaacaaatattttgtttatgtattatgtattgtattcttaaagtaaactagagaaaatattaatattaagaaaaccataaggaagagaaaagacatttacagtattatactatatgtattgataccatagcttgacatcatctatttacaagatgaatcatctgtctaaaactgtaggtacatatcaaggaatttaaccttttcttgtaacatcatggcttttctctgcttcttgggagcacgtccagcatcactagtgacccttcatgttagtcccatggtactattccaggtttatggtatgcatcacacacaaagaaaaatgagaaccatgagagatcactttttactgtgaaacaatttactggagtgaccatcagctcagagatgattagtgtcctgaggagttttaaacagatactcccaacacttgagctcaccccaatagcaatacaaggtggctacaaatttcttatagtacagtatgtactatagttaattttatgcatttatgatttcatacaccatctttatatttctttatattcctctcaactgcaagtggcaccatgtccagactgtgtttgtgtgcctacgtttcgataaattttaggcttgtttgtgtttatggtactaaatgatagaacagactagtatctacatatattaatgacatacatttattctttttttagatatttctagctagttttttttcaaattgtcacaaatgtccaaaaaatttttctaatatacttattgaaaaaaatccacagaagtggacccacacatttcaaacctgtgctctccaaggatcaactgtaattccttttctccataacatttcagtagtatcagaactacattaatgctccgtacctcctgtgtacggattatatcaggaggctgagctgtggatgaaagagattttaaaaagaaacagtagtgtgatttgaaactaaataaaagagaaacatctcgtctagagagcatgtcagtcctagtccaaacctttccagcatgtacaggctgaacactccaaaatgaaggtctactgcttattgctgaattgttggtagtctcaatgaccccaggattgcagagatgcttcactttcaaaaaaaaaatccattaaaattagttcaaagaggacactaacatggtgttagagggtcatttttcaatgttgtgggtggaggagcgagacacttagagtaactcccattatggttaatgagagttgagcatctagactcatctaaaccccctgagggtttaatttaaaaccactatggcaaagcaactctaagccatgaatgaacagcagcatttttcacacacctacctcttcccaagtaccaaaaacagtagaaataataaaggtgagtttgtttggttgggtttgatttttactaccatgcctcatagaagagaaaaaaaaaggaaaaaggctcatatcaaatgcctataaattttttggtttattttaaatccagggtgttattttaatgccatttttaaatgactaatttaaacttgagtctgggtttttccagttgctatgtgatgttcacatagaaatgcagtatttttttaaattccatttaagcttcagttttacaaatttagggctaccattatataatgtccattccaagacccatgctcttgatcaaccttaaggcatcaggataatggacaataaaaaaaaaataagtattattattattttttgaggcggaggcttgctctgtctcccaggctggagtgcaatggcatgatctcggctcactgcaagctccgcctcccagattcacgccattctcctgcctcaacctcccgagtagctgggactacaggcgcccgccaccacacccagctaattttttgtatttttagtagagacggggtttcaccgtgttagccaggatggtctcgatctgctgacttcgtgatccgcccacctcggcctcccaaagtgctgggattacaggcatgagccactgtgcccggccaaaagttataattattataccatgcttccaatatgccaaatttattcattcttctgacttccatatcaccttgttttaattctctcacaagagcccaggaggcaggcaaatacctgttttcatagcagaaaatacctttatcttcacatgagcaaatcaaacaaaaaagaataaatgacctaagtttccccatatgggactaaaatacatttctccaattccctgtccaaagctcatttgcagttttgacaagtacaaatgttttgtacccaaagacagtaaatgaggcagtagagccattggcaggcagagctctttcttctcccatgtacattcaacaataccagaaacaggactgagagagccttgtaaccatcatttccatggtttgagttttgtggtagggtcagggaaggcctctgtgtgtaagtgatgacaagggaacaggaattgaaaggaggaaaaccagggaccctgtgtaggtcagagggtggcaggtgaaggtcagaggaatgtcagattttactttaagtgaaagaaacagcaacagcaaccagaagttttttttttttttttttctgacacagagtcttgctctgttgcctaggctggttgtgcagtggcacgatctgagctcactgcaacttctgcccccctgagttcaagcaattatcgtgtctcagcctcctgagaagctgggattaaaagtgcccaccagcacacctggctaagttttgcatttttagtagatacagggtttcaccatgttggccaggctggtttcgaactcctgacctcaagtgatcacctgcctcagcctcccaaagtgttgggattacaggcatgagtcactatgcccagccagaaacaaccataatttcttaatgcaaaggaacaacctgttcttgtttctgtatttttaaaaatctatgtcagctacatagtggtagactggaggatggatagtggtagactggagttgcgggagtgataaacaaggaaacctgagagctcactgcacccagttcagacaagatttggcaggagtagtagagatgttgagtaccagactcagaacatatttttgagaaacagcctccatgtgcattggaaggatgttttgagaatgctgtcaattacatattctggcatcatctccttgaggaagaattcacagaaaatcgcctgatctctggtgttgtgcacatttctgcatttttctgaacaatcagcctatttttacctcaagaattgatgctctttccttatttaggttggtgatagaaagttcagggccaactttgtgacccatctgtttttgttggttttcaggctgctaaagacacacccaagactgggtaatttataaagaaaaagaggtttaatagactcatagttccacgtggctggggaggcctcacaatcatggcagaagtcaaaaggcacatcttacacggcagcaggcaaaaggaaaaatgagagccaagtgaaaggggaaactccttataaaaacagcaaatctcgtgagacttattcattaccacaagaacagtatgggggaaaccatccctgtgattcaattatctcccacgggctccctcccataacacgtgggaattatgggagctataattcaatatgagatttgggtgggcacacagccaaaccatatcactatctctagcaagtatataaatattttatatctatttgatgcactaatctcacttttggtccatcttactttccttttactacttcttgaattttgtagtttgcttttttttaaagcacttaaatcttactctactttttcatagtcaccttaaatcatgttttaaaaattctaggaaataaatgaataaacaaactaaaattgtctaatggaaatttccttgattattatagaaataataaatcagaagaaggtttcatcaaagggatcatcagaaagaaatagagatctacaaaagggcatgttatgtaaggcaacctgtatgcatgggaagccaagatgataaagccataaaaacttgactaaactgaagaaattgcttacagagctgctccagacttcctgaggaaggcaagacagtggcatatacaatcttgggaaatcaaatctcatgagccgacgagttatcaaacccttctgttagatttctctcagctgaggaaataactgatttcatcagcctggctggaatccacatggaaatctatgaaacctgtgctgggcatgggaggggttgagtatttttcatgctcaaaccacctgttacttctctctctttcaaagcaggccactttggaatgatgaatattagttatgtctccaagcatgtgttcatgtgtgttaggtacatagaaatcctggttgacactatgttaaccattgcagtatactgcctggtgtgagaacttaccacattattctacttgttaaatgaggaccgttgtcctcttttatctttagagctaaaaagccaacatggtcaaccagggtcactcatctagcaaatattcatttaacaaatatttactgaacacctcctatgagcctggccctgcccaggcagaggagatgcattcatgaataaacctgagaatcatccctgccctcagagagctcacattctagtcagcctgagacacacacacacacacacacacacacacacacacacacacacacacacacaaataaattatataataatttagtgtataaacactacaaaggaacgtcatgtggtaggggtgcaattttaagataatgggaaagactattctgtgacatttgagcacaatctaaatagaggtctgaaggagttgagtgaacatagcatatgtacatctggggaattggcattccacgaagaataaacagctgctggttcaagggctatgaggcagcagtgtgcttagaatgttaaacaaacaacaaggaatctagtgtggttggatctgagcgaatgtggggagctttgaaagttgtatgtagctgctgtaacaaattaccataaattggtggctgaaaacaatagccattgatgctgtcatggttttggaggccagcgtggcatccaggtgtcagcagggccacgctccctctttgctgctccagcttctgatggctgtcagcattccttgacttgtgaccacatcactccagtctgccttcacgatcatgttgtgtcctccttttctccatgtaatctccctgtctcactcttataaggacactgccattggatgtaggatttgcctggctgatccaggataatctccccacctcaaggtgagatacttaactcacacatccacaaagacccctttcctaataaggtaccattcacaggtttcaaggattgagatatggacatctcttttgagggatccccattcaactcactacaggaaaaatggtaatagatgaaatcagaggggcaatggttgatggcagggggtggatggaggagtacaagtaggaaccttgtcaatcactgtgataactttggctttagttagaagaaggtaggaagccactgtggggataatgagagaagtgacatagattcaacaagtcttaacaggatcactccggctgctgccatgcaaaaaagttccaatagcatttaatccttacattgatactttgttggcttaagagcatgccaaatttagattagaaatgaaaatgagaagaacctgatatacagatcttcagaaaatatttaataattaaaagaatattcctctacctaaccatcctgttttgaaccaaaattaaatttatcccataaatatttatcaaccatctaatatacacaagattctgactctaagaattgaagggatcacaccctacctaatgtggtattgactgacaaccccttttttttaagatttatgtcatctctttgtgtaaacaataattgaagaatctcaacttagtgggagaaagacgtgctaccattatattctttgccattacttttccagccaccctatgttgaatccctttctggctctttaataatatcttgggcagaacgtataactatgtagtcactttccataattgtaaatctctccattttaaaattctagtcttggttcttttaaaattttatatcctatcaagcacagacttgagatgcaacttttattacttagagctctctacaagtgttcccccatagtgaggctaagctatgctagcgttaaaggcagagtggtcttaggtatcaggttgcctgtcaacaggtgacaggtggccaggtgtggtggcacatgcctgtaattccagcactttgggaggctgaggtagattgcttgagctcaggagtttgagatcagcctgagcaacatggtgaaaccttgtctctacaaaaaatgcaaaaattagctgggcgtggtggcccacacctgtagtcccagctgttcaggaggctgaggtgagaagatcacttgagtcctggagctcaaggctgcagtgagtcaaggttgtaccactgcactatagcttggatgacagagtgagaccctgtctcaaaaacaaaaacacaaaatgaaacacacaacacatacacacacacacacacacacacacacaaacaggtgacaggtaagtgtccctggtctagctccagttccatctgctgggagcctctgcaaatacggtagtctgcactggtgaattaacagacatgttttttccaggaaggtagtaaagtctcgcccccgtttgtttctgaggatccatttacaaaaggacagccatgtctcccttttaggtctgccggtgttccatgacccaatcccctctctggagaggccagcacctcagttggcccagcatctacctgagcaacctagtggtgcctgcctcctactcggacattcatggtcatttacaggaaccgggggacctgctgaggttggtgcttctgggcttcttcaaagggctaccgaaaaggtgaaatagtgtagaaaagttgttctcatcttttttcccaggaacactactcctcttcagtgacttcttgctctgctactacaggcctctccaacaagcctcccctgccccaccctacattcaagaatgcaaagatgagaagcaagcactcttgtgtgctcatgtacaattccaaactccacagagcacatgggaagctctccaaaagcaattgtacctccctgcactcccagatcatgacagtacctgtgtcagcctgcaggtcctacagcttcgtagcatcaagccaaagaacaagatgccagtgtcattttgtggaaagcatcccccaagagatgtgacttttgaggcagtgggagtaattattccagaagagggaagaagaaagcatccctacactcctcatttcaactgtcgatctttgtcctcacgtatcctctccctttgcggtttgggggcgtggaggtatgtttcagtgaggtaggaatggttctgctgctgcctctcagtaatgtggatgtggggagcatctgtccccacatgtcagcattcctgcttaggccttagctgtttattccgcggaaatatgaaaagtttcactcaacatctgctgcactcctgaacttcaattacattactgcagatatgactccctgagagatggcttctagagtcatttggtccctaaacagaatagaaaatactaactggtattctaggcctctgcatgtgaaacactctagattttcatgtaattcctgttgatttatttttatcttgacacatcttatttaacaactattaaagcaatcatctttggtgaatggaagggtatcatggctaacttttaaagtattagcacgtaaatctcttgaactgaaaattaatcttaaagataaaaagaagttcttgataacttcaggcatttcaaaacctatcagaaaggagaaaaattggagagccagatgaatttagctcctcctggacccattttatctcagagcaaattatgcggctaaccaagctaaactgcctggccccatatagatggcagtggagagtaaggcttaaaccttctagactttcagaagtcactaaggttggtcttattcttaaatgataatgaagcttacaataaaataataaagccactaacagcaaaatgcccataaaaatataaatggcagagtaaagatttaggaaaatacaacactagaaagtggggctaatgggaaaggtttaaactctagggagaagaacttctcaggacacccaccccaccgtacatagaagtttgcagcacatgtgaaatgtaactggagaaggtgaaatgaacaatggaatgagaatcaaaagtcctgggtaaagcccagactcccatgaactagagccaccattggtctgtgcctcagcttttccattcaaaccactcataggccaatgaggatagaacaatttttgtttcagaaaggttcttgctctgcagcccaggctagagtgcagaggtgcaatcacagcttactataaccttgaactcctgggctaaagcaatcctcctacctcagcctccctagtagttaggactacagatgcatgccatcacacctagccaataaacttttcttgtagaaaagggtctagctatgctgcctaggctggtctgaaactcctggtctcaagtgatccccctgcttcagcctcccaaaactctgggattacaggtgtgcaccactgtgcctgtgtgaaacaaaatattgactccaataatgcattgttagtcataaaatataattttaattatttaaaattatcttaatgtaagatattagttatatgtatataaatatactctccactgccacagttaccccaaacacatatacaaaaggaaaagaaaggaaggaaggaaaaaaggaaggaaggaaggaaggaaattgcctcagtatcccccatgctacaagtaagctttcccttaaaccactattaggaggctaagttcagtgtgaggaagatgaccatttgatacgaagaaagagttctgttggtcttaattaatcagctaacctacaactatgcttgacttaattggtcttgaagaacaaagaacatgcttggtcttaggaatataaaggagcttcttccatctgtttttctccctctaaaatctccctctaaaatctactgagaccatgtgcattggcatgtctattcctgttattacaatattgaaatacacaagtattacttattacccttgcgtgctgctcaccacctcttttcttcctcccctgggactctccagacctccccacaatgcacaaattaataggctgatgtctggcacagtagagagctttcaggaaccacctttgacattggtcagtaccacctgtcatactaattgttacacataaacataactccactgcctaagacatatccacccatatcctgacccccaaatgcaggcagatacaagctaaaccaaggctcctgaaatatatttaaagcctgtagtagaaatctcacaaagatagtttagattgcaaactacttcagatatctggtattgtagaggtttttaaggataagtccaatgtaggatttgtgcccagaagctatttgcaaatttatggttattttttcagttaattagtttgagaaaggaaatggcagctaagtaaataaattagatcattaatttgcaataaatataaattaattatgctaattctaagagttgaacacatatacgtattttgtatatataataaaaataaggaacatacataagactattaggagaggaaagctaccttgactgttgtaaaaaaatccacgtatatgtactcagtagattttaacagttttgatatgtgcatgaaatataaaagaataagtaactacctactgatgttcaaacaaacctattttcattccaaatggaaattagaatatattctgcattatttgagttaattacatgacacttcttataaataatgatgtattattattccattcattacttctaattatattccttagcaagtgcgatgcctgcaacaccatgaccagtcttttcctgttccttaaaatctgatgacttgcatggaaagcaggtcaaaaatatgcccagaatataacgaacagagttcagtgattgttaaccatgacagtttaaaactacttgaaaaagttactgtggaaataaatagaaatggtgaacagctttccaaattacaggatacccatgatagcaacataagaaatatttgaagtgttgtctagatacatataattatcattctaccattcactagaattggagaaagaacacccctaatatccctctcccccagcatacatacacattaacagaattacattctgtgtagatccgcagatcgtaaagatacacatttctggttgcaaaagtgactctacagcctttatgcaattctgagaaatgtacctgctaaaagtcctaatcaaaatgacagttgaatttttctcctgtaatgcataatcaggtcaggccagcccaccccatcccatgcacagcacggtctggggctagaaggtaaaacatagtatggaagacaggtcaagatcaaggaaagacagttaaaactatcattaagcaacagggacctagtaacccacaaggctactttgtacatacatatcctcaccagagagcaggcagcaaggagccagaagagtcaaggaagagaaggcagatagcaggaagtagtctagatgaggtctagagaccaacatgtacatgcctcaggaacagtgtttcgtgggtatgtcaccttcattttgaaggggccagggcaaagtgcacaaagtccacacatttttcttcatccaatttcaaaccttccttgcacacatacaaagtacctacttaattccttcagcatcagcttccaacaatccattgttctgtctatgataaaaaataaagatgtcagtctcggctccagaaacaaaaaataaacttgggagaggaagagactagcaaggagggcttccccttcccctctagtgcccatcacagttactgccttctgaccccacgtgcagcctgagtcctcaaccttggcagctcactaccaactgatcagctggtatgtgagataaaatgaatttgttttctgcattgtaattctttagatggcaagtcaagatggatgatggtcacagcaagtttgtcttacaatgggagttggcaggattctctgtggtggattttagacactgaaaaaagatgttggtcaactttgaatgatgacagcatccaataacttcctttgttcccattgtccagtgctatcagaagctgcttgtagctggtggccatgtactctaataacccaagggtaggtgcacattcatatggaaacctttcccacagaagtaggaaaaagaaaggtccaacttaacagtcactgctaaatgcatgtctttgaacacaataatctgccaaatgaagtcaagaaagaaatgtgaccacaagaaaaccaacttgccccactacaatggacagcaatattgtctttgaacatttctcctccaaaagctcttaagctggctaatatacaacaagcatgcacagagcaaagacaagacatgtgcttagggaaattttaagagcaaaaacctatctttagctataaagatattaaaatagtgcttgtgctcattttacttgtacaggaaggtttgaaaagaactcttttttttttttttttttttttgagacggagtctcgctctgtcgcccaggctggagtgcagtggtgcgatctaggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgaaaagaaactctttagagaaatgaaagatcactaataactgcagtttcctgaacaattaaaggaattcacaagattacaacctactgaggaaatgacaaatatttctgatttttatggaaggactaaaagggcgcttttatgtatagcatctattctgtaagaatcactgttaagtaatgaagctatttttattatttttccacttatttcaggaacactcaacatggtaacggtctgaaaacgggggaaacttaacattgctctttggaaagttaatattccgtattaaaagatatttgtcagagttttcttttttaccttttgaatttggatcttggagcactgtttgcatggtagccaactttttatttctaatgtgtcagcagaaatgttcttaaagttacctagtctaattctctcacaaatatactttgtaaggctgtccctacatgcatcatcctaatgttgtatggccctggtaacattctgcgtgagatggtcttgattggaaaaatctgctctttttaataactgattcaataaactgttgacgtatgatttgtagaatacagtatgatcagtgagcaaggtttctgtcattacacaccctattcaattcatccacaaatgttgctgtgtctccctcatgttgcagctccttatgccattcagaatagcaatgcagagatcaatacactctctgctgaagacgacagaacaaatgaataattttatttacaatgaaagccccagtcttcaaatggataccactaatgtttaaattcattttcatgctcaactcaagaagagagatagacacagcacaaagcaaagggagtgggggtaaggagaagtattagccataatggttcaaatttatttaagccatgaacaatagctgggctgcactgagacacaggaataaaatgtttgctgcagaattctgaatgtgtactcttcaaaatgattctgtcaccaagaaactctgaaaagcattttccagtaacaagaaattaatggattaaagacattctgacatattcttctaagcgttgcaccacagaagccaaagcctgttcaataggctttaaacagtgttggcaaggaacagaagcgtttgcttcaggtgggaacaaggagggactgaagtggctgttttgagaatgaagcaaacgatcctgcttcaaaagcgtatctttggcctctgatttgacagttctttttctttctctgaaagctatgaaaaagtcagtgagcaaagtcataagaaataagtgttggtgaggggcagcaaaatgttataagagagacaagttcaaagatgacatttacaagcctctcatgaatggcacactccccaaagggcacctgaatgccatttttaagaagaagtcatcaaacatacaaaataaaatgttccattttacataaagatgccaatatactgcccttaaaacacagattggtccattcacaaattaacatgtaaagaaatggcaaagaaccttctcccatctgccatcaattcattcactgcttttagatttaactccctacactcacacgcttgtaaacagaattgtaatggacaaaggatgaaggggaagctgggaaaacctagcttggacatgatactgaaacatctggaaaaaagtggtgacaagacttggccttggggatgggaaacgggaaaaggtgggatttcggcacatcctgtctctctattctgttaactggaacaatgcatatactcctgatgtttccagcttcactttagattcagtgaacacagtacatttggatgctaagaaaaaagagatgtgcaagagcaggtctcgtccataggaagcaaagactcagtgcagacagaaatagggatgcacgtactttggatatgaggcagactgggctgtgtgtttggtcttggtacctggaacagagtatgagctcagtaataaagtactgaatgaatcaacatgagaataaggaagtgagtgtcacaaacagaggacagagttttgttttgttttcttccctaggagcaggggacagttatcaaagcacttcagatgaaatgaaaagcatggggaggaatctccagttgaggtgaggggcaggagaaagtatagtaaagggatagtacaacacatattcagggaacagccggaaagaagggagactgagccagtacaatgaaggtccttaaaaactattctaaggaatttggactttatcctcaaaaaacagacattccttattggtttattaacaagggaagagaagaatgatatggtcagggctgtggttcagataaagttataggctacattggaaaagcccagaggcagggagacagcataaatctagatgaaccacacctaagggctagactagggcaggcaggagagaacactggaggaagataaaagcccactccagacatctcaccatttatttatgaaatgttagtggacagagctatccacatcttccattctcaagtctcaggacaaaagactagagctttctgcaagcaaaggagtaccttattaagatgcgtctcccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagatgcgtctcccagttgtaacatggcagagtttataaaggtaaagtaaaataaaaagttacaaaatcatcacataaaaagcattgtctgaatacactgtctactggccctgagactgttttaaatactgcagctgttaattagacttatagagtataatgattttaaaaaagctctggttctcattgttcttataatcagagagggttggatccttcttgctaccttccaaacaaactgaagtgtgttaattttaataaaatattctccgagcccttggtatttactcaaatataaagtaactgagcagggttcatttcccaaatggtgacaccagtgccatctacaaagaaacgagttgtcattcactacttgctcactattcactacagatattttcctagacatagacatttctacttttcttgagttcaaactcaggtatgccctggttttagacatcactttttctgagtttgttaaaaagtctgaaatatcaaattactctcaagatatgagtaaaaaaactacaaagcagagttcattccattattaaccattttaaaaagtggccaacatggcaaaaccccgtctctactaaaaatacaaaaattagctcagtgtggtagtgcctgcctgtggtcccagctacttgggaggctgtggcacaagaatcggttgaacccgggaggcagagattgtactgagccaagattgtgccactgcaacttagcctgggctacagagtgagactctgcctcaaaaggaacaacaacaaaaaaaagtggtacatctctgtgacctctaattttcataggaatgagagtgaatttagacaaatggatcttgtctaaattcatattttcatcccaggtccctttatttcttttctaaaagtcagttaaagctggcacctagagagagatggcatttaaaccatattcttttaacacctgaatttacagacattttgctttaaaaaaccccaaaggaaaaagcccactacaaacttatagcaaaataaaatgttacttcaagaaattcaggtcttttaaaagatttcaatacacaattggtattaaaattaaaagtgctgttttctagggcttttctaaatcattctagtgtttttttttaataaacagaagaaaatagttttctaatattatttagactcatttaaaagaagagttttaaatattaagaaaagcttacatatttactagagtattgcttattagttttctaaattaatacaatttatttgactagaatttggattccagaaatttgggagtctataatacaatcacaattatcttttggtacatgtttttcttatttgtattttttttttttttagcatacaatagttacgtggctagaaaagaagcttgttcataaagttctcaggcactttccacattttcactggaaaaaaaatgtagcttactctgaaaaacctcttggcatatttgtacattcagaattactaagaaattcatttcaaagcaaaatcatgtctcagcgtggaaaatacttattatctgaaaatatcaaattttattctgttgccttctgcatggcaaactaagtgaaggaggaaagagaaaaacatcctgaagagtccgtacaaaattcatatgcacacaatcaggagtgaaacttttaacaacataaagataacttcccaagcatttcaccaatacttgttattcccactgcaaaagaataaagctcctattgaagtctataggaggaaagactacaactcagtggtcagagggaaataaaacaactccaccaatgacactggtcaatgatctgcaagctggtatttttcccaagagaaaatgctatttcaggtcctaatattttttaaaaaaaatttgtaagtatatctataatataaatttaattaaaacgcacaacttgaatgatctccaagaggtaaagcaacaaagtcagtctcaaatcctcacatatcttacttccacatcacaaaggcaccactcaatctactattaaaattcacaacagataagctgaaaaccaagtgcccgtgatattcactgggctcattttagaagcacctatttatttactcagctatggtagtgaaaaggtcaagcaaaaattcacctccaaagccacggttgctaagcaactctcctcagaagttctgcaacattgatcaagcatattactggtgccaccaactggattcagaataaatatgagtaacatcttacctggtgtctccgaagtgggagggagatggattctttatttacctttttggacagactggaggccaatcttgtatttatattcatttggctggttaggctcagaagacttttattttccctctccaaaaaaaaaaagaaaggatacgtcctggtaccacaggtttcctattcacaagagcgaaggacagttctgttttgagaaacactacagagggcttgatgagatgttggccaaatctgaacgacatgtcctcacagttgaagtctaaaagaaaagacaatggatagttataaaattcaattaagaaactcagttcatataccaccttaaagaaagcaaattccattactacagattcttagttgcagagaggatgccattgaaattgttcctcattgaatgttcaccaagatgcattctgggaaagtctttctaaaatactccactctccctaccagtgtttccttgattagagttagcaattttcaagcagaagcttccacgtggacaataaaacagcttttccccttcactccctctgcacttcacggtgccaccttaactcaaatccacaaggccctatttgtcagctacttatttttacccatctattttgtcatgtctgctaagctgaaaattttcattaagtattaactataaaccttctaattcttaaatgcttctctcaaatggttttgtgttcatataatagcaatttagaacaagtacgaacactgtctgaccttgcctacaattacaaaaacatgagcacttccagagaactattctagtaaaatctccaaaataaaggagaaaaaaaacatttaaaaagaaggaaggagcaaaacggagttcaaaactagaacaattcctggttgtaacagggccacaaagcagcaaggtacctgaaatgttctgcgtcttccttttgagggaaagccatggggggccgggggcaggaaagggaggctgaagggaatttggcaaatggcacagctgagacaagccaaatccatctagcaccaaggaatgacttttcaatcaggtggatgccaatacatgacaaagttactttgtgaatgactaagacacactttgtgaatgactaagaaacaccatccctagaaaactacttcatttttctaattcgggaacagcctagtatgaaactgaggaacatggatcaatctacagaaaaacagagaaaggattacaaaaaggatgaaattagaaaatagttggctatttgtgatatgcatttggttttcaaccccatttcctggcacgcaactcctaaaatccttagaaactccaaagtgatgtctttttgtatgctaatgattgactggtgtctagcagcctctaagagtctaggtagcttcaggatggggttgatcacaagaaggaccaagcacacttatacaccaataacagacaacagagagcaaactcatgagtgaactcccattcacaattgcttcaaagagaataaaatacctaggaatctaacttataagggatgtgaaggacctcttcaaggagaactacaaaccactgctcaacgaaataaaagaggacacaaacaaatggaagaacattctatgctcatggataggaagaaccagtattgagaaaatggccatactgtccaaggtaatttatagattcaatgccatccccatcaagataccaattactttcttcacagaattggaaaaaaactactctaaagttcatatggaaccaaaaaagaacctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccacacatctacaactatctgatctttgacaaacctgacaaaaacaagaaatggggaaaggattccttatttaacaaatggtactgggaaaactggctagccctatgtagaaagcagaaattggatcccttccttacaccttatacaaaaagtaattcaagatggattaaagacttaaatgttagaccaaaaaccataaaaaccctagaagaaaacctaggcaataccattcaggacataggcatgggcaaggacttcatgtctaaaacaccaaaagcaatggcaacaaaagccaaaattgacaaatgggttctaattaaactaaagagcttctgcacagcaaaagaatctaccatcagagtgaacaggcaacctacagaatgggagaaaatttttgcaatctactcatctgacaaagggctaatatccagaatctacaaagaactcaaacaaatttacaagaaaaaaacaaacaaccccatcaacaagtgggcgaaagatatgaacagacagttctcaaaagaagacatttatgcagccaacagacacatgaaaaaatgctcatcatcaatggccatcagagaaaatgcaaatcaaaaccacaatgagatacaatctcacaccagctagaatggcgatcagtaaaaagtcaggaaacaacaggtgctggagaggatgtggagaaacaggaacacttttacactgttgctgggactgtaaactagttcaaccattgtggaagacagtgtggtgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacagtgatagactagattaaggaaaatgtagcacatatacgtggaatactatgcagccataaaaaaggatgagttcatgtcctttgtagggacatggatgaagctggaaaccatcattctcagcaaactatcacaaggacaaaaaaccaaacactgcatgttctcacttataggtgggaattgaacaatgagaacacttggacacaggaaggggaacatcacacactggggcctgttgtggggtggggcgagggtggagggatagcattaggagatatacctaacgtgaatgacaagttaatgggtgcagcacaccaacatggtacatgtatacatatgtaacaaacctgcatgttgtgcacatgtaccctagaacttaaagtataataaaaatatatatatataaataaaataaaataaattaaattaaaataaaaaagaagaaccaaagcaggattatagggccagaacattcagccccactcctcaatctcccaggaagagagaggggctgaaggtgaagttgatcaccaatggtcaacagtttaatcggtcatgtttacataatgaagcctctgtaaaaacccagaagaacaggtttagggagcttctggatagctgaacacgcagaagttcctgaaggatggctcgccctgggagagcatggaagttccatgctctttcccccatacctcaccttatgcatcttttcatcagtatcctttgtaatatttgctgtgataaactggtaaacttaagtatttccctgaattctttgagttgttcaagcaaattgattgaactcaaagaagggaccatggggtccctgatttatagtcagttggaagttccagaggcccagacttgcaactggtgtctgaaagtcaggtgacagtctcatggcattgagccctcaacctgtggaatctgaggctatctccaggtacgtaacatccaaattcttctgaaatgaatcaaaggacatccagctggtgtccgctgctttgtgtgttggggggaaagaaaccccacacatttggtcacagtagtagtctttgctgattgttgttgctggtgtgaaagcagaagaaaaacatgttgagtgtatttttttccttattttatatagcacatgaataatgcatgattgtttaatgattctaatattctcaatgacacagaagacagagagctgtgcaaatgtcacttactatggacacacccacatagccagaactgtacacatttcaggtactaaagaaataagataggaaggtttgccccagtggtacaagataatggtttttagaacatttacaaccagctcattaaaaacccaacagttctcaaggtgacgtccctccacaatagcatcagcatcacttgggaacttattagaaatgcaaattttgaggccccaccccagacctactgaaccagaaactctgggacaagggcccagcaatcaaggcttccatagctgtccaggtgtttcagaaccactgaccaaacccaactatcctcccaatccctgggccttttcctacagaattcctgccaaatggctgcctagcatatgcttgaatatgtccagtgatgggaagttcatcacacattcctcctaagacagtcaactctacaaataacatagttgctctttataccaagtccatctgtttttcatgactttattccttgggatcatataaaacaagtatcatgcaagtggcagtgcttcagatatttggagttagctatttttcattttttcttgtttttcaagaataaagatggcaaatcacatccaccattctacaaacagcattgattcaagtgacctgtgattatttccctccccagaatctacttccttagagtcttagctgtaccactttgattttttgcttttagtaacaccccaccatattctacatgtggggctattcgtactacctggttctagggatgggcaagtgacccaggcacccatagtcctttgacatatgattggttcgggagtggacacaggacacaaaatgagccaatcaaaggcaaggacatccttcagagtaatactgctattagtaacaatgccactttctttcaactgagttgccaaactggtagactatgaacctgaaacagctacgagttttcctaaaaaagagctggcttgatgtgagagccaatactgaggcaaagacagtgaagacacagagacccatacctgatgacactgtctgagcacatggatctaacattgccagaagaagtcatgtaccagaagtttctttcaggataatggaatagaattgacttagcacaggctctacttgatgagctactattatcatgagcccatgaaaggctcttctttttcttttcacttttccaatcattttcctttttgtcctctgtgttcagtcccattccctcccttcccaccacagaaattcactttttcataattaatgtattattcagaatcctctttacatgtttgtgtacatacattttttgtcaaaaatacacagggcccttatacataatttttaaatttgtatataaattgtaggttttaaatcccattcttctgtattctctcaacattgttttagaaatttatccatgttgccataaacaattccttcactgcattccactgtagtattccttgcccattcctctagtgctgtagagctagcttgattacaaccttttaccacaagttacactgtgactaccattcttacacgtttccctggattcctatcttagcatcccattgttgggattcaggtcagatacttacttagattttctaaaatatatgcaccagcttgcacgcccagcagcaatacattaggatttctattttcctacatccttaccagcacttgatagtacttcctgctttccaagtttttaattattgaatggtaaaatggcgtctcttccttttacttcatttgtctctaatagtgtgatgtgtgtgtatatgcatgtttctcttcttatgaattgccaattcatatactttgtcctctttcatattgctttcctcccttcaattttctaattttgtagagtcccttgtatattctaaatattgatcatggtctattaaacacaataattatattttcaccatctattaatttctctatcgttccctccattgaacagaaatcattcattttgatgtattccaagtccatcaattttctttttatagtttgtgctctgcaaatctctccgaacaaatccctctctaccataagtttgcaaatatatatattcctatattttcttctatcgactttatattttcatccttaacatttaggtatttattccacttggaactttgtttatagtatgaaatacagaaacggcttcatttttctttttgtgagccaattttcctagtaccaattcctgggaatgattacagtaagttcccatatatacacaggaataagtctagactcctttctattctgcttcagagccagacgctgtagaacaaaggtcgcacatttttgcacattttttttttctgtaaaggaccagacacagcaggccacacaatgtctgttgcaattactcaactttgtcatggcagcatgaaagcagtatgagtaggcgtggctgtgccccagtaaaactttatttgaataaacaggcagcagcccagatttggtttatagggggagtttgccagctcctgctgtatcttgttaatgtctaaagaaaaacagagatcctctttctgtatttattatcccatataaattttagcctccactctgcccctttcaaaaaaaaattcttagatgttgattagactgaatttaaattgtaagatgggtgaggggaatgtgacatcttcaaaatattcaacgaagccatttatgaatgctgcatttatgctctttaataccataataaaactcttgtaatagagttttaaatttcccttatatgttttatgcattctatcttagatttattcctagatagcttttagtttatgtcactattataaatggtatcttattattgtcatagtttataattagttactcccaatacagcagaaagctattgatttttctacgttcttatagctggcaatctagctgaactcttgcattgcttctaatggtttctgctgattctcttttttgttgttgttttgttttgttttcagacagagtttcgctctgtcacccaggctggagtgcagcggcgcaatctcggctcactgtaagctccgcttcccaggttcaagggattctcctgcctcagcctccagagtagctgggactacaagcgcccgcaccacgcccggcttttttttttttttttttttttttgtatttttagtagagacagggtttcactgtgttagccaggatagtcttgatctcctgacctcatgatccacccatcttggcttctcaaagtgctgggattacaggcatgagccaccgcgcccggacttctctttgtttttatatatatgatttcacttagaaataatgataatcatatctttcatggcaattttcctactttcatgtttctttgtcatactgcattggtcagctatgtggtaatgtattgagaagcagaagtaacacagggatccttttcttgttcctgaccttaagagggctgagtttaaacttctttttttttgtattatgaatgatgtctactctaggtttttaatatgaagcctttaatcaagctaaaaatatcccttctatttcaagttttctaagggttgatacctttttttaaaaaaaattggttttatgaaatgcttttcctatatcactgatgacacaattgcttgttccgtgccattaatgtggcaaactacattagcaaatttaaaaataataattcactattctttccctattatgattaattcaactccgtcacaaggtattattttttaatatactgctagatttgaattcttagccttttgaatgtcataagtgaagttggccaataatttctcaacctatttttttttttttttttttgagacagagtctcactctgttttccaggctggacacagtggcacgatctgggctcactgcaaactccgcctccccggttcaagcgattctcctgcctcagcctcccaagtagctgggattgcaggcacccaccaccacactcagctaagttttgtatttttagtagagacagtgttttaccacattggccaggctggtctcgaactcctaacctcaagtaatccacctgcctcagcctcccaaagtgctgggattacaagcatgagccactgtgctcagccaacttatctagtttttgttatcaagattaaacataatagtttggtttttcttttttgttccaaagagagtttattaaacgagcattttctgtttcatgagcgttaaacaaaactcttttgtcaaactgtgtctttttctcctgtgccagaaaggactaagttttgacaatcattacaatttattgttttctgatttactaaagattttttttttcttgtatcaatttcttagccatatatccttttcacataatactggtaaaaacttatattctttttactggatttaaaaatataatctgtaattatctcttttacctatttcgtattgtgtttatcatggtacatggagatgttttttcttcatctgttattcaaaagtaagatctatcctatgaagttttttaaataatgaacttctggttctttggcttttatgaattatttttactttattaccacatttgtatttatttcctctgatttgttttcctttattgtttctttggatttactatgttgcagtttttctagttacttgagtcaaaccttgggcttataggattccagacttagtgtttttctcttgggtaacaaaagctatatattgccgtgaaagtattccattagctctatctctcacctactgtgcttttattatcactccgctctaaaactttgctattcttgttattatttcctatttaacctgagggttatttcatagtatgtcttttcatatccagatatataggatgtttttgctatctttttgttaacagtgtctgattttatagcactgttgttaagagaacctctaagctgttgattttttagaatttgaggcttcctgactcattgaaagttgaagcttgtgtctaatccacatgccctctgaaataaagtatgctctgcttttgttgaataagttctatatacatgagacatcaaattgttatccaaatctctctttgtctcattgcttcattggtttctgagaggactgttttaaatttctaactatatttgctaaatcaatgtctaacgccataaattattgttttctgtacctcaaagctacattactacatgtggatatgttcctattcatttcactcccttggtcttcttattcctttttcttctttgtatttgacaagtataaatttttccatcaccttacattagcgtgtgttctcttgaatttttttttaataaaatactatagcatcttgttttctatccattaaagaatctgctggataagtttaatcactacacatttacactaattattctttgagcttatttcagatattttatcttttcgtttgtttcacttcactttttctcctgtctaccttccacgggttaagtctggtttttctctccccatgagtatgaaaattacacattctatttttatttcagtagtggttattcgtgttcttatcctatccatactaatgcttagtgtttaaaagcagatcaggatctttatccttagtatattcctacctcctttcatctcttccagatatcatatcccatcttcgtcatgtcctaacttttatgctgaattgatattgttataatttcaaataatgctttatatgcttttttacccaccatccctctctccccacttactctactgattgtattttcatttgtcttgtttacaaagatgtaaggacattcccttctcacaggcagctgtgggctccagcaccacctgcttcttttgaatcttactttccctttctggcctttagtcctcccttttcctcaaaactaggctacacttttgagtggataaagagtctcagctctgccactctcttcctgatcttccagaattcactgaaccttctaatcctcagacatctcatttgaaaatagtagataatgaagtatacaaagcatgtctcgttgtctgccacatgatgtaggtacccttaaatactaatagttttctctctttccctacccaaatctaagtctacctcttttttaattgtggtaaaaatcctccccatatatgctgctagtacacctatttcttcaagttttaatttcaatgaagaagaaaaatattctaggaactctaaaagggacaaaagcattaaaaagattaagagtcaatagagtttgatgggaaaatttgtgcatctccaggatctgaaactgtctccaagactgagataaatattaaatactttcctttcacataaaaatggcagaaagcaattttattttcagataagtaaaattgctgaatctttctaccaaatataaagactagatgtaccaatattctgtggaattttccagggaaaatcatcttcagggaactgcttcttagcaaatatggagatggtggtttctgtaagccagagaagcaaatactggattaggaacctcagtccaaggtttagacccttagacttgtagtgagcattagccaagaaggaaatacaaggaacttggtttactctagaaatggtaattgaaccctactctctctttataaacaaacagaagtagatacataaatgaaaaaaaaggtctcacatttctagccgattactttcttctttatttttttggtgaaaacttcttttatttgggactaaaaatatatgatttcaacattcttaaatgagtctccatttcccacttttcagccataaaaggtagcctcttgctacctctctcttatgacatatttgtaccctctctacctcctataaactacctttacatctgcatctcctacaattctcgccagctggtagcataacacttttagagctttatctttaaaatttaataaacataaaagaaacaatgaaaagatctctactatccttttgtgtgtgactcagtggatgtgttcagtcatttttttgacagggctagataggcaacctaacttgtagtagagtaaggttcagtgacacaaaagcaaatgcaggccccaaactgggaaatctccaagctgtgaacaggaactgacaatagctcacttcagggtagggcagattctttttccggatttgctttcaaatgttatgttaacatccaactaaagtaacgaaatctcttttggtattgccaaaagagattcacatttgagtcagtgggctggggaaggaagatccacccttaatctggtgggcacaatctaatcagctggcagtggatataaagcaggcagaaaaaaaggagcacgagagagagagagcgagagagagagagagagagagacactcttcatagagaatattattcaaggatttcttaaacttgggaatataagacttcagggccctgatttgggaaatactgaattaataacaactctgtcactttaggcaatccctttgcactaaagccacatagcagtactctgttatcagacaacaagcagctgatttaaaatataagcctatatctgtcattttcatattatttcatcaaatagagaacaataaatacaaactttttgagagcatgagggccttcaaaacccactggccgaagtttaagaaactcaggccttcagcaaatgcacctaagaaaccaagctcatgaagatgtgaaattctaatcaacagattacctgaaaacatttccatcccatttcatgatttctctctcttttctgtagcaaatgatgtttttggaagaaaaagagcgcatatttcccttgcctggctactcaaaatgtggtcctctaagtagcaacaacagcatcacttgagagttgtaagaaatgtagattcccaggccccagcctagatgtaatgcataaacctgtattttaacaagatccccagctaggctgtttgtacattaacgtttgaaaagcacatctcagagcactagttttaaaactaggtctattaagatcaacttgagaactttctcaaaaaacaaattcctatacttcatcatactcttgactccaacaatctctgcaacaatgtagctaacccatcacggggatttgacaaacatggcttccgattgtatcttctttccaattcattttatgaactcaggcaagttccttagcttctttaaatttgagaaatgagtatgacaacagtaccttcttctcaaggacacacataaagcacttaaatatttgataagtgctagtcacaatattggtgtattttgccttgacaaaagtaatgcctaattttattcaataaacaattgttaattgtcaactcatacataagctaatattgttaagttgcttcgtataatgcttatcacaaaaatggtatgtaatggttacataaatacaaataaaatcatgtatttgacaccatactgccattaggtgactactatctctccatattagaggtagagcagtgtcaaaaactaccatctgattaaataatagaaataacagctaagtacttactcggtactttcatctttctaagcaatttatatgatatgttacttaatcctgacaaccctatgaggaaggtccttcatacaccaacatatcaacatttatgcatctctttgattacttctcatgcattaattcctagatttgagaatcactgtgttcaaagtatattgaactattaaggctacgggtatgaactactaaatagctctcaagaaatgtagccaatagttgatatccaacggttgtatagaaaaaagtcccatttccccaaaactttgttaatgccaggcattctctaattctccaaattgctaataaaaatttgtcatgacttaggaatacaacataaagggaaataacttcttctaaatgtcctagataaaacaatctaccatgaaaattaatgtctcctaggcaaccaggaagtcagacacaatgaaaaagaaacactgttctcttcgttaaaagaataaaactgtgtttccttttaactagaaaaataaagttgttatttcattatggccaggaatattaaggttcactgtaaaaaataatctgctatttttataccctggcattactcagtgaatggcaaaaatctagaccaatcctagaaggcacgaatgtctttgggggatgtcagaaaaagccttaactccagacacttctaccaactggagagtaggtttctatttcaattaacttaaacactaggggctcaattgttaaccaagaatgtaaatgagcttattaaaagctgctggctaatggatcccaagatgaaccttgagaggaacaatgccctgtcatctaactgaggaacaacacaatctgatctggccccgctctgaaacatactttattgatgacttggaaaacaaggcacataaatgaatggttggagacatatattgaagtttatatgatttgtaaaacattctaatctacaggcgtatgtcaaaattccacaggagacagtagaagaggatcctagaagaagataacaaagtgaacaaagagaaagagaagacaacttgaagtgtcccagaatttaagcaaacaagaatacctgtaacatttttatacaaagagaattttttagtgaagtatattaagtcatcaacttatgtcactaaaaaaattttcaattgttaacaagtcaaagaaaatccaaaacctcagctatttataaacagaaaacacctaggtatttcaaaatgccaactgccttttcaagatctcacttcatcagttacctcttctctgttctgtcattttttttttttttgtaaacctacttgttttacatatttaacctcattctcaccagtttcttccctgtctcctaaaaagatgttcagggattacatatacttaataacctttcctcatcaaactctaatcacctattcatttaataaatatgtattatatacttgccatattccaaatactattctagtggtaaatatgacagaccagccctctgctctcatgtagtattctaggcacagggtgcatattgcaagcagtagagactacaagccagtcaacaaggaaaaatattctgattgtgacttgaaggaaatgatcaaaatccaagaacaggaagggacttggaggaggcagaagtggctgcctaagtgtcaaaggaaaggggaatctcacgtttgatctgcgagttgaatgataagaagtccactgtatgtgactatatggggataaaatgttccagatggaggaaacagcaattgccaaggcaagaatgatctcaagatcttagaggaatggaaagaagagtgtggggtggagcctaacagcaggcagcaaggcagaggtgaggagatgggtttgaaagatgagcagggatcagatcatacaaggtcttgtgtggcgtttcacttaatgagaaactcgtgataacaaagattcaagctccagagtgttcagggtctaaatttgactttcaaaaaaagattttactattgtacattaaaaatcatctcaggacgcctggtgtggtggctaatacctctcatttgggagaccaaagcagaaggatcccttaagaacaggacttcaagaccagcctgggaaatatagtgagaaagaaagaaagaaagaaagagagaaacagagagagggtaggggagaggggaggggagacgggagggggagggggaagaggtgagacgggagggggggaggggaggggagacgggaggggggaggaggggggaggaggggaggagagaggagaggagaggaagaaattagctgggtgtggtggcatgcacctatagtcccagctactccagagaccatggcacgaaatgcctgagcctgggaagttgatgctgcagtgagctgtgatcatgcccctgcactctagcctgggtgacatagtgagatcctgtctataaaaataaacctcaggagcttaaaaaaaagcatatgccccattcccagattatttttctgttaagacttttgaaaagtgacatacaattcatataccataaaattcacccttctagtgtacagtttgatggttttcagtatgtgtgcaaaattgtacaattatcataactacctaattcagaacatttttacccccaaaagagaaaccatttcctttagcagtcatttcacattttcctctagcccacagcccctggcaactactattctactttctgtctctgtggatttgccttttctggacattctatagaaatggagtcatacgatatatagccttttatgtgtagcttatttcacttagcatgtgttcaagattcatccacattttaccatgtattcatcctttattccttttaaaggctgaataataccccattgtatgtatacaccacatgtttttctccattcatcagttgatggacatttgttactacatttttggacgtttgtgaatagtgctgtgaatattcaggtgcaagttttgtgtggacttatgttttcaattattgaacgtacacctaagagtgaaactgctggatcatgtgggaactctgtatttaacattttaaggaactgccaagctgttttccttagtggctgtaccattttacattaccaccaccaatgaaagagggttccaagtcctccacattcctcaccaacaccccactcccagatattttaaattaattggtctggctgagacctagatatcaggcttttttttggtttttattttgaaagttcctatggtgattctattcctaacgtatagtgaaggccaagaagcccttactccagcctgttcattgccaacttggtaagtatttatacctactccctcttcctgataagtattcatacctactccctcttctgctccagagctctttagacatgttacttggtgcccccagcactctcaatgacatctgctttgtagctgactcatccagtgagagaaggaaagataattaaggaagatacagtcttatacttttaacagtctcatttatttctgagtggggccagtgtctgtgtgaaatcttcatggttatctgcatgtctggatgggttttctccaggcactctggtttcctccctcattccaaaggtgcatgtgagattaagaggcatgtctacatggtcccggtctgagtgagaaggtatgtagagtgagtcctgagagggaatggcgccctgtccagggtgggctcctcccttgggccctgagctgccaagacaggctctggccacctgagaccctgaactgcaatgaatgggtaaataattatcttgcttttattaatctttcttataatatgtagacatcatctttatttctgtatttaatattaacaatattttggtttttatttagaagtttggtgatgtttttgtgaggagaaatatgccacaggaattttttttttaatcagttagcctatggtcaaattggtttcattatacattgttttggttaaagttgtagtttctaagaaacctacctatgactcaagtgaggacttgtgtttttacgtaatgtgaatcagcaacccccttcttccactgattgatccgacggagaccttttatgcaaaaagaggtcactgctttaaaatatatatatatatatattttatatttattttatatataaaaattatatatatttaaaaaaatatatatatatatatatagagagagagagagggagagagagagagagagagagagaggctcctgaagttcttctcatctagtcaagaaagatatagggtgtaaatggatacttctatgttttatgcttcaacctgaccttgagtattaaacatggtatcatatttacaaaaatgtataacatttagaactacttttgtcactttataaaatgattcttccaaaccaaacacaggtgatgaatatctaaaacaccagcatcaaggcctagagctttgtgtttgtacaaaatatcagggaaaagccaagcacagtggctcacacctgtaatcccagcactttaggaggcctaggagggcagatcacttgaggtcaggagtttgagaccagcctggccaacactgcaaaaccctgtctctactaaaaatacagaaaattagctgggcatggtggtgggcacctgtaatcccagctacttgggaggctgaggcaggagaatcgcttgaacccagtgggcagaggttgcagtgagccaagattgtgctgcgccactgcactccagcctgggtaacaaagcaagacttcatctcaaaaaaagaaaaaaaacgtatcagggaaagacagaaacctgaataaaaaggaaacagatttctacactgaaggacaaagtatggcatgacttctcagtctgatggaggccgagattcgtttttttcattctgagattcatcttaacggttaaaaaaaaaaaaagaacaaacaaaacgaaacccaaatcatgtttttcatgtggactgtaatagcagagacgaacttacatgtttaaatacaaaaacaatccttaaagaggagaatcagaagttgaaaatcaccttactgttatgtatctttctggagtaatcaaaatttctactatattatagtctctataccatcaaaaaatccacagatatcacagatattcatctccatggactgtatgaagacattgtggacatattgggacatcaactcagaaataatgtcaaaagcttgtatggtaaatctgaatcaactgtgatctttcagaagcaggagcttccaaaggggttcctgtagcatccctttatcagagcaaggccagtcagaggttaagaaacattgggtcttttactttaacacttctcacatattattttaaaaataaataccaaaagaaataccaaaggaaaaaccacataaattatattttgaacatttacattgaacaaattaaagttcccaacataagtgaatacaacataataattactattctgcatatgagagaaattattccaccattttttgactcctgaattgttggcaatattcatggcaaagcaatgctgctcataggtttttgctaaaacggagtataaggctaattacagtgtcaattatagctatgtatcatttgtactctatagacttactcctattttaagtggtctaccatattcttctaatatctaacggtgttattcacaagataactacatgactgatacattttttacgtaacagtgtactacaggtggtacaaccttgtaagagaacaagtttagaagtatataatgcacatcttccttcaatcctgtttattagcatatggaaaacacatttgaagataaccagatataaattcaaggccttgaatccaaagccgtcccaaactactgattccctgtgttcttccaggccctcagaagatgtcggttaaaggaaatcataaaaagtcaaactatagcctctgtgttatgtccccactaaagccagtatggccagactttactgtagctgagaggttcttgctcatggagtcttgaaatagagcttcccaacttcagcagagatgcctattatacaacattaaataaaagacgaatttaaatgaatcaagtcttgactcttcttccaccatcatgggttttacagaacagcattatccagggctccattcaaggtaattttgctttttcattgcttgacaaatgctttcccatttccctgcaccctagacaaattggtatttctcagcagctcttagaatgacaatggcagttttctcttcatcgttttttcatttcttcatcctctcgccatgagaggcactcatcaggggatctctaatcctacccatctcattacctcttcactctatttgtcaccatttggaatttcagaactcttaattattagcttactgttaccaacagtaatgaggctctggctgcctactggggagcatcatccaacactaacaagctagcagactgagaccggcacctgaattccatcacgtggttccattgttcaggccaggtgggacatttctgtctgcaggcaagctttctgcaggagagctggagtttgcagggtggctattatccattcactttggtcttatgattcacactgactcaaaacagctttcctgtgtggtcatgctcatttacatactggctattgccttccttataataacacttaatgtttatttctgccttgtcctccttttcacttgtataaggacttcctggagctaagagttctcaaagggaacactaattggtcattttcttatagctacttttgatctcctcctgacctggaatgaacagtgagtctctcacagccatctgggtgatccgtctatatacagaccttccttgacactcccgcagtagtcagcatactgcctcaacacaaaagaggctagacaaatgttaagtgacatctataaagttttctgagcaccaaagacagacccagatgcagaggagacagaaaggtaaaggattaagaaggagctggtccctctgaaactatgacaaacatgtctttatatagttaacgagggaagatgcaactgatccaaaatccatctcttccttggcttcatatcctttcacagcaacaagagccttgcaccaatgaggacaaatgagcattggttgaatacttctaaatgcccagcctacattaggcacttgacctgcatttgctcatttaaaccccaatagcctgtacagtagacctggaggaaaacaaaacccacagaagtcaagcaacttgatcaaggtcacccattagtgaaaaccccaaagctcttctcagtacaagtggtcacccaacaccgctcagaaaacggttaggcaaaatgagggcctggggtgggttttggaatagcaacaccctgaaggtaatagaggctggtggtagagaagaggagcagtggcatcacctaggtgtgtaacgctgcctttgtcccctgtagctgctgccttctatccaaggtgaccaccgtgttgaacactgtctaggaaatactgtgctcagggcaaaggatgctctctttttttcacatttttatacagctaagagaagtcatttctgaaaacaggacttggaggtcaacgtttacatatgatgccaccaaggacatctcctgatgatacccatgaaggagagaccattccgttagaaaacttgtgcagtaacatttaaaattggcatttgttaaccatactaataagagctaatattcctgtagcccttgctatataccagacattatgctataaatgctttatgtaaatatctcacttactcctctccaaagcctctgaggtatttttatcaccctaattttacaaaagaaaacactaagagtttaagtcccttgcccaagtacacacggaagcaagtgatggagccgagatttgtacccaggtatgtgacactggtctcctccccacctccaacagtgctaagaaagatcttctgcccacattgcattatgtgctgtacttttttcatgtaaatgatcattccaaatgtctacatcctggtgggtgagcggaggaggtgacaggaagaacaaaaaaaaaaatagacatgatgtcaagaaaggaattaattttcaagtgcacaatcactgctacccacagagtctgtctgtttggttttccataggtataaagagattactcagagtccataaggtggccatgccaggtctctcggggtcaagcagacaggccaagggtgtacccaggctctccttagctctctacatggctctgcctcatctgcttgcttggttcacccatgacatcagagaaacaaagttgggagcaatgctacttcaagcatatgccagttactaagggtaatttatggcaactctcattgccacgtgggctgagaagcacaacataataattaaaagactgataagcaatcactaatgaaatgcataggtattgttgaaaaatgcattttgagtccaagtaaaacaatgatgtgtgttctcccagtgcagaatctctgagctctgtaatcttaaaggcttttgcttttaaaatactatttcaaatgccagctattagtaacccatacatttgcaccctggtttcattgcaaaaatgaggaaggaccattgctttccaaaagaggcaacaaatagaattttttaaaaaacgcttctcttggaaaattttgatccgtttcaagtgatcttgtttagaagacccctacgccaagagtcctgccgggacagagttgtgttggcatcacttgactgctacctgtgtcgtctttgcctttgtgtatcgcaaagcctgttagaaacagctcatggaagcggggctcagaagacagaggtgtgtgctagaccctgccctacctttgttctctaacagggaagcataatgtcaaccaatctctagtcatctccctgacccatgtccctgactggcatacacacagggccacatgaaaccattccatggctcaggccagggtttcaagcatcaattacccttagtaacagcacatgcctgaagtagggttgctcccaacttaaatatttctctgatgtcatgggtgaaccaagccaagcagatgaggcagagtcatatagggagctcaggagagtttgagtatgccattggcctgtccacttgacccctgagtctaatgactcagcatggtctttggagttctaggatggcattatttacttctcctcttgcacagtccagaaagaacatttttccccactaaatgcacattcccaggagctccgacctccagtcaaaaaagtaaaagttgcttggtaagctcactgcctggggtcttctataccaggaagggcccaggcctagcactcatgttgtggcatcttcctcctgcactgtaggcagatgtcgctaattaactatgacatgttctcctgcagggcattaacagaatcttttagataccattaccaatcaatcagagttgctgcataacatggaaaacctattgctcatttcacttttcggctttagactaatgacccagggaaacttttcatggcagccctgagatggttcgatccatttcaagctaaggatgtgataatacgtgtatcttccagaatcttgactctttcaattaggagcatgaataacaaacttctagcattgaaataacatattctacggtaatcctctgactgatcaccttgttaataaatatctaaagaccgcatttttctctgagcttccaacttccatgggaacattctgattgtgatataatttttaaattagcgggtttattcatagatttgtgttagtaaatggcaagcttcttactaattagcaaattgtgtaaatccacagcagtattaattttcaactgtatggggaattaatataagacaaaataaataaggagacaattaaaatttccctagaggcatgcatttctataaaattcagcacaaaacaagaaaacattaacccattttgagggtgcatttagaaaagatcacaaaagatgtgtcagtgtcacagagaacaagtgaagcatgcatttgctgtggcacgcactctcagttacagctaaattccctaaagatattttctcaagttactgctgctgagatgtcccctcttgccttgatgcacttttccagcactttctcatttaataaggtttttattatttctttattgatgtttccactcaaattgctggtgtgctctctctcactttagaggacaatgcacagtataatgttctgatcctcaaaaactgccccacaagaggtctctcactaaccaagcgcttgctaatatccatttcacttttcccactaacccactgagaagatggaaagcatatgtatctctgggctcctgtttaacctcccagctctagaagatgagaaaaagcatgtccctcttacgggcacttacaccatttcttatgaagccatcccacacactgttaaacaaatctgattgtttctcaaactcccctttaactgcttcagcttattgctaagatgttggagtcttcctgtgttggtggccatggaaaccacctgtctatttaatggcatgaggtcttttctttacttttcctggcatgccaggctgttggggaaaggccagagccctaagtttaaacaagtcaagtacagatgtttaagaatgacagctcccaacagcttcagatcatagctaataccaaaattaaactgtaacatggtatgctctgatggggaaactgtgcacagtttctaagtacacaaacaagacagtacacagacaattgtaggttccatttgggggcaattttcttcccttatcatggctatcagtgatacaatctgctgcagaagaatgtggtgttaactaattagtataccatatagaagtgcctgtcttgtattatttacagtgcctgggacacactcctagtacagggcttctcataggcacagtaattatgcatttgcctctctgtcttacatattagataatgatctccttaagggctgggaatacggtcagagattgggattgcctatcagccccctcccaagcagacctaagcagccaggtggtaggcaagaacagcttcatgaatggctactaggcagttcccagtagtgcctggaaattctgtaagtaaattttaaacggcttggttcaggccaaaaccaaaatggatcttcctgttccctcaccccaggtctgcagtgacatactatcctgatctcctctttctgtttgaggttgaaaatggaaatgggaagaaccaggcaggccttatctggcctgcttgccatatggagactgatgggcagactgttcacaaccacaagcaggtaccacagaaagaggacagaatagagccggtcctttacttttaggtgagttttcctccactggcatgttgtcaccaggcaaggcagttgccatttctactgatgtaaggagacacacacacacacacacacacacacacacacacacacacacagagagagagagagtgtgtgtgtgtgtgtcaaggagaggtggggaggaagtgagtaggaagggacacagagccagggactaaagagaaaagtcccttcctgtgaaaagaataagataatattttcatttaccatccccatatacacagcagtgagcaaagtgccaggcaaataattgatacccaacaaacatcagctgaatgaacaaatggattcattcattgcacttttccatgtctctatctctagtatttaagatttttttaatgtatcttagaagagcctactgttgtacaccaaaccaaaccaaaacagcagaatgtcctaaagtactgacatatgtgtagaaattacacatcaaattaccaatcagatagacgctaaggtaggactgaaatgtgggccaaacccattttggaaacaaagaacaaagtcaatactcaaggtcaagctcttagacagctattcttccaaagcacctggaccccaagacacactcaacaaatttcaggtcatttcttctctcattaagccagttacaaccaagttatagaagtggagtccttacaagtcgctattgatagaataagagctagtcaaagaatgtttgagccatttttttcccagcctcagatgatggggagaaaaaaaaaacacctcaatcaaggatgtcaaaatgaaccaatctgcaatagtcatctgggcaggggacaggtgaatagcccaattcttctcacagaaatgaagaaaaagttcaggccattatccaggatgacttgaaaaggcaactcagtgactgagctttgtagttctgacaccattcaaatagaaatgggagccagagatagaaggactgacggctcattctcaggaatgtctgtgactatgcttagatgtgtcagtagacaacagcttcctaccaaatggtacaggctttggcagcctcttttttaaaaggccttttagtaactagtcaggcaccattcttaatatcaaaacattctctcttttttattgcccagactctgggaatctggaaaatgaaagaaaagaaaaaaaaagaaaagagagagaaagagagaaagaaaaagagaaagagagaaacagagagagagagagagaaagataattctgactcttcctaggtaaagttatgctttccagttaacttgatccactagttattacccgaaaacatgctttccctatgtttgagttctcattcatttattcaacatctactatgtgccagaccctgtgttagatgctagggatacaacggttaatgagaaaaagaaaatgtcttatcatggagctcattatttatctgtcttataattaatctatattactttatttaacaactacatacattaaacactgcccttttatggttacggaaagacagcagtgaacaaaacagacagtctctattctctgatccagggggaaaagactaaatgagttagtaacattttcagatagttaggagagctggaaaaacatacattgggataatgccattgagagtgagtgatggagtggcagcaggactgttgtttgagataaattggccaggtggcgtctccaagaagaaaagtctcacttgagactggtaaatgaagccagcaatccaggaagggtgtttgtcagggtggccagcttttccccactcctaggttttaagaggagtctgacactgactattattaggaaaataagttagttggcctacttggagggtataataccagccagcaccttaatattcaatgtgtggtctggggaataccagcatcagcatcacccaagagcttgttaggaatgcaaattctcagctccactccagatgtaattgatcaaaatctgcacttgacctgacccctaggtaattcatatgtgtattaagactttgagaagccctggagctagccaccttgagtaagacctaaagtcatgtccaccaagcctggcctctatcagtcattcctttgtttattttggaattcatttgagaaatttgaggacccaggcatagacaagggctgctatttattggaggtcctcaagatcctctaaataaagggaagaacaagtacaaagccctgatatgggccaggctgaattatgagtgaaatcaacagaaataaacgcaagccatttaaattttatccctataaaatggctagcctttggaagtttttaggcaagggagaagtaatatgttctacgtgaaactttggagcagtgactctgggtgctgcagagagagtggacaatagccaagcaagcatggagaaaccacacagttaagaagctacaaaggcgagcccgatgggaagcggtagggacttgagttggtgaggcagcagtgcacttattctggatatgtcttgggagaagagctaataatacttactgatgaatagaaatgtggggcagcagttaggaaagaggatggtcaaagaaccagtcagtgcaggcatacttcatttcactgcattttgctttactgtgcttctcagatattgcatttttagaccaactaataaccctacaatcgccttttaagtgttcaagtgaaaggaagtgtcacacatctctcactttaaatcaaaaagtagaaacgataaagcttagtaaagaaggcatgccagaagccaaagacaggccaaaagctaggcctcttgggccaaacagccacgctgtgaatgcaaaggacaagttattgaaggaaattaaaagtgctactccagtgaacacacaaacagtaagaaagtaaaacacttattgctgatagggagagtttgagtggtctggatagaagatcaaacaagccacaacattcccttaagccaaagcctaatccagagcaaggtcctaactctctccaattgtatgaagtctgagagaggtgaggaagctacagaaaacaagtctgaagctagcagagattggtcatgaggttcaaggaaagaagccatttccataatataaaatgtcgaggtgaagcagcaagtgctaatacagaagctgcagcaagttttccagaagagctggcaaagataatcaatgaagttgaccatattaaacaatagattttcgatagtgacaaaacagccttctattggaaggcgatgccatcaaggactgtcctagctagagaggagaagttagtgcctggcttcaaagcttcaatgaacaaactgaatctcttgttaggggctactgcagatggtgactttaagttgaagtcagtggtccttgagcattctgaaaatcctggatcccttaagaatgatactacatcaactctgcctgtgctctgtaaatggaacaacaaagccgggatgacagcacatctgtctgttgcatgatttactgaattttttaagccccctcttgagacctactgctcaggaaaaaacattcttttccaaatattactgcttactgatgatgtacctggtcacccaagggctctgatagagatgtacaaggagatgaatgttgttttcacacttgctaatacaatatctattctgcagcccacagatcaaggaggaattctgactttcaagtcttattaattaaatacattttgtaaggctataactgtcatggacagtgactcctctgatggatctgggcaaagtaaattgaaaacctggaaaggattcaccattctagaagccattaagaacattcataatgcatgggaggtcaacatgaacatagtttagaagaagttgattccagccctcatggatgactttgaggggttcaagacatcagtggtgaaaaaagcaggaaaactagaattagaagtaaagcctgaagacgtgactgtattgctgtaatctcatgatcaaacttgaacagatgagaaattgctttttatgggtgagcaaagaaagtgatttcttgagatgaaatcaactcctagtgaagatgatgtgaacattgtcgaaatgacaacaaagaatttggaccattataccaacttggttgataaaacaacagcactgtcaaagacgattaactctaattttaaaataagttctactatgagtaaaatgctattaaatagcattacattctacagagaaacctttcattaaaggaagaatcaatcagtatggcaaacttcatttttattgtaagaaatcgccacaaccacccaactttcagcaaccaccaccatgatcagtcagcagccatcaacattgaggcaagaccttcccatttttattgttcacattttttagcaataaagtatttttaattaaggtatgtacactttttaggaataatgatattgcatacttaatagactacagctaagtgtaaatatagcttgtatatgcattgggaaactaaaattcacatgactgatttattgcgatagtcactttttcacagtggtgtgtatctgaacccataatatctttgaggtatggctgtacccctacgaggcatggaggtgggcatactacccatgctgcccccaagcactatggctgaccccttgctgggctgatcccaaatacaaaatacaagaattcataaacaatacaacactttccgttaatggagaatgctataacacctagttcccacttctattcttcaccgttggattctaatagatgcctgttattcctttaaaaatatgagagcaatggatttcatttacaaaaaagggaaattagttacacaacaaaatgaatactcagaaaaatatttcaagcaaatagataaaagaccacttttaaaaatctgaatatccaagataacttgctctcgtaaaagtttgtgattggcaataagagacagattgaaaactgctagacttttcaaaaaaccagctcctggattcactgattttttgaagggttttttgtgtctctatttccttcagttccgctctgatcttagttatttcttgccttctgctagcttttgaatgtgtttgctcttgcttctctagttcttttaattgtgatgttagggtgtcaattttagatctttcctgctttctcttatgggcatttagtgctataaatttccctctacacactgctttgaatgtgtcccagagattctggtatgttgtgtctttgttctcattggtttcaaagaacatctttatttctgccttcatttttttatgtacccagtagtcattcaggagcacgttgttcagtttccatgtagttgagtggttttgagtgagtttcttaatcctgaattctagtttgattgccctgtggtctgagagtttgttttaatttctgttcttttacatttgctgaggagtgctttacttccaactaagtggtcaattttggaatcagtgcggtgcggtgctgagaagaatgtatattctgttgatttggggttgagagttctgtagatgatcaagtgggtttcatccctgggatgcaaggctggttcaacatacgcaaatcaataaacgtaatccagcatataaacagaaccaacgacaaaaaccacatgattatctcaatagatgcagaaaaggcctttgacaaaattcaacaacgcttcatgctaaaaactctcaataaatgaggtattgatgagacgtatctcaaaataataagagctatctatgaccaaccaacagccaatattatactgaatgggcaaaaactggaagcattccctttgaaaactggcacaagacagggatgccctctctcaccactcctattcaacatagtgttggaagctctggccagggcaatcaggcaggagaaggaaataaagggcattcagttaagaaaagaggaagtcaaattgtccctgtttgcagatgacatgattgtatatctagaaaaccccattgtctcagcccaaaatctccttaagctgataggcaacttcagcaaagtctcaagatacaaaatcaatgtgcaaaaatcacaagcattcttatacaccaacaacagacaaacagagagccaaatcatgagtgaactcccattcacaattgcttcaaagagaagaaaatacctaggaatccaacttacaagggatgtgaaggacctcttcaaggagaactacaaaccactgctcaaagaaataaaagaggatacaaacaaatggaagaacattccatgctcatgggtaggaagaatcaatatcgtgaaaatggccatactgcccaaggtaatttatagattcaatgtcatccccatcaagctaccaatgactttcttcacagaattggaaaaaactactttaaagttcttatggaaccaaaaaagagcccacactgccaagtcaatcctaagccaaaagaacaaagctggaggcatcacgctacctgacttcgaactatactacaaggctacagtaaccaaaacagcatggtactggtaccaaaacagagatatagatcaatggaacagaacagagccctcagaaataatgccacatatctacaaccatctgatctttgacaaacctgacaaaagaaacggggaaaggattctctatttaataaatggtgctgggaaaactggttagccatatatagaaagctgaaactggatcccttccttacaccttatacaaaaattaattcaagatggattaaagacttaaatgttagacctaaaaccataaaaaccctagaagaaaacctaggcaataccattcaggacataagtatgggcaaggacttcatgtccaaaacactaaaagcaatggcaacaaaagccaaaattgacaaatgggatctaattaaactaaagagcttctgcacagcaaaagaaactaccatcagagtgaacaggccacctacagaatgggagaaaatttttgcagtctacccatctgacaaagggctaatatccagaatctacaatgaactcaaacaaatctacaagaaaaaaacaaacagtcccagcaaaaagtgggtgaaggatatgaacagacacttctcaaaagaagacatttatgcagccaaaagacacgtgaaaaaaacgctcatcatcactggccatcagagaaatgcaaaacaaatccgcaatgagataccatctctcaccagttagaatggcaatcattaaaaagtcaggaaacaacaggtgctggagaggatgtggagaaataggaacactttacagtgttggtgggactgtaaactagttcaaccattgtggaagtcagtgtggcaattcctcagggatcttgaactagaaatgccatttggcccagcaatcccattactgagtatatacccaaaggattataaatcatgctgctataaagacacatgcacacacatgtttattgcggcactactcacaatagcaaagacttggaactgacccacatgtccaacaatgatagactggattaacaaaatgtggcacacatacaccatggaatactatgcagccataaaaaatgatgagttcatatcctttatagggacatggatgaagctggaaaccatcattctcagcaaactatcacaaggacaaaaaaccaaataccgcgtgttctcactcataggtgggaattgaacaatgagaacacatggacacaggaaggggaacatcacacaccagggcctgttgtggggtggagggaggggggagggatagcattaggagatatacctaatgttaaatcacgagttgatgggtgcagcacaccaacatggcacatgtatacatatgtaactaacctgtacattctgcacatgtaccctgaaacttaaagtataataaaaattaaaaaaaaagaaaagaaaacttctagacttcccaacactttgagaaacagttgccacctaactactaaagcaaaatgaactaaacctaccactggaactcaacctttaggcattttaaaaggccatttttaatgaattccctttcagctcttagtcaagctcatctttttgaattcgatctttatttttaacaggagcacatacttaaagaggtagaaggtatgaagaggtcagcagtgatcatctttacttataagagacaaagcattcctcttggaaaagtcaccataccattttggggacttaaactttgaatattttttcaagaaaacacatttatgacaattcattatgctagagattctttttttttttttcctttcaaaaatattttccattttatgtcttctaaggctgatgaaaacaggccttccaactctgggcttgccttattgcctgtctgtggctgaaacccaaacattttcctattacagtttaagtgtttttatgtatgttttatacccaaattcagtaaaggtttgacatagaccaaggtaacatttcaggcagtatctttaaaatagaaatctattttcagattccaggatgtagaacagttggttttgaatttataactttgataccagcattttcctctttaattgtacttctaaggatacctcctggccaccaaaggacactggcgtggtttatttcagtactgtgataaagtgattgagaactgagattttattcccaaagaggctaactcctttatcttattctaaagccaattattttgcaaattagatccactgcttacatagtatgacatgtgaatagatgtaaggaaatccatcactactactccaagcatatgcctactgagtaatgagttagcaggatcaccttcatgtttgaagacaccaggacgatatagtagaggagaacgtaagctctagtgtcagaacgcctgggttcttattccatctggctagctaggagactttgggcaagtccctcccctacatctcagtttccccatttatactcaatggcagtacttcccaaattagtcacctcatatttagagatatttatttattaatactatatatatatatatatatatatatatatattttttttttttttagacagagttttgctattgtcacccaggctggagtgcaacggcacaatctcggctcactgcaaccttcgcctcacaggttcaagtgattctcctgcctcatatatagctgctttattgagatgtaattcacatatcatacaattcacccattgatgtaattcacccaaatgatacaattcaatggtttttaatctatttacccagtggtacaatcattactacaatcaattctagaatgttttcatcactgcctagggatctttaaaaattccaaagcccagactatgccacaaatcaattatatcacagtctatggcggtgggacacagacatcagtagtttgcgaagctccccaggtaattccattgcacagatatgtttgggaagccatgctgcactggaatcactgtcagagtttcagggaaaataaacacagaaataaagaaagaggagatgttcagcagagagactgtcctatgataacataagcacagaagtggtggtgagaataatcatactgaggacgaatttaatgggaaagactatttaaagaattacactgcaacttttataatcgggactaaaatagcaatttttttactcgttggtaatacatctccaggcacagcatcctctgagagtatgtataagttgggaataagagtgttgaggtaggaaagggatcaggaggagataagaacctgtaacttatctaacacatttcaagacattaccaagcttcttggccttctaaaaagctcctggttagccttacaggatgccactgaagtgccacccctttgtgaaatcttttcccactgaagtcacagtttgatgcttcttaaagctctgcgtttggcataatacagcaattatcacccagagtcatatacttcagaagttggtcaccttcaccagggcaagagttctttgaaggcagaaacaatacttagtacattaaaaaattaaaaaaaaaaaaaaaaaactatctcaagagcctagcgcatgttatggcacagtgttgacaaatatttgttggactgaaccaaagcaaattcacatccactactgtcaacacaaaaatgaaaaaaaaatagtgcactagttccaaagttcccagaacacttaggggccattgtagctctcagaagactggcaagcaagacctgcaattttactctataagggacattgtaagagcaaagcttggggtacttaataactccactaaataaatggcacaaccacaagctgttattaggaacactgaatagaggctgggcacagtggctctcacctgtaatcccagcactttgggaggccgaggcaggtagatcacatgaggtcaggtgttcgagaccagcctggccaacacggtgacatcccatctccccgtctctactaaaaatacaaaaattagccaggcttggtgatgtgcgcctgtaatcccagctactcgggagactgaggcaggagaatcacttgaacctggtaagcagaggtggcagtgagctgagattgcatcactgcactccagcctgggcaacagggcaagactccatcgcaaaaaaaaaaaaaaaaaaaaaaaaaaaagaacaatgaatgacgtattaccaacactgagatcaagaaaaaaaattgccatccaggggaaaaagattaattaatatcaattaattttcttttacaggagtagattatacagaagtctttaggcttctgaggagaatttgagaaaattttacagtaaacaggaatttgcatacgctctgggagcaaaaagtgtgtccccagacaggtcacctggggtatgttcaagatgaagaacaaaagtcgggcatttctctaagtgtagagtcaggagggtgcaaataaaggcaggctttagagggaatagagaaacttttggattcaaaagaaatacaattatcattacaatagagctacatggttacacaataagcaatactattaagcaccctctctggaaagagtgttctttgaaaaacaaaatgcagaacagatccaaaagcaaggtaacaaaagctattaggtgaagtccatcagaggaagaattctctttccatagcatcttccttcaagtacaagataattatgttttatttatggcacaggaatagaatatgagattcaccattcaataaactcaggaaaatcatttctttggtcattgctttttatttataaaatgacggcttggatcaaggtagtgtttcccaaggttttctttctttcttttttttgggggggaagatttaacaggcattacttgaagaaacttagagtcaatagattctaaattatggtcacttgaaaccagcaccacaagattacccatcaagacctaatcaaccaaattaacaattagtatttgggcagaaagttgatgcaatatctccaatatcaaggcagtacagactgctttgaaactgatattcttctctgtgcatgcatatacacacacagacacacacacactcatacacacatatatttataattccttctaaatatttgaatgttcatatatataattctttctttttaattactccaagctgagcatgtgtaggttagattcactctgttttataatatttattgtgtttatagaatatgtccatcacatcctagcccctaggcatgtttacaaataagataggaaaaaaagagactgttgataacataatggctaaaaatccacagccaatattttcagaaagatcacacaaatgcacatacatgcatacacacacagacacacacacactctatctacagatcatcctggtatccaatgtgaattccatcagtattctcagtgcaaaccacaccctgtggtttcttttcctactccctacacaacttctgccatcttgagtcttaaaatataaaacaaaaaaatatatggtccattgatggaaaggatagaaggctttagatgggagacagggtcagattcatcacatcatttcttttgacagcctagcacaggggttaatgttggctggggagatggaaaaaggaaagaggtaatgggagcagacctgggaccagttggtcagcaactcgcagagttctttaatcaccaacaacctccctgtactgaggcaacatgctgctaaatgctcaacatacagcatttcgtttcatcctcttgatgtccctacaaggtagttcctattatttccatatttcacttgataaaactgaggcccaagttacaaaatatcccaagttacaaagctactaagtggcaggctcaggacctgcacccaggtcttcccaaggccaaagtttagactcttcaccagaactgcttggctttttgctagaaagcctggggtcaggaaggttaaccattcacaaagagctcagaagtggcaaggcctggatggaatgcaatcatgaggacaacatggggcactgtccataactgtgtgatattgcactttccctgatcaaacgtcccctctgagggtgtcctagggacatttgagaccatttccctctgacacatcccttcttctgcagaagcacccatctcctttagaatttgaatttctgctaaaaagtagatgctttcctcacaaatgtcccctcctcctgtattctttctcctcttggatctccaaactaaaaactgtagtgggtatagaaaggagagtctcaagtgctgtgaaaatctttctagaggactttcatcccttcccaacagcctgcaatgtggacttctgtcccctcagtaacaaaccgtacatgtccttcctgaactgagaacgaacctgcagcatccagagcagctctaagaagcaggagaagacaaaaaaggcatgcagctccctgctgctctcaggaaaggggagagaagcgcagctgcctccgttcaaggctgggtgagagtgatgagtcaaatgactgtcatcatttggattctgacatttcttcctctacagagaaaacgaaagagtctgctattggtgatcattcattctgcgttcatttatgtcttgtgtactttttttttttatttttcgagatggagtcttgctctgtcacccaggctggggcgcagtgacgtgatctcagctcactataacctctgcctcccaggttcaagtgattatcctgcctcagcctcctgagtagctggaattacaggcaagcaccaccacacctggataatttttgtacttttagtagagacagcatttcaccatgttggccaggctggtcttgaactcctgacctcaagcgatccacccgcctcagcctcccaaagtgctggcattacagacgggagccaccacgtctggttagtattatgtacttctgactattgtgttctactttccgatttaaacaatgatcccagcagctatgggagctacaaagagccaggagtttggaagcttttcaagacactgtgagccctctccttttatcctgacttctttctcactttctgccttttcttgaagaacaagaaaagcaactccagtggaaaccacttaagcctgcaatttagctcacaaattgtccccagcatccttgtatctccttctccaactccttttttttttttttaaccttagctcttcctgatgattgtgagcatagctcagagtaatgccaactgttgctgtatcagcttaaatcagtgtggtacctggtgatggggcacagttgaggcaggcactacgagcttagacgagccttcagccccaactgaaagggatatattgtggagcactcacgcattctatagccccctcctaatccctcaagaatcccaggctgggaatggctgcaacttcaggattgtaaagttgtgtaaacacatctttacattgactacatcatggtccaacgtaacactttgaaacaaagggcttgagtgtgtccctgtaccccttcattcctgagttaaaaacaaagctccatcagtcgactcatatttatagagtgctccctgctcatctcctttcagtccttccgcttgccagggtaagaaaatttagtgcagacgatcccagccttcccagacttccctcctccttcctgacagaattagttgttgccccccaccccccatgttttatcatagccctttgcacactgtgttccccttatttatatgcttgtctctccagttgactctgagcttcttgaggttgggaacatcgtttgtgcctgtcacatctttatgggcccaagaatagagatgataggcaaaagtggagtaaagaataaaggaagaataaacatttttaaaatcagtctccaaagagttttccttctggcaggtaagacaaggcatacagtgagacatgaggcaaggcagtaagtaataagggtcagaataaaaaggaaaaagaaagcgactgttggacttggctgagtaggttgatagcaagctagtaagaaacatgagtaggtatcaaatagacacaggtgcaaaaacagggctgagaaaggtatgtcggaagggatgtctagttccaaagtgtgctgagattaaggaattagaaatgtaagctgagctccagatactggaagacttttagtatcaaacaaacaattccatttttttcttttgtctaaacattagagatgggtacacaaagaatatttacctggttggaatgtccagaaggactgtagtggactggaactcatggaagggagacccaatggaaactgtagaaacaggcttacacaatagcagaggaaacccttaatagttattttaatcaaataagattttcatttaaaagaatgaaagaattaagaagaccacagtataaaatgtaaggaataaagtttatagagagcaactggcatcggagacagaattcacaggtcagaagagaacttacaaacataagttccagttcttggagagatgcaagaacatactgctcctataagttaagaacaggttgtttgttcatcagaaaatagaattttatgccttacggttcacatgaagagttgtgaatgaaagtatgagcagtgcaaaggaacaatgagggatgccgggacaccaaagactagcaacgggaggaagccatgactaccacaactgctgaaaggacaagggcaaaacagcattactcaaagccactggcagccacagtcacggaggccaagatgactggtgggagatgtagttgcagaaggacacagttactatcgtctggcaaataaaggagggaatgagtatactcacctccttctcttcacaccctgtaaacttacactaatgcctcccattgagcaaacaccagggaggaagtccaggagacgcaagacagagacgggtagaagttgaacctcaggcaaaacaaagattacccaacacaaggctgtataaaaaaggaaaaaatcagtttaagaggcaagagcgtcattggaaattaagaatatgattggtaaaatttttttaaaaaatacaagaaatggaaggcaaggcaccaaacatttcctaggacaaaaagataaggaggtggaaaatatgagagaaacgtcaggaagcacagaagaggggtcccagagagagctctgagtttaataaacaccaagggtatggtgtctgcaaatgctccagggaaaaacacaagcaaaaggaaagaaatgcaacctgaaaattctttaggattcaataacacgtaatgataaaacagtttctttgccccgagtccttggagcataaaaaaatctgggacaatccgttcccttaccacatcagaaaagcaactttttgtttcgaaaggtctgtggtgaaacacaattccatgacgttaatcaatttatttcaattgggagtgaagcataaatgaaaagttcctatttcagaacagaccgtgaaaatgtgaagatgttattatttccaagctaaaaggagatgtgagattctctgcctggcacatttcagaaaggtacaatcagccggggcaggggaatagatttaaaatagaaaagtaatgggaaaagtgctttccatgtaacagacagggtggtggatgaaaacctatccccctaaagcccactttattaatatacattttactaggcactttggaaagtttgaaaatccacatgcttctcatttcccatagcttctgggtctaattacatatttgcatccatttgcatacacacacacacacacacacacacacacacaggtctcatccagtgatatagataattcaatattcaacttgtcgatcatcaccttaaaatagagatctaattatggaaaaaaattgtatgctgtttttcaaataaataaaaaggaggacactgattaaaaatataacacccctcattgatcaacaggtacctttttggttttaacctatcataaacatgaggtttggtactacatggttctggccctcccaaattaacactgagctagttcagggaacaagctctcacataccaaattctgaagctgcctttcagcagcaatttgagggaccaagaacataggctttccaaatgtctagaagctaaccagattcctctctccttaatttagccccttacattaggtgccccatgctctcttttgggtcaaaaataacagggacaatttaataccctatgactgtccattaaatatctgaattatgaggattcagatgtaaagtgcaatagtattttaataaaagtacactaaataaggaagctggtaatagacctcttaacgaaaacgtagtcaatggttcatttaatttgatggcagagtccactttcaaataatcccaaaagtgtatattttgtaagaaaaaggttgcagagttcacctcagggtattcttaaaaaattgtttgcacactgagaagacatcagtgctaagaggctttcctgattactgaaatttggttggaagtcttttttatttctattaaatgaatatatacaaccgttcggctgcctcaggacatttatgaaaatgagatgctctgtcttaaggaagttagctttaagagcgacatttgaatcattagatgcctcattggctgttacaaaaacaaacttcaatcttctgcttccccttttctaatattagctaacaataattaagttgcttagacaattccaggtgactcaaatttcatagcacgctcttcaaaaggctaagggatcactttaagttcctaaagccctaagactaagtgtgtttcactcactttgtgtagctccagcccagcatcatgtaccaaagggataacatgattaaaaatcatcaacttgtcttccgaaatctgtttctaaaccacagcacaaggaacagacatttaaatacagaaagggatggagaactacaatcttttaaaagtgcacactttagtgcccagtgtggtggctcacacctgtaatcccagcactttgggaggccgaggtgggtggatcacaaggtcaagatattgagaccatcctggccaacatggtgaatccctgtctctactaaaaatacaaaaattagctgagtatggtggtgtgcacttgtagtcccagctactcaggaggctgacgcaggagaatcacttgaacctgggaggcagaggttgcagtgagccgagatctcaccactgcactctggcctgggcgaaagagcatgactccatctacaaaacacacacacacacacacacacacacacacacacacgataaatattcacatcatctgcctttggttattcaacctatagtttatcatgggaaacaagatcttattcttataaagtacctgcatattttcatttgctagaaattaaccaattcagcttatatcatatgtggcacaaggttttgtcatgaggaggacatttaaagaataatttaaaagaaaacaagttcaaacgttcacataaaacaaaatagccatctctaaggagaaaatgggtattgctgatcctaatgttaatattctaaaataaatgaaacatttttgaagggagtattcaccaccacagctaaagaaagccacaaaaattagtgtatatgtgcctatatttatataggtacatttcccaattttattcttttactattacagatagctaattcctaggaaacattttctagatgtcttcttttatataccatgtctttggacattaattacaggcaaagaaagtaaacactcacaagaaaaagggaattttacaatctgatcttcaatgttatctcaagaaatgctgttatagctccttggttctggtttccatgcacctgcaaattgtcctttcacccatcacttgtaagtagtagaggagcaagcatacctgtacagtcatgcattgcttaacaatgagaagttctgagaaatgcatcattaggcaattttgtcatagcacaaacatcataagagtgcacttacacaaacctagataggtatagcccactatacacataggctatacgctatatgctatatgctgtaacctattgcttttaggcaacaattctttactgcatgttaacatactgaatactgtagataactgtaacacaagtatatttgtgtatctaaatatagaaaaggtacagtaaaaatatattataatcttatgaaacctcagttgtatgtgtactctaccactgatcaaaatgtcattatgtggtgcatgactgtatgtgaacatttcttgatcataaaaataaagtgtatgttgacttagttagtgccctggcaagttaatatgtatgttgacaaactataatgcttaacatgagtatggttaaaataacactatgtgaatatataaacacatgtctatacatatacacatatatacctatatatacacacacatataaatatatacatgcttataaattacagtctgtcttacattagctaaactattactacagtttgagataaatttgagatgttacaattggaaatctcctgtttcaatttgagaagggaaaatgttggcatattctcctgagtggagaaagaggctttctatgtcagcagatacttcagaggaacgttaatgtctcgaggtttctagcaaattaacagcccaggtaacaaaatgcagggaactctggccagttgcttacttactcagttggatctggccacttctccatgtattcccaccacactaaatggagcatgagtcatttgagtaatgagtcagaaaatgtctagcagcctccgtgcaatagcagacgtgatgcttaagataaatttcagagatactaggatggtgtttttcatgtctgcacatctctcattggtgatgaataaaattccttctcccttcccaagagacaaaaactgtatcatatgctatcctgaggctcgttccaactctaaaatttaaaatttcaagcaaaacctatagaaagaggcaaatacagtgtataaatgtctacaatttgtgtcctattcaaaattagtttttgtggaatgttgtctaatggattcagtggtcacgttaatgacaacttcactcccaagtactacatgccctgttaaagaaaaaatgcttaagtgaacaaaaaatttaaacaaattttggagttcagtgaaattaatgaataatctctttttcaatcatccctgattttttaaaatcacaatacctaaattatgatgataggaattactactagactttgagttttaatcccagtaacatctttagctgatttaaacctatttcaacttccattttaatatttcatctcattttatctgtatggttaatattaatttcctttttgcaccttctggttgtagcacaaagccagctatacaatagttgtgtgctgctgaatggaatttgaaggcaatataaaataatgtacagcatcactgaactggggattaaaaatcccaagtttgagtactgtcttggcaatgcactgcctttgtcactcaggtaagtcacttcttccttacaaaagtttcttccattacaggtttcacctctcatgacaattcctatcaattagttgaggctgtctggagtaattaggcaggacgctggtgggatggagtgccatgattgatgagtgatgcctgccaagggtgtatgacagcgaagtggtagcaattttgtcctgtacttggcaattgtagattagaacagggctgctcaaatgtgcatctatcaccaggaagcttttaaaatgcagattctgattaagtctggggcggtggctgagattgcatagttctaataggattccaggtggtgctgatgctgcggagttagagagtacacaagaagcaaggcaaagtcccttgcagctctgaatgaatatggaatctcaacctctcattctctcttgctcactcgcacacacattatttctactttatgtatgtgaaaaggtgcttacatatgccaagaatactgacaagcacattaaatacgtaattctcatcctcccccacaaaaggtagttagaagttttcaggtaagaaaatggagatttaaagagggtaagtaatttgtctaacatcacagagctgacaagtagtctagatgagagatgaacctagagaacttaattctagtaccttgctcttgacctctatcatatgctgtcttgatactgtaacaacattagactgcttacttagtgccagccactaggctgttttgtacatattatctcctctacttttcttaagaactctaggaggtaggtaatatttttgttttacagataacaaaattaattatccttccactgtctcaatctcggtaaaaccatagtgattcctattaagtaaaacattagattcatatctataatgaactaaacacaaagaacagtaggctaataaaagcaacatgtatatgcataaggctaagagtaaatatataaaaatattcttttataaattcatcctatgtaaatgcatttttgacaggtaaactcaaatgtttctgcagagtttagtgatgaggttatcaaagtccaagtgattattggtcccaaacagaatccatcagtgggatttacagtgggagaagtatcaaagattcttttttcatcatactcttttactacctaaaagttctttattagcaagcaaatgaaataagattggatcagtaaatttccctggagatgagatttcaatataagcaggtgacagtggatgctgcaccgatgcacacttaagaagagcaaacaccattgcaatgtgagggcaggatttttgctttactttgtttaaaaaaacaaaagtgtgcttcaaaacctaagggtctgaagcagtgattctcaaccttggctggaggctgcactttggaatcaagtgtgtagaggggacttaaaaaatactgatgcctagatcccctagagattctgatttatttggactggggtgcaaccgagacatcaggatatttttaagcttcttagtttttaaatgtataaccaaggttgagaatcatttgaatataggcatacctgtcccatgtggggggcgactagtcattaaaggcatgaatgtctaattgatgaatgccctcgtcagagcagactggtggcattcagagagcagcaaagactttctcccttgaagttaagcttaaatttcataagtaagtctattttaacagaaaattttataaaacatttgtagatagtctgaactacgaaaatcattttctccccttaccagaattatttccactggagggcagtctcctcttgggaagaaatgaatgcggatacaaccttcttaacagaccaaagtttaaaatattgactaagactgtggcattcacatgggtttcatttcaagacaatttctgggagatggagtatttgggataaaaaaaaatgtgtattctatgtgaagatactgccaaattaaaggtttatttctgtctgctaaaactaaaaggataaaagcttaacccaaaagataaacacatccacatatggaagaccctggggtgtacaaacataacaacaacaaatagaaagtagcatttattataggtttactgtgtgtcagatcctgtactaagcaatttaaatatcctacttgattctcagaacaaatctatattttataggtaagaaaactaaagctgagaagtgttcaaagaaatgtgtccaataccacatatcaaaaaagtagctgagctaggacttgaaccctatctgcctgacttcaaaaccagcccttgcaatcaccaatgataccgctttactgcttgagtgagaagcaacatggtccctatgcgtaagacaagcgtctaaatcagaacatgtcaacacaagaaaacaggaggaaaaaactctctttacacagcattaggtaatgaaagaaactgaaaggaggtgattcgggcagaatgagaaattccttattctccttactggttttatattttaacagttttcacaaactgtttttggttcctcttcatttcttatgcaaaccctttccaatccattaaaaataaatttggcattcccattgctatgtcttcagccgctgtacagaaccttggactagctggtcatattcctcagagacttatttcctagatcaggggttgtcaaacgttttctgtaaagagctggatagtaaatatttcaggttcttcaggccccacggtcttggctgcaactactcaattctgccagtgtagcatgaaagcagccagagatgatgtgaggatatagatgacagacgatatgaacaaaaagggcaagactggattccaataaaactttatttatggtcactaaaacttgagtttcacatcattttcatgtgtcaccaattattattcttctttctattctttttcaaccattcaaaaatgtaaaagttatctttagcttatgagccacataaaaacatgctgtggcctggattcagtgggcaggtggtaatttgccaatccccgtcctgaataaggtgtcctgtattcatttgccataacgcaaaggtcttgtcacaaagatatctagcaatggctccatgctcaaagagcaaatgtatccccagataccatcagctagtatttcagaatcagctgccttcccccaaaccactttttgctattgtatacaaattctctcagtagtaaaagtatcccagttaaatcacatcagcactctgggaaatattcttcttggggaaatattacagaatctggaatctgaaaatgatccagaaggtcacagagggctgtcatttcccaaaggcattctccagagcctccaagctcctcacagctgcagatacaggtataggtacagttccttagagaaaatagctccacagaatgaccaggacctaagaaagctcttagcaggggtgtgctagagccatctcctatcagctcatagaagaactcattatatttttcagcattttgtgagccagttgacatgagttgataacctgaaattggccatggtgggagcatcagcaccacagaaattcagaaatgtgtattcacaagtgttacaaattaggctttttttcccctctgagagcaattgttaaacattggccagcatacctctatccattacccctttccaacagacaaactcctcttagatctgttttacacatacacacatacaacccttgtgagctgcggtggcggtggcagtaactgtgggttcagggaaaggaaagaatttccccaagtaataaacaaatgtatttaggattaatcaccattttagatcatccttgagttactactccctttggaatcccaaatgcattccccttttatattaaatatggtcaactggagactaaggagttcaatcatttttgcataggatcagaaatttatcagaatcttttatcttcaattatcttctgtaattttatgtgttcatctaacatggacaaaaggaaagaagttacaaagtcctgcactgcattgtacaactgtgatccaagaggtgccattttcacttctgcatcatgctaattatccatgagcctattcccttttttatttttgctactactgaatgaagatccttacaatgtaatatctagcaatgttctaatgttcctgaactatatattatttgtttttaagcaagaggctctctgattatttctggttcctggtctcactccactaaactacatgagcccataaacctaatctaaacaaatcattttgaatttattttttctgcatttgctgccttcatcttagttttgcatcacttcaggcatcaacaaaactattttaatacaatcctttccctctacttctgcaagattagaaaataaaagagaacatttatagctactaggtgagctggaatatctaaaaagggattatatccctccctatttgtcaataaatatgacaatagttcatgtgagagtaagctgaagctgagtggcctataactaattctgaaaatttctaagctttagaaaaggatatccaggacttgaatgctcctgaaacgatacaacacattcatgcgtaatcagagatacgtagattcaaataaatctacctctacaatcttcagaaagcaatttttggagtcagacacaggtgcattttgttagagtttactgaaactctttacattgtaaagctgtagtggtagtcacccttaagttattcatagacaatttcaattatttattcatagactcacatgatgttatttttcattcagatccaaagcttgttacacattctgcaacaaaatatttaatgaaattccaagacttaaaaaatcttgcagtgaaagcaagaaagacctatcaatactgagtcaacagagtggacctaccaattcaaccaggcttggtacccaaaggcacaactcaacataaagttaacatttcactatgtaaattctaactccagtttctttttgaaacacaccttccggtcatctatttttccttcttgatctgttcataagtcataggacagaatcaattacctaggaccctttcattgtcaatgaaaatatatttcccaaagtgggttctgtgaaacactattataggcattattacagttgttttactattttttttaattccagatttggataaatttgggagatgtgggttttcactccttggggacttctcagagcccttagtatattaatgtacatcagaactctccaagtagggcattagaacatacagtattatccatacattttaaaacaaaagaattttcttctcatggagaatctcattggactagtatcccacgaagcacactttcaagaatgctggtttataagacacagctgagatttgcatataggcaccaaaagtggaaccacagagaaagggggaaatcatctgagatccctctcacatgagcacactggctgcagtaaaatgagcaatagaaactgctgagttcttttacatctatttccagatcctgtcaaaatgaataaataaaggtaagcagggtaggaggacagcaatcctgtgaaataacctccccccagtctatttgatagtttccatgacttgatcattgactcatcaaaatagacagatgtgctcttatccagcaaagtttaaagttagagataaaaacaacaacaaaaacctgagcttcaccttcagcaaagaagtgtcagctggagactttagaaattcaaagaggtaaaaacagaactatcattcaacccagaaatccccttactggatataaacccagagaaatataaatcattctaccataaagacacatgcacaagtatgttcactgcagcactattcacaaaagcaaagacatggaatcaacctaaatgcccagcaatgatagactgaataaagaaaatgttgtatatatacaccatggaatactatgcagccataaaaaaagaacaagatcacgtcttttgcagaaatgtggatagagctggaggccattatacttagaaaaccaaagcaagaacagaaaaccaaatactgcatgagcttactcataactaggtgctaaatgatgaaaactcatggatacaaagaggcgaacaatagacaatgggacctgcttgagggcagagggttggaggagaaagaggagcaaaaaaaataactattaggtactatgcctagtacctgggtgatgaaataaactgtacaataaacccacatgacatgagtttacctatgtaacaaacctgcacctgtacccctgaacctaaaataaaaattttaaaaaattcaaacatcctgcctaggattacaaatttattaaaaaattatttccttccatctaagctctctatcagaaaagtaatcatggaaccaacccaaatgcccatcaataacagactagataaagaaaaagtagtatatatacaccacggaatactatgcagccaaaaaaggaatgagataatgtcatttgcagggacgtggatgaagctggaaaccatcatcttcagcaaactaacacaggaacagaaaaccagacacgacatgttctcactcataagtgggagctgaacaatgagaacacatgaacactgggaggggaacatcacacactggggccagttggcgggtggggagcaagggaagagagagcattaggacaaatagctaatatatgcagggcttaaaacctagatgatgggttggtaggttcagtaaaccaccatggcacacatatgtaacatgtaacaaacctgcttgttctttacttgtatgctggaacttaaaataaaatttaaaaaaaactcaaaaagagaaaaaagtaatcacctgatattcaccgggataaagaaaggaatttagagaaatgtcttttgtccctacagttgaggcgtaaaacctgacagtgaggatgaaggcccttagaagccacgcagttccactaacaagcccatgtagttatttctacctccattacctgctgctttattaatataattaaccactatttattgagcttctgctaatgccaggcactatgctaggctgtatgcctatatttttattttatcctctgaccatggtaacatcggttgtcttattatcctgatttcacagacttggcacagagaagttccgtctcatgtcaaagatcacacagcctggctggggtagaatctgtatcaggaggcaagtctgcctgactccaaagatcatgcaatgccccttctccttttttttttcccttccaccactcttctgtcatgccttttccctagctattaccatttaaaagcagttgtgattaaaaacaaaggtcagctgtccataacttaactcaaatgttctttcttccttgctcttagagacaaattaccatcttccatcattcacgtggaccaagaaggatttaggctgagatgattatgcataataatctgggtctcattacaagctgagcacttggaagggccattctctcagcccttaaggcagctgaacttgatcatattttcattttcttttctccctatatccactaaagatcaactgacacagaacaaatgaagttactaacaatttactgatttctttaaaatatatatcttcaataaaggaagaacaaacagtcaaatgactgaaatctaagtacggaatgtgaaaaatgccactctctaaaattctcaaaggaagagaagaaaataaagaggggaaggagaaagagaggggaaggagaaagggagaaaaagaatcgaaggagggagagaggaatggaaggagggaaggaagggtatagagatcatctgcattagaatcttctcaggctgggggtccctgagcccactccagaccaactgattcagaacctctggggtgggatccaagactgcatttgcacacactcctctcgtgactataatttttttaattcatttatttttgagacagggtcttgctctgttgcctaggctggagtgcggtagcatgatcatggctcactacagcctcaacctctcaagctcaagtgatcctcttggcctcagcttcccaaagtgttgggattacaggtgtgagccatcatgcctgtcctggtgattgtaatttacaccagattcaccttaccctaagaagtgacttgtatatgtgttgcttatggaagtcagaagtttcccaagtttaagaattcagcatttagctccaggaaaaattggtcataaatatgatgatgacacatatgtgagacaatgactgcatgagtccaggaaagaataaagacattctcctgagaaagactcctcgttggagcctatgggttctaccgggcaggtgactcacccgttggagtcacaggtgactcagcaacagggttatgtaacaagaccaccttccttggtgctaattttagatttaaatagagaaactatttgaatgtcaaattaacctttttatatagagagagaaaaagtataacccaatgtaagcacaaggtaataagcacagggcaacacattcaaacagatgcaaagcacgtggagtgaaaagtgagttttccttccaggcccaaccacttctttctggcacttcagaaacacactttgtagaaccaatcacttgtatttgtgtgaactcctccctgttaatacaaagggaggaagcccattatacacacagttctctccttcacttttcccagaataacatatcctggaggccattctccacagtacatacacatttacatcgttcttttgaacatcatcacagtccatgtatttgaccagttcactttaataaacatttagactttttctaatcctttgctaatagaaatgatgctataaggaacactcttcttcatatggctttgtccacgtcgggggatatatttttaagataactctgtggaagcaaaatggcaagggcaaaggatacaggcacttttgagatattgccaaattttccctcccaggaagttgtagcaatttaaacttctattaatagtatatgatactacttgtttcccccacaccttcaccaaagcagtatatttttgattgtgatttaatttgccacttcgacttcttactggagaaagtgctgaccagcaaacatgaatgtaacttggcagctatatttctcctggagaatgaatacattggcattctaatttatcatcttcttatgcattaggtaagtatgaatctgtggccttgaccctcttcaactctgggtaaatttacaaactttagtttctgggcctgctaacacaggtgaacagtgatgcctccaagagaggacacatctacaagactgctggaaggagtcctcttttaattttactcttccaagttttaaaaataaattgcaaaataatttttctctaataagttaacgatttaaaattgtaattcaattagaaatttttttaaatattatgaaccaaatttttcttgctcaagtctgcaagaagggaggaactctgtggaacgcttcagatcagaccaccttggcggacatcaaagatctaattcaaatgacatctactcacagactcagtggtctgcttcatggattcaaaagttaatcaaaattcatactacaaatgctgttactaatcgccacagcagcaaactagaacccctccttgcccaccacttttacactccacccccagagaataacagacaacatgctgtttcttccagtaattcttaggatgttattgatgtattgtttatttttcatagagtccatgcacttaggaggaaacagggcataatatatatgcactttcagaaaactgttttaatgttataaataatatccaaaaccattaatgagttttagaggtggctgccttgcagcggggaattacttaagcactggaaagccaatcaacaaatatttattttgcaacttctgtgtgcatgcctaaaaaatcttattccattagtaaaataagtccatctagaaaaatacattaattcaacgcatatttactccacactcacatgttgcaccacagctccaagtgtgaatgaggcagagaccctgcactcgagttaggaagacacagccaactgaactgatgacttaaacgcaaagggacagagcacaggctatggcaggattacagaaaaagggctcctcatcaagccttgagggaatcagggaaggcttccaggaggaagcaaactgatatgatttccaagaaggattcatccaggggggaaaaatggacagaattagggaaatactattgcttaatcatagaagttcacctaaaccccatgaaagtcagcaatagtaccgtttctacctgaaatacagtcagcccaggattagaatatgttcagctctcatgtcataaaatccctaaagaactttctgaaaagctaagcccactgataagaataaaggaaaagcatagcaccccacaaactaaaacatattttccattacaaatacattttcaccaactctgaaaaaccaagtggacatttaacagatcctagaagactttgctccctaattgcctcccaataaccctcactctcattaaactacagcatgaccctctagtttggaggcccaccttctctttactcaaaaatttccaaacctaatgagagatagtcttagagaaagatgatggacttaacagactgagacgtattttccttccttggtgtttacattatttgacagcaaggagccccagagcaggagctagttccaagcaaagtccccaaagaatatcaacaaggaaaaacagccactaggctgtataaatccacttgctataaaattccaacacacacataataaccagcatatgaagctgaatccttataggaaaacaattcaaaatccaggtacattcatcaggccctccccatgtcgtggaagactaaagttagtagctcttccatatgttacactatgaaacaagatgaaaatggcagagaggaaaatgaaatgagccttctgagattcattctttagtttgttcgttcaaatacacggcagaagagggtgctttccatacagaaattattccgttttgacacactctaacttaggctatttggaggagaattgtctggctctaccttacagtacacacttcccaaagtcccacaaatcatgtggctttgggagaagagagagttcggggagcatttaccccgaccataccaaaatgaattaacagggattaatttgggttacatggtctatgtgccagtcagaacagcttccagtgtgtttcagaatttaaggtggggaaaaaagaaacagaaaatcggatttcaaaactaccctttaatgaaaagctgttaaagtgatttatcttaacaaaataatcatcaaattagaagctatatgtattcttaagacattttgaactccacattgtatcaaaattaggtagaatatatatattattatatatatattatctctctatatattctctatatgtaacctctatatatatatatactatatatattccatatatatactatatatactctctctctatatatatatatatataaaatcatagatacaccatgataatttactgagaatactaaaggagatgcgaataaaaaatatgtatctagtctatttgttagaaatcaggtatacctatctgcaacagacaaaaataacaatggcttaagcagacatggtctaatttgctcatgtaagtctgaggaccagcagaccagaacttgtctggccactggcaccgtggtcatctaaaacccaggctgctttcagattctcttctaccacctctgtgatggttcttattctcctagcccaagatggcattccagccatgccattcactgcctgggcagcaggatggaggcagggcaggcttccaatctttaatgacatgttccagaagttgcgcccatcacttctcattgtcacttgtcagaatttgattatacaaccccacctagaaacaaggaaggttagaaatgtaatccttcctctaggcagttgtgcaggctcccagaagaaacagagctggattattcaagaaaggtaagcgtcagaggtagtaggaaagtagcctgagtctggagagagtgagtagagcctccgtgagatcttgtcctctcttctagcccctcatctagcaagatttacagtgggttcctgtgcctgggatatagcactgtcttgatggttatagcaaaggtcccagtggctgtgcctggcttgaaagaagtcaacagcagcaatagcaaagcttgacctcaaattgatggcacagacaggcataaagagaagcctgcccatcgctgggtatcctgaagacctttctccaacatctagggggaaaatgtgggctttcattcagtgggcagagcccacactttcattttgactagaacatacattctgagtatgtaatcttctattggttaaacttagttatactctctcactttgtacccttaacaccacatacaagactgcttttgataaggaataaggacaggagatccttttttgtcctccaactagcctgcaaaaaagtattactgtagattgatattgtataatattacaaagaatagcactagcccaggtgacctgacacttctctataataattttctctggcacattaatttacacttgcatgcatatcactgaagaaaggtatttggggtttctatcaggacaataacaggcttgaaattagtgttgaaaaacattcacagccaggatttcaccccctgcccctgggttctctattttagctttctacattggcaactttcaacttttgctgctcaatgcaaataataactagcttaatgatttagaagaaaatattcttggagtatgttatagtcgtatgttaactgcaaatggctgccacctccaaataattgtctgacactatgtctgactatctgttcctccattctattgatctctcctatgaacaaagcagacagatatgcaggtacagctcttttaggaacaaattgccctttctccaagctgacatctttagaattaagaactcagagacagccaatgtggaaaaacatttctcccctgccacatgcttggtgggtcagaaagtcaatcaaattctatttcacaaaaaaaactaattcctatgagatgggaggctgcattaatatttctaagaccaaatattctccctcaagtaatataaatttataggtataacttttcccaatgctctatcgacttctcatggtatatgaaagtaattaggcttctctgaaagccagagctgcgttgagaactatatttgagtaaacacaaaagaaaagcattttgagtgttacttttaatgtttccagaaaagttaacacctataaaaatattgtttccagttttctgtatagaagtcactgaaggaggatgtgtgaaagtctgtggaaacagtacactggcaaactgccagctggaatcgcacggagctctgttgtaactcaaatctggccaggccgcaagtcaaagcatgtcctaagaaatatagtacacacatacagcgaacacaaccattgtaactctagcccatgggaagctgaacattcaatggacagtgtccagactatatagaaaaatagaacactgacccaccacctgcagaaaccagtcgaggaaaccacaacttttgcagccatcggccccaaatggttggtacttaatcaacaactgccaacttccccaagtgttgccccctgcatccaacacaggaccaaccagtgaaagctgactctgatcacataggacatctggcttctaggttagccacctccagcttcctgtgccaacagcctcaagtcaggtcacacctgaatcctcctcctcccttccctctcctctccccttccaacactataaagggttttctattcccctacttccttttgagtcttcaccagccacatgtgatgatggctgccacccttgttctagaaagcccagaatagcctctgcttcttctcatttgcattgctttttcccccatatctggttctccctgggggccttctatcctgcctgggccctctgctaggagttccttaacttttcccttctccatcctgcagcatcttcatccttccctgcttccaagggctgtgtttctgtagatgaactgtttctcccctatttgaggccagtccttccaactgtattctttcctcattatttctattccttcttcctggaccttttgtttccacctgttgtatcccttgctgtgttcctcacatgccactgggacagcacagaaacagtcccaaggcgtctacctggccaagcacagtggagctactgtgaggacaggatataaagaagcaacagtctggcctcaccaagaaaagggagcattacagattgattcatctgcattacatttcaagccaaagttgaacagtctagatttggatgcaaagagaacagagaaaaaagctaggagccaatagcaaccaattcaggggtcagagtggcaggcatcaagaaagtaggatggacaaaggagagccaacgaggagaaattaggggaaagcgaaacatcagtaggcagaaggcaattgtacaggattaagcctgaggacaccatgttagtcttttttttttttatacttggctcctgtaaattgcagtgagccatgtattaaagggaaagaacatggaggatcaccaagcatttctgtcctaaatatatacatatacatataaatatgtatatatgtgtgtgtgtgtatatatatatggacacacacacatatatatgtgtgtgtatatatggacatatgtgtatatatatatacgcacatacgtatgtgtatatacgtgtagatatatgtgtgtatgtatatatgtgtgtgtgtgtgtatagtgtgtgtatgtgtgtattttaagagactaggtgtcactcctgttgccagtgccgtcgtgcagttatagctcactgaagcctcaaactcctgggctcaagttattctcctacttcagcctcctaagtagctgtaactacaggcatgcaccgccatgcctggctaatttttttttaagagatggggtcttgctgtgttgcccaggctggtcttgaactcctggccttaagagatcctcccacagcacgggaattataggtgtgagccaccatgcctggtcccataatatattttcctttgcaatacagtctatagttaacatccaaatcccatgcaaagtataataaaacacctcttaccagcttcttctagggctcagaaaaactctcttctctccatttttgcctcccttctgatttctccattattattgctctattaattcttctttcttacaaataaaagtatacttacccattatgaacttttaaataatcaacttctttttctcctgtaattaaccaaaaaagttcttggaataatctactaaacacccagtctccactatctcctcagtcaaatacagtgttggcttcttccctaggccattcttagagaattcctctccaaggtcattcgagcccaaacctcatgcccttcttcagcacgcacaggctgcaggctctcctgaaccaccttgaagttctccaaccttggccttgccgacactgcactagcctttgggatcaccctttttcagctcagctatttttcattctttcactcctgcccatccctcttttatcatccctcagtctcatctgcaatggaaacatgacctaatctccaaaatcctttccaattgctatctccttctggatctccaaaacagacaagattgaggctcccgtttgctgttcttggtgtttgaatcactcctgcagcaatttcctacacagtctcatagtaaaggaatctgcacccctgtattctacttctcactgggactgtaagctccttgtgggtaatggctaaatctcatccacctttatatctccaagtctaacaatagtactagacacatctcaggtagagactctggagtgtgactgcctatagagagcatgataatactttctatctcataatacaacgcctagcatgctggctcttaccatcatcatcaagagatgagagttaaattaaatgaacctaataatgtgaagacagatgttagtattgtccccctgtgctgtttctactgtatttgatttcagatattttagtgaaaaaaaatgtgctttgaactatctagatgacaccaaaactgaaatttatcagagacctctggtattctgttttgtgcagacatactgcttcccaaattattttacacagcaccatccccacctcatttcctgtgcttatggacaacggaggcttgcagaattaaagtatgcctatttattccataagaaaatgggaataaatattaagataatggttgggggaggagaaagtgtacagaaaataattaagtcaaactcacccaacattaacatgggggagaagagatttttttcaaaaccctgcctccctagagccctaaaccttttcatcgatttccaataatagtgagaacttttgctataaaattgttttacagcagctaacaagcagtaaatgtttaatcattatacatacttaggagagcagcattgttattttatagattttaaaaccaggggctcatatagatctaagagctttcttcttgcacctagaaagcagcagaaccataccttgaactgtagtttttcagactcagttcttacccgctgtcattcatatccataccattctccaaaagactcatgtaagaaaataatcaccatgcaaagaaaccatccagctcttcatgaaaagctctagttcagtctctaggaggacccaaatgacagtgaagtctaagtctcagtctctaatgccaaggaaatgtcagggaattaagaccctcaagtgtgaacatgggagggtaactcaggctcctcttctaataaagtctaaatgggagttcatcaaactgtttaaaagccgatcttatcaacctaactaaacctaattcttcttgctttatctgaaaccctgttttaaagttcaaaatgaccaagctatgcaatttgtatgcagagaagctaagcagctgagagatattgagccaggactctctgtctagtaagttagaggaagaacaacaaaagtagattgccagatacaaagaaataagcaacatcagagagataccaaataaaagaatgttgacagctcttggcttcaggaaagccaagaagaatcatacattgaggaattggcatttgagcgaaggaggtttagatcatattctttcatcttgaaagtataaaaaggtctggaaagatgtatcatcctaagcacccaccatcgaagttagatagcagcaatttaattccagccttcatattggagagcacataggcaacttaatattcagaaacaagatttggggggacaatttaaagagagggcattttccagattaatggatacagctgaataaatgtgttctttgctttaaaaatccctcaaaataattagcaggaaaggtagcgatcaagcaaaatgttgactatttttcaagctgtgttttctctcctctcagaattattaataaacttaccatattttggttaaaatatttgctcacaaggagtattaattttcctaaaatgaatagggttataatattttaaaatgtatttcaccaacagcaattaatttgtgttgagtgtttgaggatagataattccactgggcaacaaaaatcacttaatcttccatgttgttgcaagagcaaagaaaagcaactgcattttaaaagtttaattagaagtaaaagcaagtttatataatgatatatcacactgctagcaagtaataaagataaacatcctcgcatattatcagcaccaaaaaacagtcaaatttcgctttgcttacagattgcagaaacttctatagtatgaaatggctttttcagataccgcttctgagtttggtggatttttttcccaagaacttgtggttaggataatttgagggattacagtgtagacagtgacattcccttgtatttgagagaagtttgtgcaattcagacatgactgtgtttgcttttagcaaacatactgttcacattttgagaaaaactgctgatgcagtctggtgaaagtgttctagcaatgccaaatcactgacagatgtgctgtctgccaagggatttccctaggaatgttctaattttcttctatctgtttagagaaagttcgtttaaaatctgttaaaatgtattaatgtgcagtgttccattgtatcttgctgtgggcatactagcaaaagaaaagttacaggaagattggtactggggtgcctaccaaaaacttgatcccgccagatcagaaacctgcccaatcctcgatcttacagaagggagagctcatatactctgtaataacttgcattgtctataattttattgtgttagaacacaaaggggctcactattcttccaaactcatttaaaaatatacctgctgttgaaactgcagtctagagagattaggtgatatatccacagtcacagtcaattggccagtgacaaacaatgtggtcacctgcaaatatcaatagaattaagaaaacaaaaggtagttcttaccagtgagttttgcatgaaggatgtgaggctcaaagataagatactttgagtacggatctaaaatttttatttgttaccaaatcaatgttttctatatttcctaaggtgactattaagtcggagtcaaatatcagaaacatcatcacagttataaacttaaccattgtggggaagattaacatggctttcattagtgaattaaaattgacttctgcatgttggtacaacagtaagacaatatcacaactgtactcccaaggaagtaaaatgctaaaaaggacaagttaaaaaaaaaaaaaggaatgcaatactaccagaagtcctaatggtaccagcacatacacactgtcccacatcaatgagaatgctcacctactgcctgagaagtataataatgaacagctatcgttcttgcccatctaaactccctttctttagggcaggagttcttgacctcagcactattgacattttagaccacataattctttgctgtgaagagctgtctgtgtactctaagatatttatggccactacttactagatgccagcagcatctccttcccagtagtgacaaccaaaaatgtatccagatgtcgctaaatgtgttcagatggggaaaggggagatataaaatcactcccttttgagaaacacaactttaaggaagcagccacttcctcactgtactggtagggctgccattcacatcatatgcccagaaggcacttagagctcagtaatctcatggccatggccttcccaatatccacagatccatcctgctaaaggcaccaatgatcagctcttctctgggacttgttctttaattccatatcctacacaacactctcccaaacctcttttttccataagttattcaaagttgggtctgctacttacaaacaaggaagcctacttgattaaaaaaaaataagcagcaaaaataattgttttcatttgtgtaagaaaaaaatagtgcatctgtcataaactaatagtagagtaaggcaggattacagaatcacactccccacctccaccctgcaagaaactaatttttaaaagtaagaaaatgataaggattttaaaaagctaataccttacccaacacctataaaaccaataaagtggtataagctttgctataaattttgaaagcctaagaaaagaaaacaaagattctgatacgtcagccccaccaactcaccctaatccaaccctacacacacccagaagcggtactaatcaaagaaggtaagtagacagatttctgaagtttctcagaactaccctaaatatgaaaaggtatggactgacagaaggggagtgatgaggcaaacccagacaaattcgagaaaaacaactttgttatagaagctcctacatgtccttttgagaccttatcaggactacagtacatattatagatgttctttttatgagaagatgccccctctgggcagaccaaattagaaaaatgcatccctctcatgagcggatgcaacagccctgcaccaagcatgcttttttggaggcagagcacagactggaattgagctccccttccgggcccctcacctatgtttctccattcaaggacaacctgcacacagcagcagttcacagcagccctgccagcagaggctggaagggtccccagagtttgttgacttccacagcaatgtgccaagtgacagaacctttgaaagcccaaagactgcaacaatgctggttgaggaatgggcccagggacagaatattaataggatctcggaagatacagcagggatcaggtcgcccagtgtgggctgcaccctgcttccccacagccttctccaccctcaccctccacatttcctaccgcagtggcttcctaatgtcagcatgtttcagagctgcctgaaagccttgtgataaaacaggttactgggccacatctccagagtttctgattcaatgtgtatgaggtgaggcccacagattccccctgttaaatgatgttgctggtctgaagaccacattctgaaaatcagtcatctttagaaaagtatgtaaaaagcagcagctagccctcaaaccatagctcagaatagggaagacaaactagtgtcaaggaacttgaaatcaaggaagatgaagatcaactcacaccagttaagaaaaacaacaataacaaaaacataaaacacccatcttaatagtgagcaggataaaaataaaaggcatgactaccatgcaaacttactacctgaatgaggagagggtggggaatggcagaaagaaaataacagaatgtaaaagacagatgaagaactcagctggaagaaaatgtaactgaaattaaacaacagtttcctcataagtgttttataatattaaggaaactaaaaagaatcttcaataacagctcaaaattgagaagataaaacacaaacaaggttttgaaaaggaaattccagagttaaggaagtactctgaatatattacataccaataaaaacttaattaattcattagaaacagaaatagaaaaagtcaaagctgaaaactaaattaccatgatggagaaactcaaaataatttcactgaatacctgagaaaaaaggcaaggaacttgttcaagcaaacaaagtaagcattaatttggaagacagatagagtaagccaagaaaatcatcatcagtgtccctgaaacactggaccgtaaaaagaaaaattctcagttttcacacaaaacatttatctaaagtgaagaaagaactgaatccatgggtggaaatgatacagtatcctgagaaaaatttaatgatcagcattgtcatcctaattaagctattacacatcaaggataaaactagagctgttcaaacatctaagaagaaagcaagtcaattacaatagggaaaagaaaatcagcctggcctcacactttctacagcaacagccaatctcggaaaaccatggagcaatgtctaaacttcagagaaaaagaaaaggtgacccaagaatgtcctatcagccaagttgttattcaggtataaaggtaataggtagatattctcaaaagtgaaaaatctcagagaatataaccttcatgaaaccttcttggagagaaaaaaaattgcttgatgatgaaaggtacccagctaagagataaataaaaagaaacaatcctggcatctagaaaccatggtaaaaagactaccagagctggatccaaataaaaatacaaccaggactaaacaaatgggagaatgacatttgcaaaacagaatgaggatgttatgagcctgtgcaatggactgaatacttatgtcttctccaaattcatatgttgaaatcctaacttccaaggtgacagtattaggcagtggaagtcatgagggctccattctcatgactgggattagtgcctgtataaaaaagacctcagagagctagctaatagccccttgcactaggtgagaaaatagcaagaaagtaccatctactcatgagaaagcaagcctttgccagacaccaaatctgccggtaccttgatcttagacttcccagtctctataactgcaagaaatatatttctgttgtttatgagctacccagtttatggtattttgctacagcagcccaaacagactaggacagcctgtcagggtaaaaataatatgagcaacatagtttgaaggtagtaagagaggtagctggaaagaaattagaaatcaatcatgtaatctctcctagtgaataacatctaaaattggtgtagttaaaaactcataaaaactccaacttttgaatgtttttatattttttcttaacctttagaaaagtctttaggaacaaatagctttaatggtgaaaaaatacatagctgaagctcaacaattccttggatttcactttcagtttctttttcttctgttaaattcaggtaaaattaaatttaacatctttattgataaagcagatatattatgatctctgaattattctcatccttacaatgttaattcttactatctatccattttactatcttcctatctgtacatgtgtattaagagatgtttagaacgatgctcttcaactgttcagagggtatttctcggtggtgggatttagggtattgtgttgctttcttctgtataattttgtatattgcctacattttttaatgatgagcataagtcacttgtaaaaatatacaatcaccactctaaaaaggaatacatgaaatataacaccacttttctgacacagtgagtataaatgtatctctttcaatgagcaacatcataaagtgcctctctgggtaaggcatcattgtgaatatccaccctcattgcaaagtacactagaagtgaatgatacgtaagaatgagtagaatgtatccaaggcaataacactataaggctctgtttcatttttgtaaatagatctctggcttaggctcctttaattagcagtacctaacatttcctgagcatttgctatgtgcccggctgcatgccaccatactttataggtattttgttatttaattctcacagtaactataaggtaataataataatggtgacgaagagactaagaacagctcagagttgttgagtgtctactatgtactaggcactgctccaagtgcttttcaggcaataacattcttcagtaggaagtacttatagcaatgggagtacattgtgcagcagaagagaaggctatcaaggccagcttttaaaaatacaaggatttacatttagtacagtgagagaaagtgcacaggtgagtctggccttgtgtagagagaaaacataaagagaaaaaactggcagaaccacgcaattaattaagtacttttgaccacaaaagtgaggggaatccagggtagagcaggactccgaccaagaagatataaaggccttggtcagcttctggttgtcgtggaaatgggatttcaaccattataatgagatcaaatcatatgctaacaaagaaatcagtaattagagttggggccacccacagagctcacctccatcttgggataagatctaggaagagccagacatgcatttttgccgcagataaaatcccaaaaggaaaggttttaagtatgaaagggttgggctgaaataacatactcaagaatattgctattctgagtgttgcttctgcttccagctctgaccaggtcactgcagataacaaattatgtcatttcttatagctctattccactcatcagctccccttctatgcaggaaggagcatgaaatgggaaaaaaaccgaggttcccactcttggtgtcctaagtgatcagccacaggaagaaaaagatctctgctcattttccctctcacttactattgcccaggaatcttggatctcttcagaatagtgggcaaactgagagaaagcaagttcatttaatcctcaaaacaaccctatagattccattctgttatcatcatccccatttcacagatttcacaatggacagggaggagcagcattgaagggatcagtaacctgcccaaggtccattttaacacaagagctttctgacttcattcaggctcccctctctgtgattgtgatttctctcatgtctaaaccattcacattttttaaaattaggatttctatgcttaagtatgtacctttgttcacaactaagttgaggattctatactcaaacacacacacacagagagagagagagagagatgcagttgattttccccaatactaatgtccatgaactgaaagcttaggcaataacttagtatagccacagctttggtttggttcagttctagggtactgctttgcaaattaaaggtgtaatcccttcaaatcactgcaataaaagtgatttgaaatcatactatttgcagtcataatagaaacaaatgcctacttaactactcatggctcagctctggtgagaacacatcaatagagtaaaatgcttttagctttccagagaaaggttccacctgacagataccaagagatcaaatattcactccgcttaggacaaagaagtgtacggattaggacatacttgagaagtcagtttcagaaggcaccagtttagaaaagaaccctgaaagacctctaccatttatttatatttcaatgtattcattccatttcttcctatgtcttttcattcatttgtttatctccttggtctgtgtgctgcaggctaaaactacagcaattaaacacaaggtccttgcatccaggagttcttctcaatccagtaatggaaacaactaacatcatatactattttgctttattttctgctagaggtacggacaggaggtgctgtgggaacacagctaatggggcacctggttcttgcctatgagagttttgagaaggatacctgaagtagggtttagaaactgaccatcacaggggatgggagaggaggaaagataaagttataaggaattctcaaactttgaacatgtgaatgtcctatatgtatctgtaaatagtatataaaaacactatagtatctgactgctctgtcacagatgaaaaccttcaaagagaagctgatcatagacacaattatagaaaccaggggatgttatctcgcccaagtctgcctgactacttttaaggatgctaaattcctaatctctcaaggatgacattcttcttgccccagagtgtgctagagccagagggaccaactctttctccctaacttcctacccaacaaagaatcctcctctacaatattcctaatggatgtttactatagcaaacatcacttgttcagttttggttcctcagtccctattccctcattgtaatagcattttttttttttttgagatggagtctcgttctgtcacccaggctggagtgcagtgacgcaatcttagctcactgcaacctctgcctcccggattcaagtgattctcatgcctcagcctcccaagtagctgggactacagatgcccactgccatgcccaggtaattttttgtgttttagtagagatggggtttcaccatgttacccaggctggtctcaaactcctgagttcaggcaatctgcccgcctcagcctcccaaagtgctgggattacaggcgtgagtcaccgagcccagcctgtgatagcatcttgattcacttttagggacttttctcctattataagccaccattaggatagtgaattgggtgccttttcattccactccagaatttgaggtcctggagacttctggtatattttctgctgtaatggaaaaaggatgagcatgtgtcctaagctcagttaattggaccttctcttccagggctctgaatcctaagaagagtgacatgccactcactcactcattgctgtaatggcttcttaatagccaagtagactccatcttgatactttcctgtttctaagcctagtccctcctgcccgcatcttgattctgttaactccccgatatccttctatttgtaacaaattccttttctacttatattaacctcagtctctgttacctgcttccactggaactctgattctgcttgaatccttccattaatgggaatattactacattgagaggctgctcattccattgctggacctctatatttgtttcaaaagttgttaattcaagctaaagccgggttctctattactagtgtctgtcatcaggaattagaaagaataaattttagtccctcttccatatggcagtcactatagtatccaaggaagggcaaataatcattgataaccacaccactaaagcccttctcccagctgaaaaccaccagggtttttataaatcttctagaataatataaattttcagacaccacagaaatagaagctttgaattgccgatgagcagattaatcattttcagatggtctcagggaactaaacagtcacttcctcggtgggcctctttcgaagagggcactttcatgtttattacttgcaagggttggcaaatggtagaattcttttttaggatgataaggatttatatttctatctagtctgccactaattaaaagtatattatcttccctactgaagttggggtaattggtggttattttcagagcaactcatcagggtgagacagattctttctgattgaggtagcagaggtgttgaacattcattgtgtactgagttcacgtttctagtatcacaatttcccacaccacatgcgtgatagatgtgtcttcaacatttgcaaacaattccaagtcatttctcccttcaattattccctcttctctgacatcctaacaaggttttcattttgtactaatttcactaatttaggaaaacttttgtctgcaatacatacatatacatatatacacacatatacatatatacacacatataaacatatatgtatatatattcatattcttgagaagtaggccagaaacttggcttgctgtgaaaatcagaggggaaataaaaaggatgaatggagaatagtgtctattccctttggcacttcttacctaatactcaagccccttacttgctgaaactcaagtcttctcctccctgctcccacttgccttatatcttctctcaatgagtgaggattaagggcaggtacttctcccattccagagaagcagcagctccatctggagcactctgcctctttctgatggagccctcaggggtgtacactgtaatgtccatcttccctcgtctgctcacgcagaggacaagactctcactctcaccctctttctttccctatctaattttctctcctttctctctctctttcctcttcatttctagtggccaccagctctgaaggtaacatcccagcctgagtaggcctgagccaattattctagaccagaatcagcgggggtaaacacaaacactctcattctctagctgtttcctcaggtgctatggctgttctggactgttctccccttccactgctcagatgatatatgacactcaattacagttgaagagaaatggatcaactgctctagatccaggcccctgaagctactttaatatgtacataagtgttcaccagaggttcagtccagctctctggggtgctacatgggtgcagaaggtccaaagacccagctaataacgaaagttgacttagcttttatttagcctcctttattttttttcccaccaggaaaaaaaggagttgggtcaaacaggaactgggcccaatatcattacaacaatactgcaaggtcccccttcatcccaatgccacaatctagactttgtttttaggaatatattttaggaataataaatacaaaagaaaaaataaatcctaaattatgaacatcgttatttggttttgcaagtcagtcaaagtcatgtaaagagagagacctagtcattatcaggaaataactatcttgaattagtctgtaacaatttcttctcattgagtatttttgtgtttcccttctcttcataataggtaacatgatttcctacttaaaacggtggcagagtttcccttaaaaacaaatttatgttttaaaagtcagttgattcaaataaatattaaatatatgaatgcatatgctggtcacgcacaatttggaaaaaaaaaaaaaaagtatataaatgtcctggagacttctggtagattttctgctgttcctactctgaatggacatggatcattttcatgccactttggggattgatgcatgactcctgttgcttccaaactgtctcaaaagaaaatagcattccacctgacagctgcatgaactcaagtctttctcatgtatgggaggcataagtatgtccatccaacaaatctgccagcattgcctttattctggtactgtctaaggctgcctattcccttctgcacagagttcagccttttgcttccttttttatttattttttttttgagactgagtctagctgtgtcgcccaggctggagtgcagtggcgccatctcagctcactgcaatctccgcctctcgggttcaagtgattctcctgcctcagcctcctgagtagctgggattacaggtgtgtgccaccacacccagctaaatttttgtatttttagtacagatggggtctaaccatgttggttagactggtcttgaactcctgaccttgtgactcacccacctcggcctcccacagtgctggaattacaggcatgagccaccgcgcccagcccttagccttttgcttcttatggaaaagcattcttcattgttttattcactaggcttaggcaagtaccaccctaactctcaaatagcctttccatctgggcacccttcttcatgatgtctttgttcctggaatgtgcctcaaaggtctgatttcttaggtgccaagcagagtaaaacttctaatcttccttctatcaatccggagttcctgctatctcaacaatatactgcatacccaaagcacatgcataaaataaagtttattacaacaagactttgtttacagaagaaagattagactgattgaatacattgttctacactgattttaattggtgctataatctgatctgtctctaaccagctaatcggtatttaatcggttgctttaattttattacaaggcagctagaatgcagctgtagctagagaccacacagtaaataaactacattattattatatttatgcatatgagttttattctgcttgtgtcaaaattatactcacttccactcccctcctaatttgtttgtattaaaccattgctgtgcacttgcatagtgggaagagttaaaaaatgcctttttattgccaagggtaagttatgtgataagtttccagatgtacccaccttcatttgccaaacaatcttgtgattgatttaaatatttatacagtgcttcaattactgacattgtttctattaattaatgatattagggtttaattctacagaatacagaaatagaaacagaacaaattcatgcacaaaaaagcatctgatatgatcaccctgaatgtagtttcatgctagagtttctacgcaattccccagagaatgaagcataccagcattaataaaactctaagtgttttaggggctttgaacatgggtgcgataggttccaaagccctatgtaagtatttgaacaacttgaccttatttcagcttcttgagagaactattagggacagtcacagaatcaacatgaaaaattattaagtacccacatactgcctgcctgaaaggactcagacaactacagcaaacttcgaaaaaatattaataatatcaaaacaccttgcggctgctcttttagatcgctgcacatttttaagatgtaatttactggaagctctcttttgctctttcctgtcatttcagttatgcaagaacacaatgctctcaccctacgccagtctggagagctttgcttttctcttgggaggaggcatggtgcaatgatgagaagaagggcttagcagcaggccgaccctggctccagtcccagcttttacatactccctgaatgacatcaggccatgtactcttaagcctaaatttcctcatctgtaaaataggagtcatcacagctactctgatattagtgtgaggattaaatgagacaacaccataaggctctagccaaggggtccagctgttcctttggctactgtgatctcaggctcatttagcccagtaattgtggctcatctcatagttgtcttctcatcctgctgagattcatttatttaacaaatgtttattgggtactgatgggggtgccaagcatgggctagaaacctggaacacaacactgaaggtccagtttgcaacacaaagtccagttggtccaatgaaaaagaggattagatttgccttttaacaaaacattcctaggtagatgtttatggtaaagctaacatcgagccaagtatcacagaaatatatggcaggacattaatgcctagtgttccattataggaacgctaagcatgtgggagttatttataacctacagctcaaggtcatcaccaaggtctgatttttcactcatgcaaaaattcaaaaaactgaaacctctggcataaacgggttaaggaagggaaggccccttagtccaagcctttccttataaaggtatggaaagaaaccattgttcctcatcagcatgagagcaatacgtgttgtttacatagtattttgccatctgtgatgatttttatgtagtgtaggacaaggactttctaacgctcggctctatactagaccaggtccaaaaatctacctgagtatcactacctctgtcactgaactactgtaacccaataacaggataagatggctaacaaaagatgccctcgtaggaggaactatccagtagtttgatttcatacttgtcctaaacctttaaacttgttctacccacatgtcacagatatggaggttagtgaaaactacctgtgtgtgtacagagcagctgggaggacattttggctctgttctaggcagtcatgtagggcccccttactttgctcctgcagagggtcctgatactgtcactgttctgctcagcttcaaaactctcagcaggatgtcccattcctcacctagccctcacctgctctacctaatgatgctcaatcactgaactggcccagaaataatacctgcctatcctgacttcttacccaaacctggggctacctccctgactggcatcctaggggggctctccatggcctttagtgaagtggtcaaagagaagggtcaactctttatacaaaagaaaaatgagtcatgagctaactgtgaaactctcaataagtcacatattctctgatctccatttcccaaatcacacaaattgagagccatctaaattgcctcccaactctgagactctatggatatacatatatgaatcatcatagcaaatatatatctattatagaagctaaaggaatcttctcactttctccaattagtaccaactagattactccacaaaagatacttgaccttgttaaaacaaaaagcaaaacaaaaatactcttttacactattatcaggaaatctatgcctggctttagcagcagagtataaatatttggttattggatacttttcaatttaggggaaaaggtatatctattgcttaaaaacatttgtgcccttcttatagccaggtcacccattccaagtctgaagaaaataaattgaagtggtggtaaaagttagttaaatttcagaatttttaaaagaagggatatcattcatctctggctagataactctgtaaaagatctatctgtaagaacagaaaatgctcttataagaactttgagactagataaacaaatgcatgccacacagaccaccactcccatctcctcaggctgtggcagacattattaatcaataacagaatccttcccactatgtctatacacagccttcaaatggctctcaatgcagtatctcaggtaactgccagcaacgaatcatatttggcatgaatgataaaaggtatttggaatccctggctttatgactttgactgttaccctgactgccatttagaggattaacagccaagaatgtcacagtgtcattatttaaataaaatagaaagggatcttgcctgcaggaacatgcctctgaatattagtaggggatttcaagcttgaaactctccagaagtttctttttcatcactctaatgcttgactttttcttcctctgccccctccttccttatgaactctcaaggatacttacaggtcagaagggtcttcaggttgagttctggccaaaatttgtggcatttccaagtctcacttcactgaatgagtacaaccctgagacctgtctgggaacatggagtgaaacagaaactaagagagccaccactgctgaggcagggagggatggcctggtgatacacaggaaaggtaagtgtggcagtgcagtgagagatgggctggggagtaaggtagacaaaaggatctaaagagtggagtccaaaagcacaatgatacaaagtgagtgaagctcagggtttagcaagttaacatgaaaaccctagctcctgaatgaagagtaccttttgcatggagcctggattatcttttctgcttatatctttcttttctcctccctccagcccttccctccttcctatatgctccattttcaactccctttatattccttcatctttctctccctacttccttttctttaacttccatttctttctttttcagtcattcctacatttccctttttctctcattctcctttgtctaagctttagacaaccctgctcactagctccttggcctttaagagcttataagggctaaggggctactagtagcttctccccatgcaacatatcacacaggtgtcttggagggacaaagtggggcttgagactcctggatgctacacagcagaggtaagggctcaggtacccaagagaagaaatcaatgaagtaggaagcagaggtgaaaagagtatatcagctcaacaggatcaacaaagtccaggaacactgtcaaaataagcttggcagaaaatcaacagagcagagaacagcatgaaacatgaagtgatacaggttgtgggtgggtggagaaagagaaatacaaggcaagcaaagtggcagcattaataagcagccatgactggacacagacctgaagatggatattaggaagtaggtgcccactgagaatgagagtaaaaaccaaagtgatgaactatgcctttgtaacacctgacacaaaagaaaagaggtatgccagttaaatggcagcaccatgtacagaaatgagtagatatttcttggttttgcttaatatcgctctggaagcacagaattcatgttctaagacttaagaataacctaaaccagcccagtgtggtggctcacacctacaatcccagcactttggaggtggatggatgacctgaggtcaggagtttgagaccagcctggccaacatggcaaaactccatctctaataaaaatacacaaattatctgggcatggtggcagatgcctctaatcccaactactcagaagcctaagtcaggagaattgcttgaacccgggaggcagaggttgcagtgagacgagatcgatcacgtcattgcactccagcctggacaagaacaaaacacctcaaaaaaaattaataaataaataaataacctaagtctatttgggtgccaaaaaatgtgtattctatttggacattacagtggattgacagcatagaaattatttattaaacccatcctactggacctgaaggtgaaccccatcgtaacagggtgcctggtagagtcattcttaactagccatcgatttgtaaaaaattgcaaaagttgttttttttttgttttttttttgttttttttttgttttttgagatggagccctgctctgtcgccagactggagtgcagtggcatgatctcggctcactacaacctccgcctcccaggttcaagcaattctcctgcctcagtctcccgggtagctgggactacaggcgcccacaaccacgcccggctaatttttgtactattagtagagacagggtttcaccatgttggccagaatggtcttgatctcttgacctcgtgatctgcctgccttggcctcccaaagtgctgggattacagtaaaaatttcttatatcaaatgaccgttcttgaattgttaccttggattaacagggagcaactattggcatttccatacagcaatctactatctggggataatctagctttcctggagggatggaaacaaagtgcataatggttgtttaccaatcatataatatcagacaccaataatttgtcattcactctagtgttctacaatcattagaggagctattcaactgctctcagacataccagctatgatcatgtaggaaacgtgattccgtgggctgaatgtaccaactcttcactaacatctcaatactctagactgaagttaatgaccagtgcaaaccaccagagtattacagtaaaagaacagcagtaaaaaggccttaataaatcagaaatttaaattggctattcattttagttacagccattcgtcagagcaaagtgatggtccaattcacctatgcggtaacttacattgatcataacagtactttaagtaatatcatccattaatttattaagcaaatatttgagtaatacctactatgtgtacaaccctctgccagatgctgcaagatatattcagacataaaagaaacaatcttaacctttaagaaacttgtaatccagtaggagaaaaagacattttgtagaagtcttattcaaataaaatatgattccataagataaggctccatctaagctctctgcattgcaaagctgatggcaagaactacatttcccagaatactcttccctggatggttcgagtgaagtttaccaataagaatagagtgagatgtggaagaaaaagagataaagaaactgttctttggaagtcagacaaatgtgcacaaatgaagtcttcctcattgctgtacattgagagatgtccctgctttccttatcgaaactctgatctgtctatgagttattaacacccttgtcagtaatatcacttgtcattaggtcacaattcttgggactaccattgtctaggttcttctattccacatgctttgtttctgtgcatgttgagtccaacatgtgtgtatattttaggtagtgtcacctgtttggatatccacaagacctatttacacaacacctgttacaaaaactcaccccagatgttttcttgtttgttcagtttaatttattatacaaatcttcacatttgaaaatataagcaaaagtgattctaagccactacaggaaattcacaaaagcaacacctggtgtcaacatatttcatcacattttaatgattatgatgtgcacaggtgtgctgaaagtttctcctccatactctttgattcttttttaaaatttttttaattatacaagtaatacacttctagaactaataagcaatcatagcaagcttgtgggacaaaagttaatatacaaagtcaattgtcttcttattgctagcaatgaacaattgggacttgaaattaaaaacacaataccatttacattaatgccaaaaatttaaatacttaggtataaatcaaacgtgaaagatctatataaggaaaactataaaactttgctgaaagaaatacaaaagatctaagaaaaaggaaagctatccacatacgcagacaggaaatctcaatattgtcaagatatcagttcttctcaacttgacctatacattcaatgcaacctcagttttaaaaatcccaagccaaagtaaaagccatctacggcacacagcattccgaaaggtttgggctacctgactattatggcaccaagaaatctctggtatatgagaactttcactttaattcaaaatgttggatgacctgattttcagcagaaatgctcttcaaatcagtttcacttaggctttttggtgtgaagtgaaacgatgcagacaatgagctttggagaatgaggaaccactgaataacttactatggaagtggatactgacatggcaaagaaacgacagcctggagtttttaacagaatgttcccaatgagcaggacctgaagatgtttcttcgttccaaaggagctagcaaagaagtgattgttagcatcatatcaaaataactaaaagctataacacacactcttgaacgtctttcaaaacaatgggatctatgaaggattatgatatcagatcttgatactgtaaatattttgggccattctcctgaatgctttcttttgtcccatgaaaacctaaacttagggattctatgagttcctctactcagctggatttacctgtaaatgcctttgttgattgttgaccaatgtcccttgtaccttttccaatagtctcgatctgaataaacagatggttaaagttttgcaggaagtatatttttcattgggtcacaatgatcccacagattttgtaagaaagatgattttttaaaaccctttcatcttaattcagggtaccaagcaggtaaaaactaacattgaatttttacaggcaagtttcaatttgaacagtagggaattgctattttaatatgtggtccaggaaccaaaatcctagacctttccaatgactatgccaaaacaaactacacaaatatcaaacagaagctgttttctctctgaggtactgaagaagaggtacaaaagcttgccttaagttatccagatgtggggaaaaaaagttatccagatgtgatcttttggcagagaaaaagtttagtgagaagaatattttagcttggtgcaaaagtaactatggtttttgggcaaaaaccatagttacttttgcaccaatctaatggattgtctcatagaataataaattagccttctgtgaaagtaatttgtgataactgaaaaatccttgggttctggattcaagcataagtactttataaagtcaaatcaaagaattagtaaatgctggctgtaacttgaggacatcaagcatcactcttctactctggagttaaaaaaaaaagatacaaagtaaatttaaaaagttaagcagaacactggggaatttttgaaagccagtcatataatgtagtggtatcttttcattttgaatttgggcctttcaaaaaggaggggtatgatttcttaaccacagatatatatatgtaataattctttggctattttgttttacaggtttatggaaactcatggttgatatgctcaggtgcagtcctcctagctacctattttccagtttgaattactccaacataccattatttgatacaggctgtgctgctgtagagatggtagtgccatggtgatttgctacacagatcatcccatcacctaggtattaagcccagcatccattagttactcttccttatgctctccctcccagcagcacccctccaacaggccccagtgtgtgttgttccctccatgtgttgacgtgtgctcattattcagctccctgttgtaagtgagaacatgtggtgcttggttttccgttcctgcgttaatttgctgagggcaaaacctgattactttgaaaacaagttctactgtggcaggcagaatcatggccacacctaaagatgtcaacgttttaatttgaagaagctgcgaatatgttatgcaaaaagattttgcaaatgtgattaagttgaaatttgattaagttaagggccttgagatgaccttgaatcatctgagtggacctaatataatgctaagggtccttaaaagtggaagaaggaggcaaaagaggtcagaatgatgctgtataagacagacttgaccactttgaaggaggtgaaaaggaggctttgaagaaggaagggaccataagccaaagaatgcagggggccacaaagaaaactgaaaagccaatgaaacagaatctcccctaaaggccccaaaaaggaatgcagtacggctggtaccttttcagcccagtgggcccagtatcatacttctgtcctacagaaccacaggatgataaatttgtgttgtttgaagccactgagtctgataatttgttacagcagcaaagattaacatagcaactaagtagatgatttgttgcattataggtggtcacaaaatacaatcctttagtatcatgtattttttcctcttacaagagtaattacatttaaaaaagctatctactgttctagaatcactgtcgttgtttacaataaagtcctttaaatgtgcgcataaaaaactaaatgtgaataaaatgtaaataaaggaatatttttgcctaataaatacaaagaaaatgaaaatcccagcaacctattttttgtggatattaacaaactgattctaaagtgtacatggaaaagcaaaagattcagaatatgcaagacaatattaaatgagaagaacaaagtaggagcactgacactatccgacttcaagagttagaacaaagctatagtaattgaaacagtgtggtattggcaaaagccaccaaatacatcagtgaaacagaagagaaagcccacatagtcttttccacaaatggatctagaacaaatggatacccacatgcaaaaaaaaaaaaaaaaaaaaaaaaaaagaatctagacaaagacctcacactattcacaaaaattgactcaaaatgaatcacagacctaaatgtaaaatgtaaaaccatagaactcctagaaaataatgtacaagaaagttcagctgatcttgagcatgaaagtgactttttatatataataccaaaggtgcaatccatgaaagaaatcattgataagctagacttcattaaaattgaaaacgtctccttgatataagacactgtcaactgagaaagacaagccaaaggctaggagaaaatatttgcaagaaacatgtatgataaagaactgttatccaaaatattttttttaaagtcttaaaactcattaagaaaaataatttaaaaatgggcaaaagacttgaacagacacctcaccaaaaaatacatacagatggaatacaggcatatgaaaagaagctcaacatatattattaggatattgcaaattaaaacaatgataccactatgtacctattagaattgtgaaaattcaaaacaatgacaacaccaagtgctagtgaggatgtggggcaacagaactcacattcactgtggatgggaatgcaaaatgatatagcaacctcagaagacccgcaatattttacaaaatgaaacgtactcttaccatacaatccagcaattataatccttggtatttacccaaagtagttgaaaacttatttctacacaaaaacctgcacacagatgtttatagtaactttattcaaaattgccaaaacctggaagtaattgagatgaccttcagtaagtgaatgaataaacaaatcatggtatacgcagaccattattcagccatactaaaaagaaatgagctgttgagccacagaaagacatggagttactttacaggcatactgcgaagcaaaaggagccaaattttaagggctgcatactgtgtgattccagtgatgggatacattggaaaaaaaaaaaaaactatgaagagaatacaaagatcaatggtttgcaagggctcagaggagggggagggaaagagggatggctagatagaacataggagattttttagggcagtaaaactattctgaatgatataacagtggttgcatgtcattcaacagctgtcaaaacccataggatgtacaatgcagactgaaccataacataacctacagacttggttaataatagtgtatcaaaattggctcatcaaatgtaaaaaatataccacactaatgcaagtgttaattataaaggaaactgggggagtggtggggcgtaggcaaactctgcactcgttgctcaatttttctgtaaacctaaaattgttaaaaaagaaatagtgtattgatttcttaaaaccaaataatatataaatagccttataaaaaatgtcaaaccactcagaagtatccagactaaaacatttaactcccaagtgatgttttcacaccaatcctttcattcctggggcaaatgctcctcacagtttggtatttatgcttccagtctacttttgattttttttttttttttttttttgagatggagtctcacatggtcacctaggctggagtgcagtggcactatctggacacaccacaacctccacctcctggattcaagcaattctcctacctcagcctcccaagtacctgtgattacaggtgcccacgactacgcctagctacttttttgtatttttagtagagacagggtttacattacaatggccaggctggtctcgaactcctgacctcatgatctgcccgcctcagcctcccaaagtgctgggattacagccactagctaccgtgcccagccccagtctaatttttaatatgcttactattacacttatttccaaaaagtgttcaaacataaatggaacattttataaatatcattctgaaatttggacagttccttaaagcaactactagtgactgcactgagcattatgtgaaaaaaaaaagactccagaaaatacatgtgcaaggtggtcactatacaaacacacttttggctttccagagcattgtacagcaatagtcacatagtatgggctctagaaatacttgagtggttggcaattaagtcaagatgaaaaggaatcaggccattaaaatatagctacaactgggaggctgaggagggaagatcgctggagcacaggagattaagggtacagggagctatgatcatgccactggactccagcctgggtgacagagtgagacactctccaaaaaaaaaaaaaaatacaattacatggtctgacagttaaattctagagagaatcaacctttcatccacacagctagtatgccaatgaggtgtccactgtgtagggagaattaaccctctgcatttttcttaaggatttgagctctcttagctacacaaacataggaattgttatccccatcttagaggcaagaaagctgggagtcagggagcttaaataacttgcttgagatgactcaatgattggtgatggagtcaagattgaaaacccgggcaagcctccatgtctcacggtgcccctaaaagtactttctacaggtaacaagcacccaagtggtcttttcctcatcagtcccaaattggccgaaaagatcatctgtgaccaactggaacaggattatatccatatctcaattaaaaccatgtttccatttgccccttccttaaagcaaatcacagttctttatgtggattttttgaaacgtacaaatctagatttttttttttaacacattctggtgctcagttgcttaggaaactgcttttgtcattaggtgggaaggactaacacacttaagagagagaaaggcaaagggggaatatatagtaaacccagtgctgatgtgaattgtatccacagggactataacaaaacaatcagaactcaaagggaaaaggagcttttgagtgggttgtgaaataagctattaagtcatgcaaataaatccaatgtcaacacttcagcctgggctgattggatgcatgcattaaaactcatacttcataagaatttaaggcctctggtgttctcagtttttcttctttttcactttggggttttttggttggagggaggcatttctagagaaagcatgcctgctttacgctagaatcgctcatgaagtagagaatttgtgcatcaaggtttgaaacaatacattattccaagaccttgtccttcatcagtagtttcagcctttgccacatttctgagctccgtgctcaaaagaagcatctcttctcccaggctcctgcacccaaccaggcagggatccaacattcagataattcagacggtacacacattcatgacttcaagatgctgctgttgacagtcgtacaccttaacttgcagtgggtgcaaacataatcagccttttctcccacgaagcccatctttagaagcactgtgagatttttgcctgtcttgttcaagaccatacctacagtgcctagtgcgggacctggcacacatagtagatacgtaacaagtaatcactagtctgttacatgagcaagaaataacttttttaatgcaattgcgtggctgatctatttgtcaccaaagtgtaacctcccctgtccaatatgccatcactttattttccactgcaagcacaagatcttgcagctcaagaaagaactgtgctacatggcatgctctaaattcgacatgccatctcaatttaacatgatacttatgtaagccaatagtcccactttacagatgagatattggagctttatagaaatcaagtaatctagccacagtcccagagctaataaatgataggacaaggatttatatcccatcattttagctgtaaaacatgttcatttttttctttttaaatctgtgctgggctgtgttctgacctcaagtgaaatactgtgtgtttgtatcactcaactcgcacataccaaagtttaagtcaagagcctttatgacttataaaaaacaattgcttgagaggcactgggtgatacataggctcagttaaagcagaaggaacagcactagcatgtcatattggtaagatacaaattaaattgcagttagaaatggactgtcatggtagtaaaactatgggaagagcaaggaagtcctcgtttcggcgtgtcttcaggaacacaccggttaaccatctatttgcccaacccgatttggtctttaaacttgcctgaagaagccagttggagggaacagaaggcttctctcaaggtcaatgtctccctccataccccccacttcaggatctcctatgcatcaggcactgtgctatacaacgagtaaaacatagtgtttgcttttgaaaaattctacaatacatgaacagataattatggcagaacatgctaagtacaatgttatagtaatacagagaaaaacagaaaaactgactcagagcacattcaaaagggctgtttaatccatgcctaagtggagtaaggaggccaaaagttaatgaggagagcatcccagagagaagaaatggtagagccagtggtgtgaaggcaaaagccagtaggacgtatgcagagaagtccatgcagttcagtggtgccagaatgcaaaatgagaagcaaggagtggtaagagacagcaggaaagcttagcttactttttaagtcagccatgctgagcagcttgggcttcaacttgacaatgatgaacacatatttggcaagatttggcagaggacaggttggatatgaagtttagaaaaatccctacagctggtgtggatttgaatggaattggacagaagaccagcccaagttaggaagctgatggagagtcccagcaaaatacaggaatctgagcaagttttatagttttataaatataggaacatgaatgagaataggaatgaagagagaggactgctttgacaatgattccaaaagtaaaatattcaagaagggtgggaatggagtctaccaagaagaaaaactggataaaggcagaataaaaacttggaataaataatattactgaaattacttagcaatgttaataatgttaaatgtgtctgtggtaggcctgaccctctggctgtccattattccatatgtggtcttttctgactggcttctttcacttactgtaatgtttataaggttcatccatgttgtaacatgtatcagtacttcattccttttttttacaagatgatattgaattgacaggatatgccatgtttgtccattcagaaattgataagatatttggcttgtttctagtttttttttttgtttgtttgtttgtttgtttttgagacagtcttgccctgttgctcaggctggagtacaatggcacaatctcagctcactgcaatctccgcctctcaggctcaagcaatcctcccacttcagcctcccaagtatctgggactacaggcacatgccaccatgcctggcaaatttttgtattttttgtagaggtgaggtttcaccatgttgcccagactggtcttgaacttctgagctcaagtgatccactcgcctcagcctcccaaaatgttgggattacaggcatgaacgaccacgcctggccttgtttctagtttttagcaaatttaatgttgctatgaacattcacgtacaagcttttgagtggacatatgttttcatttctcttgggtatatatctacaggtggaattgctgaatcatatggcaattcgtttttcaaccttttggggaaatgatagactgttttccaaagtggctataccatgttacattctcaccagcaatgtatgttcaagttcctctatgtcttcttttcaattatagccatcctatgaggtgatgtggtatctcactatggttttgatttgtattttcttgatgactagtgatgctgagtatctttttatgggcttattggtcatctgtatatcttctttggataaatatctattcagaccttttatccattttttaaattgggtttatacaaatatttatatattctagatacaagtctcttatcagatatatgatatgtaagtattttatcccattctgtggagtttcttttcagcttctggatgttatccatggaaacacaaaagtttttaatgcttgtgtctttttccatttgttgcttgtgttgtctttttccatatgttgttaagacatcatatctaaaatattttgcctaatccaaggccatttgttatgcttatgtttccttctaagagttttatagttttagcttttacatttgaggccaagattcattttgagataatctttgtatatggggtcaggtaaggatccaaattcattcttttgcatgtggagacctagttgccccagaatcatttgtttaaaaggtttttaccatgaattgtcttggcagcacttttgaaaatcagttgatagtaaatgtgagtttatttctggaatctcagttctatgccattgatctttattgttatgtcagcactacactctcttgatcactgtagagttgtcatgagttccgaaaccaggaaatcctccaagttcgcactttttttcaagactgtttcagctattctcaggatcccttgaatttctgtatgattttaggattatcctgtcaagttttacaacaatatctgctgagattttgataggagttgcattgaatctttatggcactcaacaatttttggcacttttaacaataactcttccaatccccaaacataaaaagtcttgccttgtatttagatattcttcaacttatttcaaatatacataaattcagagtttatattttttgttgcttttaatttattcccaagtatttattctttttgatgccctcataaatggaattttctcagtttcattttctgattgtctatcacaagtgaatagagagaatgagtttgtgtatattgttcttgtatcctaaaaacttgctcaacttgtttatttctgataggttttttagtggatttaagatcttctatatataagattatgccatttataataaagtttttcttcttttcaaatatgaatgcagtttctttttcttgcctaatttccctggttagaactgttagacaatgttgaatggaaatggcaagaggggatatctgtgccttcttccttatcttaggggaaaacactcttttttttttttttttttacgttaagtatgatatgagctgtgaatttttaataatgctttttatcaggttgagaaagtttcatactattctatttccttgagtgtttttatcatgaaagggtgttaaatgtttttcaaatattttttctatgtctattgatataatcatgttgcttttatcctttattctattgatatgctatattacatttattagttttcatatgttaaaatgatcttgcatttctgggataaattccacatggccatggtacaaaatatgttgctggatccagtttgcttgtcttccactgaggatttttacatctgtattgataagatattggtctgtagtttccttgcattgtgatgtctgtctgttttggttaacaggatgctattggcctcatagaatgtagtgataatttttggaagagtttctgaaaaactgatattaattttttaaatgtttggtagaattggccagtgaagtcatctgaacttggacttttatttgtgggtagttttttattataaaaaatatatattcagtctttttacttttgatgggttattcaggctttatatttgtagaatcagttttgtttgtatctgtttaggaatttgttcatttcatccaagttatccaattcatagtcatacatttattcattgttttcccttgtaatcctttttctttctgcaaggtgagtagtaaggtccccttttttaatttttgagatggagtctcgctctgccacccaggctggagtgcagtgacaggctggagtgcagtggcgggatctaggctcactgaaacctctgcctcccaggttcaagcaattcttctgcctcagcttcccgagtagctgggactacaggcatgtgccaccacacccggctaattttcgtatttttagtagagacggggtgtcaccatattggccaggctagtcacatactcctgaccacgtgatccgcccacctcagcctcccaaagggctggaattataggcgtgagccactgcgcctggccaggtcccactttttattcctgattttaataatttgagtcttctttctttcctgcttagtcagtctaggtaaagttttctctggtttgttcatcttttgaaccaactctggttacattgattctatttttctattctctatttcattaatttctgttccaacctttattattttcttctgctttgtgtggtttactcattttatagtttattaaggtgaaacataggttactgatttgagattttttaaaaatacaggtacttaagctatatgtttccctcaaagccctgttttagttgcattctatcagctgttatgttacatcttcattttcatcaatgacataaaattgtttctcattttcattgtgattttttaaattgactcattggatatttaggagtgtgttgtttaagttctgtgtatttgcaagtttccaaaaatatgttagatttctaatttcaccttattgtagctagagaatatactttatatgatttcaatcatttgaatatattgaggcttttatggcttagcatgtggtatatttggaaaatgttccatgtacacttgagaacaatgaatattgaaggttttatctctttctctgatatttctgttgtctgcctcaattggcctcacacccagctgttatgcttcactaattactggataatcattctattgttttgaaaaataccctagaggcataaatttctccacagtctgacccaattaaattcaagggcctttgggagttagatcttcaggccaatttttcgttactccaggagggctctcttacctttacctttctttgattctctctgatcatctaggtaatcgatgggttagcttgtagattttatagagctaccagcctccttttaatggcttatcaccacaatgtctattgctttggacaatgaccttagttaggcttgacattccccccactgtttcaaatgaaatcaattcctatgagcttcagagttcttatggactgcttctacccctagcaaaatctgagcctggagctccagagctggcaggcagagtaacacctatactttctgagtaggggacttgttgggggtggcagcctctggctttcttagcttgcctctctcagcttgcctctctcagcatagaatctgcctatgagtaagctgaggcaagggggactggggcctcaatattctcagcctcccatacccggggtagaacatccacctaattagttgggggtaggtggaagaaggtaattcctaaactttccgccactctcaccaagaacttagcctctgcagtttagggcagagggaatgagaaattctagtgacctgttcctcagtgagataccatatcccttgactggaagctgaggggaaaggcagcaccatctctttggccacatctgcccagagtggaggctccatctcacagagctacatgaaagggatagatagcaggctgtgtctgacatgctacagactctcatgttcttagggagattcttcagatttgctcacataagtgcttttgatttgtcatattccattacaataatttccagagactttaaatgagtttctttatatttttcatcagttatggatgttttctgggaaatggtccatggaacaccttattctgccattctggaaataaaactccaagaaacttctctttaagcctctgagacttagaggttgcttattactgcaggaaagcctagtttagcatgatgaaagccgtgtctagtattaaagcagaattaaagtcaactcaaggaaagtaaaatgattttccaactctatctttctctgataggttcttgtcccttaaagctgagtagccgtcactggccagattctagaataatgcccttcctgtttttcttttgttctgttgtccccacttgattgctttaatgtatctaggtagactgcctctattaagaagtcccaagttaatgtaggctacttgcagtctttgaaacacagtgcccatttaaagatgacaatcctagaatcataagagcagggatacaaactattttattcactctagtattctcagagcctaaaacagtgtctggctagcctgacacttgatagctgctcccaaaaggtattttttgaatgacagtgtcaggaccttgctcctgttcctttgttacactggctgccctggggatcaaagcgtatgggagggctatttgtcttatgttatctttctgaaagtatcctcccagagactggttcaaacaggaaccctacctgactcctatgtcctaaaggactctatcaataaagtattccaagattcttctagccaggaggtctggcttcattttcgaagttatctcagaaacctaaagtgtgtactctggtatcattaactgatgtgacacaactagtgtgattccatcagttttataaatgacaaccagtgtgaggaagtcgacaccaaaagaagacactactggacagaaggcaaatgattttgaataatcagcctctaccctattcccccagggagactaaaatgcctaagcaatgctctcgttgatcacaaaggatacatgtttgtcctcttgtttagagttgcaagaacccactctttccaaagcaatcaaaatcctatattaaggggaccatgtctagaagctctggaaaattcctggaatagtaacacaaaaaaggagtcactgtaccaccaccacaagcctctctgggaactaattgtgttctagatgcaagagacacttaacccagcatttgtcttagcagtgtctgcctactatgtgagccttacgccatccctgagactctgccaggcccctgcccatccactcaacacttacagttgaactttgccaggaaatctagctcatctagttctccagctttctaatccttcctctcacccaagactgacccactccttgtcctatcttgacgtccctctggtttatacagagtaattaaatcactggttaattgatgaattcaattaaatcaatgtcttacctgagtccctgttaggattctttaaccttttttggaaaatagccacatgtcaaatttactcacttcttcccaggtcattaaaaaaaaaaaaaaaaaaaaaacacacagaaataactgagtaaaaaacactctcaatctttgccctcttggtatcagctttgagacacctggccaagtacagcctgtgctaagtttcaaagaggaggcagataactttgaagattttatttcacaggggacaacagataaaagtctctgtcaagttgtcattagatgcttaatgctattcttggtggggagcttgaggcgcccctcctcctctgtagacttctagcagattaggtttcagagctttaatttgaggaaggatttacagctgtgaagaggtataatatcattttgatttgggttgtactaggctggggaagccagattacatttgtatgaaactgtattagaccatatgactgaaaccaccaaaatcaaataaagggaaaattttccagagagcctaaaaacaagagcctgtctttccagcacctgagcattgtttcactaactattattctgatttacatctaggggatccatgcagaaatgcggagggagatggcaacaatgcctgtgcttgctggacctatccattcattaatctgtcatcaacctaatccaggggcccatcccctagaacaagaggaaaaaaattaacacttagagaagaggggaagttggcagggggaggggagataactttatgaaaaatagccttctttcatctccggaggcactgtctaattcagagtctcaaagaaatccatcaaattgtctctctgggcctcagtccatccaccgccaccatatgctaccatgtgcgtgtgtcgcacggcatccccagataatgacttacgtgggcaccgtgcctttcctctagaaccatcttaatgctattttaaaatccgactctcatttgcatggaaaacaataaatcactttgggtaacacagaaaacccagtttcttctgagatgaaacatgaaaaaaagagttagctgttgtttgtaccacacagctacacagaactgggcagactaccagcatcttctactgggatttagagatggacgcaagaaacaccacgggtaggactctgaaaattgaaattatttttgtgccagtctctagattcaactagaatgtgctcttggctggggagaatttgggaaagaagtgttttttttttgttttttgtttttttttaattgcaactactaagtttcaaaaatgggggaaaatcatgaagacagccacagacatcttcaggggctgactaattcttaaatgattggttcctctaagagtggttagtggtgaaagagtaaatgatgtatgagaacgatttctctgatttctgccaggagttctactcactcagtaaccacagggaatagaaggatcaggttttccacagaaactacttttagcacatgctgtgtttctacacctgtacttctcttccgaacaactatcttagctccaagttgacatggcccgttaccaaggggctccatgtcttttgtttttgtagtaaagatgacttgaatacagaagaggtgttgtaggagagcgcgtcttctccaaatgctggcagatgacagtttccgcagggacgtaaagaggtgacaaaggcacagaatataatttagtcctgatttccaggtctggctcacaaaactaatcggatgaaaatgtggccaaaagaatacctcggagataaactttctagaacaagctaacgccataatttgaccctaattccaaaaatcatgggaaggacatacttcttagtatctttatcttattctcaattaatcaacaaaccttaatgtaaataaattttctaaaattcattgtcaccgaggaaagggttaaaaaaaactaaagttctcttttgagaatggatttctttccctcactaccttcttagacaatacaacagaggttatttctagacccagaggagacaatgcaacatagcttctccagcctttggacactaagcaagttatcaataatgcagaatcttgaaacctgacactaaactccttcagaggtaggtatcttgtgagcaaaagagaacagagtaaaaggggcaaggatgggagagtgtaagaagaaccatgctgtggacattttacttcttggggtgttagtttccttctatgcaaaatacaactgtagattgccacaagcctaaacaaaatctgtaagaaataaataaccttcaaagcaatttaataaaaagaaatgtgcccaaaatatcctcaaagactttattaatctagggaggcaatagttaggaatatgagacatgagtcaaaccacctgattccacatcccgattgcacgatgaactagctgtgtgatattgagcaagtgacttaacccccagatttcctacctgtataagaggaataatgaaagctccacaactactgcaaaagctaaatcaaataatatgtgtaaagctgttagtacaatacctgcccccacagtaaacacacaataagtattagaaatacaacaaattattatatttaagtataaagcggtaatctgtacatacttggaacatttctgacttgagaagctataaaatcatggatcaaaacagttgtacaaaagatggtgttatgtgaggtcctttggatttaatataaggagccaaataaaagcagtccaaatttagaaaaatctttcaagctattccgcgatgactgtgtctgtcatcacttgggaaaggaaactgtatgctactcgcattctagagagctgttaggaaatgctagctgaccctcaacaaaccttcagcctccccaggaacacagttaggcagcttaatttgggcaagcgaggagaaagcatgagcccgtacccaagcactgcctggtttccatctgcgcgatttaaccacaagccacagagcgcctctgcggacaccaagtccagctgccagggaaaggtttcagacccacggtggtgtcccaacaatttccagttcagtggaaatctggggaacgcacaggctcatagcatatgatttcttcatgtttcattagtttccaggttttaaacaattttaaccttctctctggcacagagctgctgtactgtaagtagaaatcactggactttgagtaacatgagcctgtttcacgtttgtgggtggacatccaattggcacagtgaccttggccatgtcctgactcctctgagcttcactttcctcatctgtaaaatgggtgaaagccaacttcagtgagttctggggacacaaacatgtttcacatgtgcctagatagatgctgttagtctcaactcatttgctatcctgaacttaaacgggttgccaatctactctcacaccactctaaaacaacaaaaaaaaaatcttttcaaaagctaacaaactgaactaggagacgaagaaagaaaattcaccgctacataaattagccaggagcaaagcaagaagctgcccgagtagggcagttggcttcccacaattgattctttaataacttctgtaatatttctgaggcacatcaaaggacagtaacagcccagtgttggtaatccctctcacatataaaaactttcattacagagtgttaaaggcatcactctgcttgagaaatcgcaatcaatagacgttggccttttttcttcttttctatcctggggtaacggcaccagcattttctctccagtaatgcagtgctgtgtggccagagtttcctctgatgctgcagacgagcaccaagatgaaaaaatctttgtgataaatgagaaagaggagaagaagtttgggagaatacctctctgtgttagaaacccgaagtgttccatgctaattcaccctaaatgctgtttgcaaatattggcttagacatgcatttaaaagtcacagggatttgttttaacatgatttcttttgcattcccatgtggaaaataccttattttagagtgagacgccatctctatttcccaggctggagtgcagtggctattcacaggtactatcctcaacccacaacagcctcaaacacctgggctcaagcaatcctcgcacctcagcctcctgagtagctagagctactgcatgccccactgcgcccagcctataaaagatttcaattgaaaaatgtttccaattagcaccctaagagcaggataattttggaatactgcagcagatcttagggacacaaactaaaaggacagcaggcagtcattaatttctttgttccttattatctataatacaattgttagagtcagaaatataaaattacttgcagaagtttttttaaattcagcctatttgtttcctttgaaagattactccaggttctttaaaaagccagaatcacatttttctttttattatgaatgcataaaggccaaaggccactcatagcatctccctcgtaaaccgcatcttgccaaagcccgtggccaatttctggcctccctttactgaaccacttagtggcatttggccagttgaccactcccctccttcataagccgttttcttgcacataaaccccccaaccacactaccctttccccacctctactacctggctccatttgtcttcatagttttataggaatttaagtcatctatttgtgtgtatgtttattatcttactccatgtcccatgcctagaaatccctggtaagttgtagatactccataaatatttgctgcctggctgactcttagtattttcttttgacagattaaaagctcagaggagtgaagccacttgcctaagactgcatagtaagtggccgagtcagaattggaactctgagcccatactcatgacctttatataatagaaaaagcagcctcgggataaatgtccaagagcagggttggcaaacttttcccttaaacgggcagacagcaagtatttttgcctttgtgagccacatatatatatagtctcttgcatttttaaaaaagaatactttaaatacataaatctattattagctcaaagggtcatacacacaggccacagctgaatttggtcttagtttgtcaacccctgctcaggagaataggagcattttctactggattcatgactttaacccaggcccaagaatcctgtgcagaatcaattaagctttgtacaatgattttttttttttgagacagagtcttgctctctcgcccagactggagtgcagtggcgccatctcaatctcggctcactgcaacctccacctctcaggttcaagtgagtctcctgcttcagcctccagagtagctggaactacaggcatgcaccaccacgcctagctaatttttatatttttagtagagatggggtttcaccatgttggtcaggatggtctcgatctcttgacctcatgatccacccgccttggcctcccaaagtgctgggattacaggcatgagccatcacgcctggccagaatgaatgaattttaccttcatcctctagacaacaagatcctcaaggttaccagacttgggcatgtcctacagttaaaaaacagttcactttccacaaaagggagctggataaattcctatggatggacacaatgatcaagaggaggaagaatcctgataaattcctatgtagtaagagaaaataacgcaagatcaagagtggcaaaatgctgaaaattttgtgttattctttttccaattaagaggctttcccccgctatgaagtaagcaggcatcaccagaagtgagaggaggaaaataaccgctctcacctctccagcgtcctgtgctcctatcctgctgagactgtcttttggctactacataaaaagccaaaaaagtgagtccttcacagcatgaggatacttttagctgttggacacggagaaggttttctcttggtcttttattcaatcattcacagaaagggacatcctgtgacctcattttcactctaaagtaacagagaaagccaagtggcttcctgactctgggttctatagaaacccttgctttgatggtgcctttctcctcctctgaggccaagtcatggtgggggctggtggggcttccttccatttccaagacaggtggatctccttgggaaacagctgctgtctgggaatcctggcagcaccagggatagagagagaagagaagctccagtttcaaccctctgagtcactgcaaaagaatccccttcattaaaactagttctcaagggaaaggtgcttagagaaaaaaaaagactcagcaaaatgcataggacacttgggtaggagacatttcattatggccactttgatagcaccactttgaagcagtcattttgattttggtatgaaacttcttggaattttagtagaagttagagaattacctaagtaaatgctttttgatcaaaaataatttatatttgccagtttgtctttcatttctccccttaaagataagggctatgcctgtctcgtttaccattccatctctagtactcaatatggtacctcacatataggaagggtatatttatttaaaaaataactactatgaccatcactactactgcctatgtccagtgcttacattagatacataataatttgttgaaaaaatgaactgctaccatcactactaccattattgccacataattactattgtcaccatcattattcctattggctgtctattgtaaagccaatgggacaagcattatgcttagattatttcaattatcattcccatttcatagatgtgaacactgaagtgcagagaagtatcctaaaacatatatacagtatgtggtaaaaaattgaattaggttattattatgattagtcttgtcaagtaaattgggagaaatgaataggctgagagataaggataaggttgtacttagtgcctctattttggacttttaagcatttcttttcacggaaagggaccagggattcttaaagaaatgactgattccagatctgctccaggaaatagacatgatgaattggcaaattttgttgtggaaagctatcaaaacctactagagtaatgtcaaaaggacttggagctaacttgaaaggggctcccactggccaagacaaatcaacttcaataaaaacaatgaaagtggtagaatgaaatagatcaaatacacaaacattcaaacatttcttaagagtaaaaatcaatggtcacccttagaagttgccaggacaccaacttatgatttagaaaatattaacaaaaagaaactaagggaaattaaacacttaccctgcctttcctgtatggacaacctttcaaagtaacaacacgacatggagggaacgtttttcctcatagaggaatcacagttaataaaagcaggaggaatgacagatttagaaaatcaccatttcacagctcttaatgaaataatgggtctagacaaccaccattcatagctgcaaaacctttgccttaaagcttaattggaaacttgatatttaaggcatcacactgacaacatgtgaatctaggatcaatcctaacttaactaaatgtgggataatagtacattacatcagtggttcccatactttgaagcacattagaatcacttggggaactcttaaaaatcttaatgttcaggtcgtgtaccagatcaatcaaatcacaatgtctggggtaagagtatcagtaattttaatttgagatgttttaggtgattccactgtggagcaaagttcaggaatcttttcattttatggctcatggtgtgatgctccctatgatatattaatgttactatcatagggagatatattaacatcctatgatatataaccaaatatttaccagaaacagaagaaacgtgtttaagaatgactacaaaaatgcaaatcagaaatcaaatgtgtgaaaaattcaaagagggtgtgaatggcatatcttctcaacaaacaaatgtcattttaaaaaatggtgtgttgggggtgggaatggagggctttccttaaaacatgactggaaaagttatgcttctggctatgaatgaataacttcatacatcagactaatcctcctgcagaaagtaattgtgatagatgcataaattaaaaaaaaaaaaaaagctgttcaaaagcatcagagcacaaccaaggcatgcaagattcaagcatcctagatgatgtaggcaaagaaagcccactgaggtgagctctatagttaaagcaactttgtgtcctaagggcatttgcgaatttgcatcgtgagggaataaaccaagtagaaagcagcagctagagcttgatgcagtttctgagctagagagagaagtttggaagttaagggctatagaagcagcagctaggacttgagggactaagatttgtgagaacggtgaaccaaagaaaagtgatcccaatactcctaacgtaatttccccttgagatatttgcaaattcctaaactgcaaacatatgaagagaccaattaactaagcaaaaatcaatgctaaaagaccaaaaacgaaggagccattttgtcagtctaaaagggttggggagacaaaattgcaatttagaagacactaaggagaaagggccatcgtaaatgccccaaaatttcatttgagaaactcaaaaggcttgaattgttaggacaaactagaaatagaccacagaatttgaaaaatatcatttctggattaaatcaatataacttgcttatactgtatccacctgccagaatgttaacatatctctgcaagaagataaaatccacattaaaggaaacactaaaaggaactaaagggggttatttgggcagattaaaaatttcccagatgaaagcatagaatgtaggatggaagaaagagtactaggtaaattggggtaagtaccactctaacaatttaatcaagagaaatgaatacatgtccacacaaatatctatacataagcagcttcattcacaataatccaaacttgtaaacaacccctatgtgaaccaagtgaatggatacacaaaatgtcgaataaccatacaatggaatactattctgcaataaaaaggaacattaacacatgcaaccactattctccaagtcattatgttcactaaaggaagcgagacacaagggagttcatattatgggttaattcattaaaaatcctagaaaatgcaaaatcaccgctagtgacagaaaataaaatcaacggttgcctgagagctgggagtgacagaaggaaatgtccacagtgtggcacaaggaaagttttaggggtggcagaaatgttctgcaccttgattttggtggactcatgggtgtatccctcttttaaagctcaatgaatgaattttacatgggcacagtttattatatacacactataccccaataagctttttttttcctaaaagacagttgaaattccccaaagacagatcaaaaagataagttgctgtattattctattgaagtttaaaaacagataaaatcaatccatgattattaaaatggtgtatatcttgcagagcaggtgttcacttagtgaacaggaaatttctgggtactagtgctagtgagtggtattttctacatctttgagaaatagttacatgggatgtttattttgaaaatatttattgagctaaacacttaaaatgtgtgcacttttgctgtttttgtcatacttcaataagaaaatttaaaggtggaggattgagagaaattaaagaaaatccaagagacaaagcaaccaaaggcaatgcatggatgtcatatggcttatgattttaaaaactcaactgaaaaaaatgtgaggaaatgaatgaaaatcaaacatggactatttatcatatattaaagaatgcttgctcattttattgcatgctactgtgattacatttaaagtccttatctgctaaataaacatactaaagtatttataggtgaaataattgagtaggatttgctttaaacatcagcaaaaaagaaacacacaggccaggtgtggtggctcatgcctgtaatcccagcactttgggtggctgaggcaggaggatcacctgaggtcaggagttcaagaccagcctgaccaacatggtgaaaccctgtctttaccaaaaatacaaaatttagccaggtatggtggtgggtacctgtaatcccagctacttgggaggctgaggcaggagaattgcttgaaactgggaggtggaggttgtagtaagccaagattatgccattgcactccggcctgggcaacaggagtgaaactctgtctcaaaaaaaagaaaagaaaaggaaaaaatacatgtgctcaagtataggttgatcatcatggaagttggatgacagatgcatgagaatccatactattctcttgagttttgcatatatgtaagaatatttttacaaagtaaaaatacaattcaagtgaagatgaggtacaaggatgaggcagagggcccaggagggtgtgaagatgtctattgtgcctatgacctatattctattctttgcactttgaagattaaaatacccacagcatcaaaatggctatgtcaaaatgtcttgcttcagaatttgcatggcaagaattttctcaggggcccagaaacatgacaagcatgaaaagaatgaaatttacgagagtccaattaggtcctgaatgacagccaggcagatatatgatgacaaacagtgtccttcgtttctccagagactgatctactttgggcccaaagagaggaaagtgagcttgtataatcctgggaatttcaccatccttcttctggtccctagttatctccatctgaagcctattcaggttttggaagggagagaataaaatgggcagccaaaaaccagattctgatggcatcagtcagaatcctgacaggacacagatgtcatactcctctgcaactttgaagagaaataaactattttcagaggtggaggttgggttacaaggtaaggatttgaagcccctggtactagctacagcagaatgcctttagtatcctgggcctaaaaaagcaaagaaagagaacatgttatcagagcctggtgaggtaaaggtgggtgggttaggggtagggggtggggagtgggacgactatcatcactgctacagccttgaagggacacagaccctgaaaaacatgatgagaaagacttccatgggagtaaacatcccccatctctctctctctgcccattgcctggtctctttccagtacctcccattgaccaagcccaaactggaagacagagacatggaagcccaggtgacacagtcaacctcctgggtcaacaagcagggcagacaaggtcgcctaataggctaggaaggcgggggatggagaattaccagcacatgcccccaaagggtaatttacaccacactggaatacataagatcttcaaagccacagttagttagaaatgatggccatttggcaaaagctaattcagtcagacccagggttgcagatccttaatttaaatggaactgagtatttctaagcatttcacaagaggcccaaagacaatgaatgataacagattctttacccacacacacacaccctccccatgggggaaacggtaaggagctactcatgctcattctcaagtttgtaaaacaaaaatcttttcttctatattagaaatttccaaagtaaatgcacaaaaaaggggagaaatgtggttgcattttccattgggctttaaccatcactctgcgaaagagaagagttcagagcaaagtcatcacaggtggaaacaatctcaagatcagatgggagaggagtatcctcttccccccacctcccccgctccaggggtatgtggtcctctcttggttggtgatgccaaccctgcttcctctggccctgggttttgtacctgctgctttctctgcccttaatgtgctttcctcccttccttcacttgttaactcctattcctatcttagctcaattgtcactttccagaggaaactttcccatgttcactaatgaggtcaaagcccctaagacatactgtcatagcatctggaacttttccttcatgaaagcactttcacagtttttggtatggctgtttgatattgtctatctccccagctgaactggtagttccacgtggcaaggactatgtgtatctttgagtaccattgcatttccagggcctcacatataatctggctcatagtaggcacccaactattgtcgaatgaatgagtcttcactgcaagataaagtgacaacagttttccactctagagaccatctacgtttttccctttcaatgtacaacatgattttgttttctttcccccaccccccacagcattaaattactggaaacacatcctatgctcatagatgggtagaatcaatattgtgaaaatgaccatatttccaagagcaacctacagattccatgcaattcccatcaaaataccatcatcattcttcacagaactagaaaaaacaatcctaaaattcatatggaaccaaaaaagaacctgcatagacaaagcaagactaagcaaaaagaacaaatcttaaggcatattacccgacttcagactatactacgaggcagagtgatcttaactgtaccaagctaaatcctacatctagattcacagatgcaaaagtgtttaataaaaccaagttacttgcattcttaggctcatgtagatgctgtacgcagatggtcttctaaataggttttagatatgtcaaaactttctccagccacaaagtcaagaatgatcaccttagggttgcagtatactcaattatttatactccttctatgatcaagggtagtagtatctgcattaagtagtttcctccaaaccagaaaggaacgaattggcagaatatatttccttgcctccagaaataacttatcatcattagaatcatctgatatttttgggatctggaatctatgttctgtatttgtgagggtaactatgagacttgaacagtccaccagggatcttaaaggcatgttttcaaaacacagcccccatcaaaacagtgtgctgttaccaaatatgtttgggcaatgccactgtgaaatttacaacatacactaacagagagtttgagaaatcccatggctggtagagcttggcaaagggaaatgtgtttccctcacatatctaactaggaaaccgtcatttcaaatacttcctcttactatcctgaaggccatattttaggaaatgctgcactggaggaaagatgttctagaatagacaggtactacaagactgaaaaagagaaaatttaacatgctttcctgctactgaatctattctatatatcctgtttttcttcataggtgtttgccccacaatatttttgttttctcattatctctaatattaaaatgggagaaaacagtaatacaagcatgttgaaaaactgataccgtgaaatattgaaaatttgaaattgattaatgttggttcctaaagcaaattattttactgaaaaaaatggttctattaatctaaatagatacatttattaatatgtgttgaatacataggtatgtacctaggagttttgtagagagcatgtctgtttagaaataagcatacaaatacataacttcatgtaacgagtatgctgaacaagcatgatccattgcataaaacacaacattttactctccttgcccctctaaatttgattaggtggtaataatcttcctttgcccttggataaaaactacagcaggcccacgagtttgctgttcacaggtaatgggcagttctaaaacaacttcaggttacacatacagtcccaggtgagaaaacaaactccacaaccatgttgcttttgtatggaatctttccccttctcagcttggccctgcttcagactgaaagcctccagatcaccctgtggcccctccaccttattagccagcattctgcctttctcaaggttgaagaaactaagagacagaagggctcctccttgtgctagttctgttataatctagcttggctgtctctgggcctggcagatagttagggctgacactttctcttttgataagcttttatggattctgcagaggtttcctgttgggttcttttctcaaacagctcactagatcccaggtgggtggccagggatcccccatcccaagccccaggtcatctaggcatctgccttggacttcatatgctacttttccatgactccttcagttactgtattgaagtatatcaaaaacaaccccacgttggccctctcctttgcacagtccagaactgatccccaggaaacacacacatctcatgccttgacaaaaactgggaaatattggccacttcgcaagcaggagcattcctaccctaccacccaagcagttggccagcccctcttctcctggccttccagagtttcagggtgagtctcaaatgcatgggccctctaaacttcccaggcttgatgcaggcacaagcctctggttttccaactgcaagaaataattcagagctttctgattagtcctcttaatgcctcctattggggttttgggttacaagatagtacactctactttttctcccaagagggtaatgatgactcaatacatggccacagttgtctctaaagagacatcttctcttgtctcctctggactcatatatacaaaagccatggaccaggatcatgactttctatatgaggcagctgtcttttggtcgctgtattatgggtggctctgtgaaactgagacaatagacaatacaaccattctaacatcctactacctacgtcgtacacatatatatgtgtgtacgtcatattttactatacggtttctataacaacttcaaatagttaacgctataagagcctcaacactccccaattcaattataatctccagctttcactgatcactgctgatttggttataaatgacttcacaaccaaaagcttaccttgagaatttttcaatccctatgttcccagattcaaataaataaaacctacttgaaatatgtggacttaaaatagtcttccaacgcattcctcacacatgaaattactctcgaataactagctattggtgacattcctgatagtgccctagatttctcaacttttgcaagagcccagatggtcagaaagaactttaccaaatttggttacttgtttttaatggaaggattttaaatgttcttttaacaatcatctcagctgcatttaaaggctacttagcagtgtttgcagctaggagaacagataattaccggagtgaactagcaaattcctactggttataacctgaaatgggaagtaatacatggtcaagaatgtaaaaaattacttatatatatatacatttacgcacacattttttaatatcaagtgagcaaaatggtattaaatctggttaattctgcccatgtccatttgaaaaacaaccgtgtaatttgcctaagaaaaaaattctctcatagttaagtcagatgcctaattatatcatcctttatctgggactgtcaaaaataaaacattttggatctattcacaataaaatgacattttcagattcaatttcatacaagttttttatccattatgctcacagatcaaaagtgactggattcatcagccaaaaagaatattttaaagagctgctgagaactttataaaaataattctgattttcttttgtgggggaaacaatttcttttagaggagttagaaaaaagtgagaaaaaattttttgaaagaaaaagaaccaccaatgttactagagagcagagttgacatggcgttactcacagtgactggttaagggtaaaagtgggggaaaaaagcaaaactgtaaagtaactgattatttcactgtcttcacctggccttaattcaaatcagaacacttctcccacctgcattacttcaaacaatttaccagaaaagaagagaaaatgtggattacataacccagagcatatagagcgaaactgcaatgctatcattcagcaatcacagtgctctagtttatttttaaaatagctcagaattggccatgctcaagaagtggtcctacatacagcaagagagctcttcgtttaatacaatacagatttttcctaacagcttcctctactacttcacatatttcttccatatccctacatggccctcctaagaaatatacctttagcaatgaacactaggaaaacatatcgttgtggaaaggcatgggagagagtctactctctttacttgctttagcgtgaggcagaaaatatttcttacagggtagccatccaatacctgagcactttcaaatactctgcagcaggtaatttgtttttcagaagggtgggagttaaaagtaacacagaaagtcataatggggtgagagattagacttttctccaaagttacagcctttagatttagctcctgcaattctgaagggcctcagagataaggaaatcatgttgcaaatgtgagaagtgagatttagagaggtgaagggacctgcccaaggcctcctagaaagaagaagagactctggtactcgaggccctcaagtccagggttctttccacttgcccaggtttatccctggttgtcctctcctctgccccttgatctgacaaatgttcaaaggattacttaaaatagtcccctgctcaaaataacaagggcttgccaaaagaagaaaaacaccttgaaatagagattccaattaactgcctctgattgctggataactcttcaagactcccagaaaccgattctagcagtatgtgttatttgtttatagccaacctttgttccaaaaataacttgatatgttttacagaaatatgtagaatacatacaatgcagaaaattattgcaaaggaggaaaaaggatgggaaaagctagtaatcttggggatgaattgtcatacaccaagaaagcaatttatatacctggtggcttaacagcaaatattataatcaatgcaataatagtgacccagcagaaatacactgtgagttgaaataaaatgttaacaagagtttgtggggaagaataagacacaaaagtcctgataatgtctcaatatgcagggtttggacttctgaagcaggtcactcctaagccttcaagcttaggaaaaaagggaaaaatgagaggacagaggatagatgggacgacaatggggtggggagtcagggagtgggtagagggaaccacaacaggttgacgtccacctaggtatcacttatcaatgaactgaaaatttatcaggtaattggaagctcaaattcatacgtcacctggactgaactgcgcttttgttatttataatgcaatatggtataaatcaattggcttggattttaaaattagagcccaattacctgtgtaagggaatcataaatccaacttgtatttttctaacagggttaacaactcatgatgccagcttaaactcaggaaaatcaatggtctgggcttaagaacaattgtgcgtggtactttatctccctggtctagtgtagcaggtgggcagtctaggagttgggggtgaaggatttgggggagggtagaagcctaaagcaaaggaaacaaacagaaaacattgaatattgctaaaaacaccacatgccaggtaaacaggaaggggggcacttacatatagtagacagtgaaaatctggacacctgttacttgatgaagcatcgcaggagcaaaggcaaaacactcctgttgcttttcttgttctgcaaaactctccagagctaagagagctaatgtgagatgaaaagctaaaaaaggagcgagtcagaactcccactgacagctcccaaatctggcccttcctaaaggcgtttgcgcctgccttaagccagagactcccttctcaggtgcagtttgttgaccctctcttcaattggaaacatctgaggttcactcagtgataaggggcacgtggaggaataaagctgtggcagtggtggaggaattaatagtccaacttttatggagggcagttaacattgtgtatgcctgtgtttatgtaagtatatatacctacatatacacacatatatgttatatattattgacatagaaattccattttcataaaattctccttgagaaatggttgaagaacagtgcaaagatatacatacaaaattcttcattgcggccgggcgcggtggctcacgcctgtaatcccagcactttgggaggccgagacgggtggatcaccaggtcaggagatcgagaccattctggctaacacggtgaaaccccgtctctactaaaaatacaaaaagaaattagccgggcgtggtggcgggcacctgtagtcccagctactcaggagtctgaggcaggaggctgaggcgttaacctgggaggcagagcttgcagctagccgagatggcaccactgcactccagcctgggtgacagagcgagagtccatctcaaaaaaacaaaacaaaacaaaaaattcttcattgcagcattgcttctaagaaccaaagttgcacacaaactagaagtcattcaaagggggtgatccaagccaagtgtattatatttcactcatacaatgtaatactatactgaaattataaatgacgatataaaattctatggacatgatacgtggtaaaataaaacaacaaaatagtattactggatgtgtcaattgtgtgagtgtgtgtatgtgtgtgaataagaacgtgtgggagaaaatcctgcatattaatcaagcttattgctgttgtaggataactgatattttttaatatttttctgttgtgttggatttttaaattttaattgttataaaatagtcaggtattacttttataatctggaaaaaaaaacccagcaatttccattttggatcttgaatacagtaggaaggatagcagggtagcagcagttactgggcaaagcagacgtcaaccagggcctaacaacaaggctctcactgcacaaagcaccagcacctgtcccataatggcttctgttttcacacaaaattccgccaactgggtacatcttctcaaagaggggaaacaaatgcaccaaaattaattgtagaacttatctttatgttctgggggccagaaaactcagtctatactgtgcttctgagagcaaataatcctttctaggcctaaaatacagtctgtcttctattttgggcttgtggtacctctgttgtctcattgttcaagtggatgtaaaagtattaattcaaaaaacccatgttctctgcttaaagcacagaattgtcaacaaaacatactacagaacacatgcctctcactcagtcatttctttgtcttagtttcttgtggtctattccatagtaaggaatttgcaatgttggagtaagagacctaagaggaccttagagatcaccccattcagcatcctcatttttcacaagagaaagcccagactagtcatcaagtgagctagccaggactaaagccgagggtctggtagtcagtccactgtttatcacttcagctctaattccattcaagacacagctatagcttcccccttctggacaatctgaatattcctttagctaatgttgaaataaatcagactttcgacatctgatgtgacatacagagagaaaaaggcaggaaatctaacataatgtactagttagcttttccaaatgcatgagaaatactttcaataatggaaaacactacatatactactttatgcagtcgacttttgcttctgtgatagaaaagggaaaaagttcaggggaagaaaactacgcgggtcatttggtgacgtttttaagatttttactttcagaggcacataatttaaagtgtttttctttttcttctatcaaaaccaaacatagttactagaaaacatctgaaaaatgcaacaaaattttaagaagcaaaaaaagaaaacatgtcacacaattcagccaacaaaaaaaccacagttaaaatgttagtatagttccttctaggtttttttcctttttgaatggttgagcacttcatatatataccatttccaagttttgttttgttttttacctaaattatacctaagcattttatgaattcattaaaaactatttataaacattatttaatgtatgaataatattccatggtatagagtgccaaattttattttttctttatttatgtcatttagggtttttctattatacattattctatgatgagcattgtaagaaatccatcttgatcttaatttctgattattttcttgtcttaaattcctaaaatggggaattgccagattaaatactatgagcattttaaattaccaggaagtttataacaaattttgttgttcctaccaaaagtacatagaagtacccattttataatcctttttcagtaaaacatattttcaaacctttgttaattttacaggtggcaaaattaaaattaaaatttattttaacttgaatctttattattgaaaaatttggtatacccattggccattgtggccatcctttggcagatctactcttgaggtcttggcccatttatttactgagaaaaaaggaaagcattttgatagatccaatctttttttttttcaataaataaataatgaatttttaaaataaattaataaacttatttaattcactaaagcttaagaaacacaaacttctgggctgatcagttggaggctgtagaaaaatgaacggaacacactttttttccaagtatattttgtataagctctatctaattaatgaaaccttcctgcaactttctgcatctgctcattccaagcattagattaacaaacggttgacataaaatgaagagctacatggtatttctttgacatgtggcatataaaaatcacaaactctgtctttaaaaatagagtgttctggttcacactggtccactgagcaaacctatttactgcctttcccacccaaaatactttctaaatgatactaaagaaatgcaaaagtgcaaactcataaccacaaagagaatgggaagaagccattagaagataaatgatttgaataaaagtctgttggcttctgaaccacacagcaaaggaaaccacagcctaaaaagggattgcggcaaaggagggccgacctgcctggttattccagaaagaatcgagcctcagaaatagcaggtacaacacaggatggaagagattggtggggctgaaaaggggggttaattacaggccaggctgaatatgtaacattgaccacccttcctcctggctctccatgtggactagcctgaggccaagcaccagcttcaaggcaataaaaaagtggggagaaccatcacagttatcattagtgttaaaacctcactctaggccaggcgtggtagttcacgtctgtaatcccagcactttgggaggccaaggcaggggggatcacttgaggttgggagttcgagaccagcctggtcaacacggtgaaatcccatctctactaaaatacaaaaagtagggccaggcgcggtcacgcctgtaatcccagcactttgggaggcccaggagggcggatcatgaggtcaggatatcgagaccatcctggctaatatggtgaaaccccatctctactaaaaatacaattagtcaggtgtggtggcaggcacctgtagtctcagctacttgggaggctgaagcaggagaatggcgtgaacccgggagcggagcttgcagtgagctgagattgtgccactgcactccagcctgggcaaaagagagagactccatctcaaaaaaaaaaaaaaaaaaaaaaaaattcaaaaagtacctcagcatggtggcaggtgcctgtaatcctagctactcaggaggctgaggcaggagaattgcttgaacctgggaggcagaggttgcagtgagccaagatcacagcattgcactccagcctgggcaacagagtgaaagttcatctcaaacaaaacaaaacaaaacaaaacaaaacaaaacaaaacaaaacaaaaccttactctagcacattgcgattccccagttcccatgcacacaccctaaactgaaactcttcaagcttgctattcacaagacccacccacttaaaaatagaccgcaacaatagccttcttattgcctcattctttcacacacaccacagatcaccagaaatttaatatgacaagaaagtctaccacagaaaagaaaatgagcaagtaaaacaacagaaaacatgacactggagaaaacagtttaggggaaagacacaaactttaaaaataaaatctagttaatatcgtcaagaaagatttgaggagatttggtaactacaaaacaaaaacagggttctattgaaaaggaataatcagataagaaagagctctttggaattttataaatgcgtaagtaaaaaattcaatagaaagtttgtaggcaacgttggaaaaaatctcctagactatagaccaagtacagaagtaagtgagaaaaaaataaaatatatagatgaacaattcaggaggtctaaggatgactaaccaaattttcacaataagaaaaaaagaaactggagtggagggaattatcaaagagattgcatggtaaaattccccagagttaaagagaaagatgaatgttcaaagtataggaatctacttgataccaagaataattaactgtaaagtggtagaaaaatgaaattcctaacaatttcctgaaaagtaaaaaaaaaaagaaggtggcctacaaaataagaatcagagtagcatcagacttagcagcagcaggattgcatactaaaagacaggaaaaaggattttcaacagagaagtctacacccaaactatcaattgtcttttgagggcaaaataaaaaattctaaacctgcaagcatgcagaaagtttacctcccattcaccctgatatggcttggatatttgttcctgcccaaatctcttcaaaatgtaatccccggtgctggaggtggggcctggtgggaggtgtttggatcatggggacagatccctcataaatggcttgggctatttccttggtgacaagtgagctattgctctgagttcacatgagatctggtggtttaaaattgtgtagcacctcgcttccccactctctctccctcttgctcctgtcttcgtcacattatgtgcctacttccccttccgccataattgtaagcttcctgaggcctccctagaagccgagccagcaccgtgcttcctgtaaagcctgcagaaccatgagccaattaaacctcttttctttataaattatccagtctcaggtatttatagcaatgcaaaaatggcctaatacacaccctttcttaggaagttaatagcaaaatcagaaggcaaattagaaaagaaagaaaacccattcaatccagcaaacagtgactccaaccctggagagcaatggggacatctcaggatgattctacacagcatgtctacagagccacctgtccaaatgggagcaaaatggaggtctgtaagagacaggaccaatagaacaaagagtgtaattatgagcttgaaaaaacttgaagatattattgaggtatatactcagaaaaggcaataggacatcagaaattccagcaaaaacaaacaaaaataactttataagaaaaacttgaaatatatattacagaaactaaaaggtggaatgattttgataaaatgatttaaaggaagagaatccatttgcacctgattctagacacaatgtctttgagtatcacaggaattgtgacagagaccatgtggggctgcactaaataatttagcaaatcttaattgtgcaaatattttcattatttccaactttggaaaaatcacaaaaaaagactactctggtgacagagcaaatgtcaattaaatttgacaatgcaaaaataatggtatatagctgaccgagaatggaaagtggaaggaaaagaaaagcagtgaagaaaagggtattgagtgcccatatctcatcctgtgatgtgtggaggcaagagacacaggctagattgatggaccaatcaggggaggtataaatacaatttagaagtggcaagcccaatagaagttgagaataatgtcatgttatggtgggagcatgtgaaaagtttagtgtaagttagtgtaaggcaaatacttcttgtctttagaagaaaatcagtagataacataaaaaataaataagtgttaactagcaatatggaagtaagaccaggaatgttgaaaagtgattgcatttagggagctcagctggaggtgggaagggtgggactgggaactgttactttgcactacaggtgtttcaaaaccatttgatttttaactacgtgcttatttttgctttcataaaaaacaattccaaattatgattataaaaagcaagtacattgttacaagctcttttactaaaaacaacaacgcataattgagcctgtatgaaatgctgtcttctaagccactggacacgctggaggaatagcgaataaagtataactggatttatttataacgaggagagagcaaatgcagtgtacggaaatgagacacatcattttatctcgacagaacaattaagctttcattagggcttaatgacaggatgacattcgggggtttggagggtaagcacatcaccttcattatcaaatcaaagattatccagtatcaagaggaacagttttatttattctgtattctcctcgaactccccaccccaagctctgtcatgaccctagataagatgggaattgaacaaaagtccccaagtgctaattgcatattctctcacatccccaagattgctgtctcctagccatttgatgttaatatcacagaaagcagacagcaagtgtatatttggatgcacagctaggtacatttcccagaatgtattttggaaggggttagttgttggaaggttggcaagacactagtgactccacgttttggctactacgcctttctgtcctgaaagcctggtgtccatgttatttagaacagcctgggtaaacttattactgcaccctgtgttcacagaaaaggttggttctgagttcaattacaatccctagcagtttaaacgatagctgctgtgctataatctaaaataaattgcttttctcaagaagccatgtaagcctttgcactgcatcttagcagagctgctggttttatctcatctgaaactcaagaagggtacaaaagcaggacctctgaactcctgttgttacctcaaatgtcattcttctacacttctggggctctctcttcaccccaaattcctatcccagaactagatttatgggaaagcaacagtgttttcattttttaatgcaaatcatcattttgtgtttattgttttctatataagctgcatactttgcctggggtcttttgaaagaactctattactgggggcaagatttgtttttcctcttcccacagctagaaggctaacctgctaccatgggccaagatagcaagtatgaggacgcccgcacccaaatgaattggggcacctctacagactctccattcaaacgcacatcctcctcctctctccaaagggaatggaggaaaaggaaacaaacttgtcaagcgctcaatacgtgaaatgataattctggctttctccaccctccacctccccaggagtttttcccaaaggtcccattggcccaagctcaagcctcagcacttctctaaacaagatgcttgtagatccctttgatgtctttccacaaaggcaattagaagggtttccaacgttaactatgtacattctttcagatttaacaaggcaacttaattaacactgctgtgtttctgctagtcaacaagagaaaattgtcctttcaagagattttgcacattgacaaaaataatccagtaatacttttccctttcaaatatttttcttctattgagattgaaagaggtggtttgcagagtgctatatggtatgtgctcagcagcatttttctgaaagggaatttttttatgtccacacaaaaaaaaacatccaggacaaataaaagccaaatgaatactttagacaaattcaaactcaaacttagagccactcagaaggcaaggaagtcctatttctttttataacatacatgcaaccatgccacgggaggatatgaaatgtagctcatgaattatgtttatccttaagttctcttggagctataataattagaaagagacaaagtgctgattctcaaccagtatccctaggaggcactaggaaatggaggaggtgaggacatttctttgatgtctcagcaattggagggcaaaactgacatttggagagttctcaaaatgttgctaaaagttctgtagtgtgttagcaccacagagcgaagacttttcctgcccagaatgccaatagatcccccttgggaaacactgacctcaaatgggaggttgtcaatgctgcactaaggcaaaatgagctccttgtcctgggtcctttgatttctcattttgcaaacttaggtgtctggcagatagtcaatgactaaaggaatcatctagtggtgaaatgatggtaagtcacttatccattcaataaatatgtattatgtaccatctgtgtacagtgaaagtactgctattgaccaagagtctctccttgaccaaacgttaatcaggctcctctgattctctccctaatcaggccttaacttttggacttctgtgtctttctctgtattgcccaattttagcaagaatcctcttagactggtttatccagaacccttcatcttcaatattggattaccctcaatatctgatcagattccatatccaccaccatcccttaggtggtttaatcacatggcctgcctttaggtacatttcataacaatgtatccaattttcctgatccaatttttctgcatccttgccagcatttggcgttattattatttttttccaatttttttgtggtaaaacatacataacataaaatttagcatcttaacaattttaagtgtatatttcagtagtattaagtacattcatattgttacaaccatcaccacctatctatctccagaactcttcatcttgcaaaactgaaactctataccatttaacaactctcaattcctacttctcctcagcccctagccaccattctactttctgtctctacgattttgaatactcaaagcaccacaaatagatgaaatcatacagtatttgtctttgcgtgactgtcttatttcacttagcataatgtcctcaagtttcaatcatgttgtagcatatgtcagaatttacttcctttttaaggccaactgataaggagggacttccttctgtcccattttgctattgattttctacacaccttacagtttttttctgtccctcatttcctgcatcactgtcttcttgtgtggttagtttattttttgtagtgaaacatttaaattcctttctcatttccccttgtgtatatctattttctttgtagttaccacagggattatatttaatatcctaaagttatcgattctaatttggaattataccagcttaactttaataacatacaaaaacattgctcctctacttctctgtccccacttctttaaattattgatgacaaaaaattaacatcttcatgcaatatgctctaaaatataaactgatattttaaaagatgtattagcttctcaaattatgtagaaaacaaaatgtggagttacaaaccaaagttacaataatactagcttttagactaataatttaaaaaaattagtctcatatcatgtagaaaaaaaatggagttaacaaagcattattacaataatactagcttttataattgcccacatttttacctttacggagaactttatttcttaactaagattcaagttactattagtgtcctttcatttcaacctgtagaactcattttagcatttcttacagagcatgtgtagtggtaataaacttcctcagctttttttttttttttaatatgagaatgccttaatttcttactcacttttgaaggacaatttgctgaatgtaggattcttggttggcagttttttttgttttgttttgttctttctgtagccctttgactatgtcagcccattgcattctggactcctacatttctgacaataattctgataatcgtattgatgattccttctacataatgagttgcttctctcatgttgttttcaagattctctctttgtctttcaacagtttgagtatactgtgtcttgtgtcttggggtggatctctttgagttcatcctatttggaattcattgagcttcttggatttttatgtttatgtcttgcatcagatttgggaagcttttggccattatgtctccaaataatctctctattctttctctctcttcttaagcttctgaactctcacaatgggtatgttggtctgcttcatggtgtccagcagctctgttccttcttcttcaatattttttctttctgttcctaagactcataatttccttgtcctatcttcaagtttactgactctttcttctacctgttcaaatatgcctttgaatatctccagtgaatttttcatttcagttattatacttttcaactgaaaaatttctcgttctatttttactttttctgaatctctgtattgatgttgctagttagttcatacatcatttattttttactttttccatatcttttagttttttgagcatctttaagatacttgttttagactctttgtctagtagatccacaattataactttttcagggacagacctcgttggttcattttctttcctttgaatgtgccatacttgcctgtttctttttatgtgctgtgattttgttgttgttgttgaaaaccggacattgaaataaaataatgtgataactgtgaaaatcagattctccttccccttccccagggtttgctttttcattctgaattgttgtaggttgtctctgtgctgaggataagcctgagatgtaaagttaagtccttctcacatcttttgtgagcctgcatctttctctaggtatgagcggtgactttctaatttcccatgtatatgtggctgctttaaaatgtactagtctttaatgtctggctccaaacacaaaaggggaaaagaaaaaaaatgaaaacaaaaggaaaagagtgctagccctttaaatcccctggaagtcacttcagctggagaaagaagggcttgcaacaatggaaggaaatgcaacaacaatggcccctggctctgtctgcacctttgtaatcagaagcaacaattagctatcagagaacagattcctgatttttgaatgacagtggcctttttgcacaccctggctcccataaactgtgtgcaggctactcctggaatctgtgcaaggatgcctgcgagtggggtatgagtagctgatattattctaagagctaaagtcaaccacagttaagggcaatttactgcccaagccttctcttggaaattaaaagccttcaatagactctagagttctaaaatagttacatcagacagattatgccatgcagttgttctctaggtgaggagatacattcctggtgctttctactttttgatcttcccagaatcccctccttatcaattttttttatttagccattttaatagatgggtaatgatatctcattatggtttatatttgcatttctctgatggctaatgatgtggaatatcttttattgtgctctttttttttttttttttttttgccatctgccattctcttcagtgaaatgtctcttcatgttttttgcccattttctaattggactgtttgggtttttttactcttgacttttcagagttctttatatattgtaaatactagttctttgtgtaatatgtggtttgcagatatttccaaccagcctgtaaattgacttttcattccttgtagttgggctttcacaaagcaaaagttttaatgttgatgaagttgaatctagcaattctccttttgtggattatgcctttggtgttaaatctaaggacactttggtttgtttttttatttttattttttatttctataggttttggaaaaataggtggtgtttggttacatgaataggttctttagccatggtttctgagattttggtgcacccaatacccaaacagtatacactgtacccaatttgtcgtctctcatccttcacctccctcctccctcacttgaatctccaaagtccattgtatcattcttatgcctttgcatcctcatagcttagctcccacttatgagtgagaacatagaatatttgcttttccattcctgagttactctacttagaataatgatctccaattccacccatgtaactgtgaatatcattatttcatttcttttttacggctgaatagtattccatggtatatatgttccacaatttctttatccactcattaactgttgggcatttgggatggttccatagttttgcaattggaaattgtgctgctataaacatgtgtgtgcaagtatcttttttgtataatagcttattttcctctgggtagatacccaatagtgggattgttggatcaaatggtagttttacttttagtgctttaaggaatctccacgctgttttccatagtggctgcactaatttacattcccaccagcagtgtaaaagtgttccttttcaccacatccccaccaacatctattattttttgattttttgattatggccattcttgcagctgtaaggtagtattacattgtggttttgactcgcatgttcctaataattagtgatgtcaagcagtttttcatatgtttgttggttatttgtatatcttcttctgacaattgtctattcatgtctttagcccagtttttgatgggattgtttgttttttttcttgctaatttgtttgagttccttatagattctggatattggtcctctgtcagatgtataaatggtgaagattttctcccactctgtgggttgtctgtttactgactgtttcttttgctgtgcagaagctttttagtttaattaagtcccatctatttatctttgtttttgcttttcgtttcgtagtcatgaagtctttgcctaagccaatatctagaagagttttccaatgttatcttctagaaattgtatggtttcaggtcttagatttaagtctttgaaccatcttgagttgatttttgtgcaaagtgagagatgaggatccagtttcattcttctacatgtggcttgccagttatcccagcaccatttgtggaatagggtgtctgttccccactttgtgtttttgtttgctttgttgacgattggttggctgtaagtatttggctttatttctgggttctctattctgctccattcgtctccgtgcctatgtttataccagtaccatgctgttttggtgactatggtcttatagtatagtttgaagttgggtaatgagatgcctccagatttgttctttttgcttagtcttgctttggctttgtgggctcttttttggttccatatgaatttttggattgtttttttctagttctatgaagaatgatggtggtattttgatgaaaattgacttgaatttgaaagaaaaagatttctttaggcaatataggcattttcacaatattgattctatccatccctgaacatgggatatgtttccatttgtttgcgtcatctatgatttccttaagtagtgttttgtagttttccttgtagtggtctttcacctccttggttaggtatatttctaactattttatataagaacattttgccttgccttacatacagagattttctcccacatttattttttaaaattgttattattttacatttaattctatgatccactttgagttaatttttgtatgaaggtatgagatttagatcaatgttcattttttttcccaatggatgtctaatgctctagcatcatttgttgaaaggctggacttccttcattaagttgcttttgcatctttgtcaaaaatcatttgagcctatttatggaagtctatttctgggtcctctattctgttccattttgtatattcttctgccaaaaccatgttggtttgattactatagctatatagccctaatattgggtggagatatatatctctttaatgttgggttggttgattcttcccactttattttatgtcaacattgttttagctattgtaggtcctgtgcatttccatataaatggagatcaaataagtttgctagaattttgttagaaatttaatttctcaaagatcaatttgggcagaactgacatctttaccatgctgagccttccaagtctctactcatttaagtctttaatttctttcatcagcattttgtaatttcattatataaactctgtacctgtttttatttacttatttatttatttatttctgagacggaatttcactcttgttgcccaggctggagtgcagtggtgcaatctcggctcactgcaacctccatctcctaggttcaagtgattctccagcctcaggctcctgagtagctgggattacaggcacccaccaccatgcccggctaattttttgtatttttacaagagagggggtttcatcatgttggccaggctggtctcaaactcttgacctcagcctctcaaagtgcagggattacaggcatgagccactgcacccggcctctgtacctgttttattaagtgtatacctgaatcttttattttctttggaactattgtaattgatacactgtttttgatattggttcctacacattctttgttagcatgtaaaaatacgattaactgttgtatgcatcctgcacccttgctgaactcacttgttctaggatttttgttgttgtagatttctagggattatatatgtagacaatcatatcatctacaaagagagatttatttcatttatttccaaactgcatgccttctattttcttttcttgccttattgttttggctagactttccagtactggttgaataaaagtcatgagagtgaacctcctggccttgtttctaatctcagggatgctctttagcaagtcgagataattcatcactatttctaaattgctgagaatttttattataaatagatgttggattttgtcagacgcctttttatatgatgatattatttactttttttatttttaatttcttccagtgtttcctcaatgaattttcttctgtagcttatttctatggtatattacattaattaattttaaaatgttgaaccaaccttacatacctggcatataataaatcctacttcatcatattacataattctttttattctttgctattatttcattaagaatttctgagtcaaaatttacaaaagacattgaactatagtcttctttcctccctcccccttcttcctcttcctccttcttcttctttgcctggttttggtatcagggtaataatgagttgaaaagtgttcctgcctcttctattttctagaaaagataatataaaattggcattatttttttttaacatttggtataattctccagtgaaacaatgtagtcctagagatttcttttttgggatatttttaattattaattcaattttttaaatagctataggactaggctagggctgttcatttcatgttggctgagtttagctagttttttttttttttttagaaattggtctatttcttctatgttcgttgaatatatgagtgtaaagttgttcatagtatttttattgtgttttagtgaccacaggatctgtatttatatttcctatttccttcctggtattggtaattttgttattgtcaattttgctagtagtttatcaattgtattaattttttagaagaacctgttctttgtctcattgactacctttttcttatttttaattccattgatttattcttttatccttattatttcctctgtctacttgcttttactttatttttctcgtttctcaaaataggaacttaggttattgatgtgaggcctttaaagacttactctttgacctgttgataacttagaagtgtgttataaattttcatgttttagagatttttctgctatttttttgttatggataacacattctgtaaaaatttgctaagcattttttatggcctatgatatgatctattttggtgaatgttcttcggttgcttgagataaaaagtatattctgctgttgttggatggagtattctatatatttcaattagattctatttgctgattgtgatggcgcaatcttctatattcttgatgattttctgtatagtagttctatttgttgttgagagaggacattgaagtcctgaaatataattgatgatttatttgtttctctttcagttctatcagtttttgctttgtgtattttgaggctctgttatttggtatgtacataagatcattttgtcttccaggtggatccattcttttatcattatataatgttccttcttgtttccagatattttctttgttccaaagtccacttttatcagatactagtataagcactcctgtttttttaaaaattaatatttgtatgatatatgtttttccacccttttactttcaacttaactaatcatagaatttgaagtgagtttcttgtaggcagcatacagttagattatgttctattattcactttgtttatctctgtcttttgatggtgtttagatgatttaccttcaaggtaactattgataagttagcatttcactataccatttcattacttgttttctatttgattcctctggttctcattcctctgtttctcttttcttgccttcctgtgtgtaacctaaacattttttaggatttcattttgatatacagtgttttgggaagtacttctttgtatagttttcactgtggtttccctgagtactaaaacctaatatgtgacttgttacaggctacattatcaacatttaactagtttgaaacttcactcccatttaaatctcttgtccttcccatttttcaataacattgaattgagtatcagatggtattataatttttgttttaatcatcaaacatgatttataaaactcaaagagaaaagaacagtttattgtatgtacccacaaatgtctttccaatgttctttcttccttcctaatcctctaagatttcatcttgtattgtttcctttctgtttaaagaactttctttagccaatctttaagagtaggtctgctagcaacaaattcatttacttttccttcatctgagaatgtttttatttcctcttcactctggaagtatagtttttccagacatagaatttacagttgataattctttcagtacttgaaaaatattgtggcatttccttctcatctccattttatgagaaatctgctgtcatttgaattggtattcctctataggtaatgtgtcatttctcttactgctttcaagatttcttcagtatattttatttttaaaagattaattatgatatatcatagcacagatttcattgggattacgtgtggggttcattcagcttcttgaagctgtaggtttctgtctttcaccaaattagttaagttttcagtcatcatttcttcaaatactcgtgtttatttgtttgtttgagacaggatctccctctatcacccaggctggagtatagtggcacaatcacagctcactgcatgcagccttgacctcataggtgcaagaaatcctcctgcctcagcctcctgagtagctgggaccacaggtgtgcatcaccatgcccaatttatctttttcttttttcttttcttttctttttttttttttttgagacagagtctcactttattatacagggcagtgacataatcaaggctcactgcaacctctgcctcctgggctcaaccaatcctctcacctcagcctcctgagtagctgggactacaggtgtgcaccaccatgcctggttaatttttttttttttttttttttttttttttggtagagacagggttttaccattttgcctaggctggtcttgaactcctgagctcaagcaatatggccacctcagcctcccaaaatgctgagattacaggcatgagccaccatgtctggctgtcagctaatcaaatactctttcagtcccattatctttatcctcttctgggactccaatgacatgaatgttgggccatttgtcattgtctcacagatctctggggtcctgttcattttttcagtctatttttggtctattgctctgattgggtggattccattgttttgtcctcaaatttagtaattctaccctctcttatctctaattaacagtagatagtctaacctatcgttaatactatccagcactatttttatttctgttattttttatttctagaatttttattcagttgttttataacttctatttcttttctaatattttctattttaaaaaattgtatcaaaaatttgcagctgctttataggtcatttatatgacagatgctttaaaattattgtcagataattccaatatctgattcatcttggtgtttgtgtcagttgattgtcttttctcattcaatttgtgattttcttggttcttggtatgaaggataattttttattgaatcctgggcattttgcctattatgataggagagactaggtcctatttaagtctttcgttgtaagtcagtaaccctgttaaattaatcatgtgggtcttggctacttttatcagctgtggctccagtggcactctaattttcacagactttgaggtgttattttgttctgcttgattaatctggttgcaagaggccactggttcctgcctctaccccactgccttgtggggcagaacagatttccccacactgggcctcaggtatctctcagtgggagaggaatacggtggggtctgccatctgcctcagtgtctttgggcagggaaggagagtctcaggcatgtgagaacaaagaggcttcctagaattggccactttttgtggttgcatccttgttgctggttatgtcttcttgccccagtgactctagacaggggaggatcatttgaggcacacagagaaaaagaggcttccctgacagtattatttgctatagttcattctttttttacgtgttctgcctgcccacttcagtatttcttggtggaaagggagagtctcagggctgagggagagcagagtccttcctctggccaattatttttggcgaggcttccaattaatctctttggctggtagcgttgaacttgtctgatagttccagagggacatccgctcaatcaggaaaaaaaaaaaaaaaaaaaaaaaaaatcagcctccctgagctgcttcttgttgccaggcttggacttaggaaacactcagttaggaaacactcggtctaggtgaccatcttctgttgggttgggacactctaaacactctgctactgtgctgttcctccaggcctagggaggccagctcattctttttttttttttttttttttttttgagacggaatctcgctctgtcgcccaggctggagtgcagtggcacgatcgcttctcactgcaagctccgcctcccaggttcacgccattctcctgcctcagcctcccaagtagctgggactacaagtgcccaccactacgcctggctaattttgtttttgtatttttagtagagacggggttccaccgtgttagccaggatggtctcgctctcctgacctcatgatccacctgcctcgccctcccaaagtgctgggcttacaggcgtgagcaaaccagctcattcttactgtctttcagcgctctcatttggttgtctcttgtaccattaccagagttggtagttgttcttagcaggaaaaagcaggggaaaatgggtctacatcatcttttctggaccagaaatctgtttattatattttaattgcatatttccattcattttttggcaattaacccttttagatcttattataattatttgtgtacatccacggatttgaaacatcttggtaatttatctttgtgtattttacagtgccttgaacaaagcagattcttccttaaaggtacttatacatgaatgaatgttcatgcatattttctctggggctgtacaatggaacaagacctacctgttaaaagagtggttgttggtagaatgtaaacatgacttataagtgttcatccttgcaaatggacataggagtaacagggagaaacttgcttaatgtgatttacagaaacctggttcagaacataggctcacttggtcatcacttccctctggtcatcacaatctcacaatcatttttctgctttcagcagatgggaacatgtgataatgctgtgacagatttccccaccattacttcctaaagccattacccgcttctagcttaaaaccttgaacacacaaacacacacatatatacacactaacatacacatacatgtatgtttcaagcatccaagataggaagtaggggaacatgatgaattttcttttctagaaataaaacaatcatttgtccaatgaaagatgagcataaaacacccatacctaataacaaatggcacagaacaacattgctgggaatccccaaatagacctcacgaaaacatcactgaagattgcatgtgagagctagaaggcctcaggcagggaatgccatggaatgtaagaccaggcccctgctggggctcagaaataggaatgatagaaaagcaagcaggaagagaccctgggcaattgagttctcccactgagcaagaaagaattgaaaataacagcattaggcaggaaaacaatggatgcctgacctcccatttaaccattgtaatcatgcattgttatcaattggcttggtcttttaagattcctagtcacttgtccctcatatctgtggcacatacttatcactgtgtggatttgctttttggcaaacagaagttttaatttttaatggagtcaaatctattactcttttcagaaacgatctttctctttgtcttcaagtttatgaagtcccctctcactccagtagggataaatactcatttctattctgggtttctaatgattgattttatacatttatttattgctttaatccagctggaattaacattagcatatggtgtaggaagactgtaattcttccaactctaatgcattcttgataagtaaaaaataggatttcctacagtagaaaactcagcctagaaacctgcctttcagtatcctgaggcaggaatggagtgaatgaggcactttcctcaaacctaaaaacctcatcctgttttactggggacttgggataaccttctttatttctcagtgtctcctcctttgtgtacagtagcgacacaaatatccactgtgtttccaaagagaagtcaagtgcttaagctcctcaaattttctgagtacattctatgtagaggattttccattactggttacacttaatacacagggccttgctggagaatgtgaccaggagaactagaacttcagaaaacacaaaatgagctatcaaaggcttggcactttgtaggggtgtaatcagaagaaaaacgagtcctaatatttagaacacattagatgtaacctcttaaactccaaagttctcttcaaatcttacctatttaatttgaaagcaagcaatgttccagtgttaacatttctgatttgggggatgccagatagtgaaatttggattaaacagagggaatttatagtcttattctaattaataaatggacttaacggggttctgaaaataaaacaacctcataattagttggtaattaacatagctaagagccaggtagaactgtccaacctgtgtcatattctcacaggtgtgcccacaaaatacaatattatatagaataaatacattgcccaccttcattcatccagcaagatgtactgacttttcactgtaggcatgaacctgaagggaattaaaaatgaaggatggtccttgctctcacaaaagctgccaaattgggtacactcactcagtgtcttcaaggaacacatggtcaggtttctagattatgcttaactagattgggagagtggattaccctcagaatacccttgataaaagctttcaaaattttcctttactcacaaaaccatgttttcagggaacctaaacagaagtccaatatataagatagaataatagataaaagtataaattatttggtcaaatgaggactactagtgttctcaaaacactaccccacttccaaaatacacacatacacacacacacacaattcctggaactttacagagtagagtttcaaaatcactgcagctgatgaattgacaaatagaaagaaggggtaacagataggtacaaatgtaatataataaacacaatagaatgttaatgttagacaccaagcggtggttacacagggtgttcactataaaattacttcagttttcatatacgtttaattttttcataatacaatattgaaaaaaaaatcccgctcttgattcctatatctgaaagttcttaaagttttagttgagtaaacatttagaattattggccgggtgcagtggctcatgcctgtaatcccagcattttgggaggctgaggcaagtggatcacctgaggtcaggagttcgtgaccagcctgaccaacatggtgaaaccccatctctactaaaaaaaaaaaaaaacacaaaaattagccgggtgtagtggcaggcacctgtaatcccagctacttggcaggctgaggcagcagaatcacttgaaaccaggagaagaagattgcagggagctgagaccatgccattgcactccatcctgggcaacaagagcaaaactctgtcttgaaaaaaaaattggaattattatttgttcttaattgacccctttatcattatgatatgtccctctttatctttggtaaaccttcttgtcttaaagtttactttgtgtaattgatgtagccacattggctttctaaaaattatttctataacatatatttgtattccttttacttttaactctttgtgtttttgtatttaaagtgcatatgttgtagtcagcatattattgggttttatttattttgtatctttcatgcacgtccgtgtgaagagaccaccaaacaggctttgtgtgagcaacatggctgtttatttcacctgggtgcaggcgggctgagtccaaaaagagagttagcgaagggagataagggtggggccattttataggatttgggtaggtaaaggaaaattacagtcaaagggggtttgttctctggctggcaggagtgggggtcgcaaggtgctcagtgggggtgctttttgagccaggatgagctaggaaaaggactttcacaaggtaatgtcatcacttaaggcaaggaccagccatttacacttcttttgtgatggaatgtcatcagttaaggtgaggcagggcatattcacttcttttgtgattcttcagttacttcgggccatctgggcgtatacgtgcaagtcacaggggatgcgatggcttggcttgggctcagaggcctgacagtatccatattgacaatctatgactattaattgggacatttagtccatttatatttaatgtaatgatataattcagttttaagtctaccatctgaatatttatgccatctttttttgtttccttcttccttctttcttgccttctttctgttaaaatgcatatttctaaagtttccatctttataccactattagggtttttaattatacctctttgtagcgtgtgtgtgtgtgtgtgtgtgtgtgtgtgtgtgcatgcatgctctaggactaacaatatgcatccttatcttatcaaaatctacctaaaattaatattatactatctcatgtaaaatataagaacctgacatttattacttccttgtccattatgctgtcacatgttttacttctatttgcattataatcctttcaatacattgtcatgagttttgctttaaatagtaagttaccccgtaagagcttaacagaaaataaagacggtttaaaaatatatatattattccatatatttaccatttctgtgctcctcattccttcctgttaatctgtttccatttgctttcactttcttttaggctgaagaatttgctttaacatttcttataatgcgggttgactagcagtacattttcttaggttttgtttatctaaaacttaggttttgtttatgcagccataaaaaggaattagatcatgtcctttgcaggggcatggatagagctggaagagatcatcctcaacaagctaacacaggaacagaaaaccaaacactgcatgttctcactcataagtgggagctgaccaatgagaacacatggccacagggagggaaacaacacacactggggcctgtctggggtgggatggggggcagcggtgggagggagagcatcaggataaatagctaatgcatgtgtggcttaatacctaggtgatggtttgataggtacagcaaaccaccatggcaaatgtttacatatgtaacaaagctacacatcctgcacacgtttcccagaatttaaaataaaataaatttaaatttaaaaaaagaatttaaaaatgtcattctattgtcttctggcttgaatagtttttatttaggagtctaaaataactcttactgttgttctcctatatgtaatgtctctccactcctcccatcctcagcagcttttttctttacttttggatttttatcagttggccgtcatacatccaggtatggttttctttgtttttatcctgctttggtttgctaaacatcttcaacctgtagtttgattttttcactatatttgggaaaatttgttcatttttttaaactattttttttcctccctcattctctctatcctcatttctggacctcaaattgtacaaatgttagacttctcgcttttgccccacagatcactgaagattcatatattttttctattttttcctcctgttcttcagatcagacaatttctactgatctgtcttaaagtttcctgatcttttctgtagtttctaatatgttgctaaggccattcagtaaacttttcattttggaaattattatttgcagttctataatatagatttgtttcttttttatagtttacatttgtttctctgagatttcccgcctcttcattttatgtcacccattttatgtcaagtccttgaatatacttatctagttattttaaattcctcattttctaattctaatgtctgagttatttcaaagtctgtttctatttattgcttttttctgattaatggagcttcctcttcacacatccagtaatttttttgttgtatgctaaacacagggcgacacatttagggaatctgcattatattgtcttccttatagggtactgagtttttttctggcaggaaattacatttctaaaatattctcttgaacctttcattgttagaactggtctagttcaaatttgtccttagttgtagaacacagccttatggtagtgtacaggtctcactcctgaggctggcctttctggggtttcaactgaatgcccaggttctcagggaaatctgccctctcagactaagaattccaacgtctcccatctctgggcaaccactagtgtctttgttcggctcttggtcccacagtgaaccctctctgctaggcctcatggtgtcttgccctgcttatacatagtcaatccttcagacaatgacctgcaaagaaacctccatgtacactacctccacatgccctacctcatgcatctctcttattcagtaccctactctgctaattccagcccctcagcagcaacaaagtacaaactctgccttatcagttcattgaaacaagcatgtaatgcttggccccacctccttactagccagtccagtgaatgcacccctaggcagaaagccaaggtgaatgcaaggcttgcctcaggggtttaccttgtctcaagggtcacagccctgcattgcctgttagccaatttctgaaaacagttgccgcatacattttatctaattttatagttattcatgaaatgaggtcaagaatgataccagttacttcattgtggcttgaaaactaaaatgctttagtatctctctccactaccaccatcaacacttgaactttacaaatgatcctatttattctaccacctgctactaaatgatgaaaaataattatcaagtgagttgccgaggcttcctgctcttatttctcttaccatgttctcagatatctgactgctagctaatgtctctgcccgggaacaaaagaagccagagaaggagaaagaggaagctcaagttctcccatattctctcttttcaaaagttacgaagagtagaaaatagtttaacaaggaagtttagagattacatgaaaattgtaatgagtctgatgcaccagcttccaataccgtcatcacaaccagcccttccttggtggtagttatgtattggttgcacctgatacctaagcagtagtctgctctcttttgcaataaatcacatctgtctctatgatagactctgacctcagcctaccaacagcatgttttttaatgacactggcttgcaaatgcatctgatttgaaataaactttctttgtaccatttttaggttctgtacttttgaataaaggtgcaatcacagcaaatcaaattctcagaagactacaataagtaaacattaagcagtgttcctttttgaaagcaggagagagtatatgtttaggaatgttcaaggattagtctggttcttttttaagtttttatttattgattttatcttaacagcaaaatacaatgcctggctagagcctttaaatacagataaacaatccaaacaagctgcaacttacgtatatcaatcttctaagatcacctcagaaaagagaaggtggctcccaacttgtcccaagttaaatacatttaagagaagcaaatgggaatagcagctaaagctgacggacagggcaattcgaggcatcagatgctccctttcaggttgctgagatgcttccagatggttcctgtatctgcatggccaaagtggtataatttattttcttagctttttcaatctctctgcatattacatcacaattttagctcaagtttatttttgttgtgtgtatttgacaatcctttggtggtgtggaacttaaatcatcacttcccagagcaagaaaacaaaggctgacacttctgatatagaaggctgcaatctggaaaggacgatggttggaagggcaggtggatgattgggaccaccactaggtttattctttatttgttcaacatgttttcattaaattagggtacagaggtggacaagtcagaagcagtctctctcattatggagtttacactctaccagaggtgagaatggaggacttaaaggtagacaaaaatgcctaatgtgtcacctagagaacacaaccaaaaatgagttacccaacaacttcatacagctgctacctgcagttagtatgtacatgccaggtaagctaggaagaggcctacagcctctcctggaaaatcttgggagaccaaataggttttgatcttgaccattccctgaaaatcctcatctataatcttcaaatgcaagaaggaaccaggaggtgccattatgtttcaccacaagaactcattttttttaattactgtttttttcttttagtgagcataattttttcttttgttgttattgttgttattgttgtttttgagacagggtctcataatgtcacctaggctggaatgccgtggcgccatcttggctcactacaacttccgcctcctgggttcaagggatcctctcacctgagcctccatagtagctgggattacaggcatgtggcaccatgcccagctaatttttgtatttttttggtagaggtggtgttttgccatgttgcccaggctagtctccaactcctgggctcaattgatctgcccgcctgggcctcccaaagtgtttggattacaggcatgagccactgtgcccagccaattttttaattacgtaaattaaaggggtacaagtgcagttttgttatatggatataccgcatagtggtcaagtctgggcttttaatgtaatcaacacctaaatagtgtacattgtactacctcactcccctcccaccccatcatcattctgagtctccagtgactattattctatactctatgtctacatacacacattattcagctcccacgtgtgaggacatgtggtatttcactatgtttctgagttttttcacttaagataatgacctcctattccatccatgttgttgtaaaagacatgttttcattcattttctgtggctgaatagtattctattatgtatacatatatacacacacatatacataaataaaatgtgctgtatgtatatatgtgtatatgtatatacatgtggtgtgtgtgtatatatgtgtatacatatgtatatgtgtatgtgtgtgtgtatatatatacatatgtatacacttatatacacacacagagcacattttctttatttaatcatcttgatttttttggaagagtttcagtaggatgagtatcagttcttctttgcacattttgtagaatttggctatgaagccatccagtcctgggcattttagggggaaggttttaaaattattgattcaatcttactattcattattggtctgtttaagatttctatttctttctggttcaatcttgggcagtcatatgtttacaagaatttgtcaatttcctctacattatctagattgtgagtgtacacttcttcatagtagtctctgatcatcttttgtattcctatggtatcatttgtaatgtcttctttttcatttctgacttttatttggatcttttcttggttagtacagccagaggcttatcaattttgttcatcttttcaaaaaaccaactttttgtttaacttatccttggtattgttatcttggttttcattttcattttatttttatttttaacaaccaatttatatcattcaaacagatagaactgccttgtgcttgtttcagccttgttttctggttattaaaagaagacctgaaccagatacaaattcaccatattttccttcaaggacacttctcataaaagctactaatatgcatattttggcatacaaaatcacatttgctaaaacttttttctgcttaaatacaattcttttttcatttagcaactgcatgttattatagaggtcaattcattgggttataagagaaaagaaacacttattgaagattcacaacatacattccattatatatcgctgttcaatagaatgcaaaattagtaaatatcacccctacaattggaccatgtaactgatagattttcctgtaaggagttaccaaaatgtcatcaaaatctagagtttgacaatttccaggccttatcctgaccttctcaatgcaagttgcacaaatgaaatcagttatccaagagaaaaactgggatagaaataggggttaatagattatgatcctaagttgaaaaatacagagctctcagtttccaagatttaccattttcaagtgtccctaattttgtcccaagagtggctccagcctgggcatgacagctggctgtaatggggacagatagctctttctttctaagaacaagatttaccatttgttttgtctgctctctccacaagctcttcctgaaacatatcagtggcataataaatatcatctcgttttccatcttaaggactttagtactcaaaggtaactgttttgagtccttaaaaaaaaaaaacaagcaaaaaaaaaagtggtttgcaaacttttgtctgtgacataacaccaaagccgtagtaaagtcaatgataataataataataggtacttacttgggctagggactgtgctaggcttcttttcattcattatctcatttaatattcacagttcctacatggcttagtatttcttgcagaccctttaaatgcttacatatagaaatctgccctactatttcaagtataggcagaagttggcaatacaagaaaagacaaagggataagaatccgtccaactggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttaccaaacatggatttttatttctgcattctatagaatacttattcgccactgagagttccatttaaattctttgcatgcacacacacacacacacacacacacacccttccaccaccactaccaccaccatcattttcatcatcatgtgatttcagaagagcagtcatgtctacagtaaaggtatttgagagctaaacaaagcctcctggctagagatcctggtatcttcctttaaacccagatcattcatggtatgggttccctgcagagcactggttgtggccccaccaagcactgccatttccagcactgtcagtttctttaaccttcaagagaacacagaagagtcattcaaagccagcaagtgaagagatgtcctggcagtctaatttcaaacaggcctcataccagagtcttttttatggtttttaaaagaagtattttatgctgctctgatgaaaacctctaacagtagtagcttctgtctgacaaataccatagagaatgaaacaataagtctgaagcaaagggagggggtaaaattatttttgtttcaatagccaacacacaatgaaaacaagaaactatagaggtttaaagaataaccgatatttattctggtaaagacttttctcatatcagcactttaccactgtaagatgctgacaataattatgtgaatgttgctataaaaaaattaaatctcccatctcatgggtttaaaggtgtttccgcctctgccttacacacacacacacatacacacacacacacacacgtacacacacatatttcaggtacctctgtcaggatctcccaactcaattatactgcatggaggaaaaatatgtatactactactactagaataagaataaactagtaaacaaacaaatagaatacaatgtaagctgcagtacatgtaatctgaaggcctgaagctcatgtgtgctaggtttttgattgagcagtggtgggggtaaacgtggcacagcagttatcagcctggactgtggaatccgatcataccgggaaatgaatcctggcttactcattgagtaacctggtaactgaacctccctgaggcccaggttattcatcaacaaactgatgacagttatcccatggggttattatagggattaagtgagaaaatgttatataaaggtgaggagtggcagaatatgccaccccaaaatatgccactttggcatgaggattattttgagctgaaggcagttgagaagaagcagatatgagagaagctctctgtcttccccctatttgccacaaaacaggatatagatttataaaggtgccctccccacctatcaggaaagaaaaagttaatcatcagagataactctagatattcactagccagaagagacaccagaggaatctatgtaacaagctttactaactagcccttccattagttcccccatatatttaccttctcacaatttgcagaaactcaaagtcctttcctttgtcttaccatttctctaaaaatttattgctcttttttaaaaagctatataaggtcacattttaatcacccctttgagtcactcatcactgggtacttccatgtgtatgtgcaagtacatgttaataaacttctgttttttcttatgttaatctgtcatttttcactctactttagagggccacagctggagaacctaggagggtagagggaaatagatttagtacaaagagcttagtgcagagcctgtttcacaatgaagcactctgtaggtgaaagcattgccatgattaatgattgccacaaagcatccatgttggttaaacagacaccatgcctaagggcatataatgactctgaggaaagctagacttgaagaaaacacgacttgcccagccaagtaccttggtcaaaacacatatttgtttgactctatagtgttgagacttgagtatctaatatacagatgaatgagccagtacagaatttgaaatttcaacaaaaaggcaagtataatctgcctgataataataagcaacttgtaaatctttgaatggatgggcttgcctgttttcacccatgctactcaaactgtgaaccacagaacagaacatcagtttcacctggggacttcatagaaatgctgagtcttaggtctcaccctagaccttctgtattccagaattataataagatctccagatgatttgtaggcatattaaagtctgaaaagcactgctgtggaccacaaaatttaatgtactgcttatcccactttgggtgtgtttctgtgatctttacaacttaataaaccacccccaaaagttagtgactttaaacaacaatttatttgtcctgcttcttcaatattggcagggctcagtgagacggctcatctctgctccatatggtgttgactggggtagttcaacacagactgcaagatgcaagctggcttcccttcattcacatgcccttggctgacctggctgggacagttgggggctggctgggcctctctccatgtctttgttgttcttcaggacctctttccaaatggagtggtctctctcctgcagcatgatcagacttctttaagtgatggcaccaggctccaagacagtgaagtcagccatcttaaagtctaaatctggaactggcactgtgcatttctgccattttctgttgatcgaattgagtcaaaaggcaaacaaatgtcaaggggagaaaaaagactttatttcttgacgggagaagaggtctgcacagacagtgtggaaggatttgttagcaacagtttttgcagacaagctaccacagagtatctgttacttttcactttcttcatctctctgttctcctgattggtcaaacagccacttcatttcaattacacaactatatgcgaggtcccattgggagcataaggaattttaagacatgatatctcccatcaaggagcttgttataatacaattggtaaaataaggaatacatatcttgaaattttaataacaataaaatactgtaataataaaatatttaagtagcagtgccagataataacagaaatgatgtcctaaggccatgaaccatttatttaattaatcgtgcacacaataaccatcctgagtgttcagaagagagaatggaaggggaggagaatggccatggaaggacggttgtgcagtgagtaagacttgcataggaaaatgagtaaggttttcaaaaaaaaaaaaggtccaatgaaatacacacaaaggatacaacagaatcaaggagccaagggaatggggtcatagggacacaaggccatgaatgagtatctgcatgttcttcaatgatgattatcaattcaatgttcctgaaagaatttcctgcctcataacgtccacctttacttctccctttagatatgttcataagctatttgtggaatccccaccagcaatataaccttgtattaataatgaagggtttttatgaaccttataaattttattataccttgtagagagggtgggggaacaaacaaacagaaatgtaggcattgccaaatggcaacttgtaaacttcactattcattgtgtaggaactaacacttttggtattgttaagtagccttgtaaatttcactctcccttagaaaataaaaatggaatgaaaggtgctgcttagaagaaacgtataaatttcaatctccactgcaggaaaataagctctgattacactacatagttcatacacctcaatgttccgaacacttgtttttttacagattcatgtataatgacttggttttccaacaacagagagtgaaatttacaagttgttatttaacttttttaggagtgtatttttcttccatgtcttttttttcttctttgcccctactcacaccagaaacctaatatgagcaatgggatttctgaatagtaccatacattaattccttcaataacaatgattaaaacattttaaacattgttctcagggcctcctgataccacatataaaagtggggaatgacacagcttttggccacacagttcaaaaaattgctctttaccttgttggggaagaagagggcttattaaaagtttataataagcagtattactagtatttaacttctatttgttgttgaaaagaactgagcctataatttcagaggcttccgagcattttcataaatatacccattagatattcaatagccagtggatttgaatgattttgccatttattcgaacagatagctgtcctggacaggaaggatagaagcattggaagaaagtgttagaactacatttccataaagtcatgacaagaaataaagaaagaaggggagtcaccacctcaatactagaagtgtcagcacaatgatatcctcataaaaggtgttctaaaagaaacttttaggtgttctaaaataaagttataaatgccataccaagaaatactgtcaaaacaaaagtcaagtacaatacagcccagaaagaaccaaatacatctttacatcagggagtaaaaatatacatagatataatatccacaattgtcttaatttatagcttttaaatagataatatacatacaaagtgaaaaattgaaaccacaccaaagtacgttgaaaaatgtcttcccactcatgctgttaatgatctctgtaccctcttcaacatatgcatatgtgaacatatacacacattttaaatttccatgactacaaataatggcatattctaacccatttttcacttaaaaatgtcatagagatggttctgtatagacccatttttgtgatggtctaattttattacaaagattataaagtatagatattccataatttatttacagattctcctattgcttggacacttaagctgtttttaatcatttgttgttaaatgcaatgccatggcgaatatttttgtacatagaattttgtgcacctgcatgactatagttctaaaataaattactagaaatggaactgctaggtcaaaaggtatatatgcattctattttgatagttagagccaaatagctttccaaagacaatataacaattcatgcttctattcatgataccaatacatcttgcattgaaggaattccaaaacaaccaaaagttcatcatttttctgccaactgatcctttctctcttaaaaagagtcggggtaaaaatcacccatttttgcttataaccataggcagttataatcattattgcccaagattcaaggccatttcattacccactgcatcaccatcctcactgtggtataattctaactggtcagagagacctttaatttgcagaccttctcagaagacagattatctgcattctgcagacatctgcagaaagccatccacaagtgcatatttcatggctgaatatttttacataacatcagctggaacccatcgttccagcattctcgccaagtgtcacaacctgctctattatatcaataagcagtttcaattagtcattttcttcccatggtgacgacagctataatagcatgcagtagtctgatgaagtttgtaatataaagtggagatgggagtattaaaaggaagagaatacagaattagaatcgcataaaaaaatccatctcccaaatagtcatttggggaaatgacaacatttttgaaacagtgttcaagaatgaatacaaaaatgcaattacttttgaaaagtcagataaataaatttgccatgggaacacattcttgccccagatagaaccctagtttttactggctaattagtcattaagcaccatctcaaaaacaactgtatatgaaagaatattgggtaaatagaaataaaacttaaggcttaacagaattgtaaaatgaaaataaatgccaacagagaatactactttgaaagcattggatagtagtaaataaattagaaggaatgacacagttgctctgccctcaaaatttatccctaatctgttactacttcctactttgtgtgctaagattaccaggctccaaaccatgcttgccttccctggcacacagccagagccttctgactggccacctgcctctcttcttgtccccttcagcctcttctttacacagcagctgaaatgattttctaaaaaatataaatcagatcgcatcatttccttcttttcagccctctactggttttgctcataattaaaatctaaaatctttgccatggctggcaaggccacatatggaatccatctaccacttctttctcctccctacactggcctctatcaagcacattcccaactcagaccctcaggtcttgctgcttccagctaaaaggttagacccccaaatattcagatgtttttcctccttcactttattcaggtatgtcctcaaatgtcacctcatcacaaaggattatttgaccaccctatctaaaaaataacccaaaactctttatcaaatgcatgcagatttactttccttatatcatttaactccactcgacattatatgatgtagttagatgtatatctgttcattctgtatatcccctactagaatgtaacttcaatgaagatgagaagaagcaaagataaaaaagtgcatcccaaccagacagaaaaacatactatgactgtgaactacacccattgatatggtttggttgtgtgcccacctaaatctcatcttgaattgtaactcttataattcccacatgtcaaaggcagggctaggtggagataattgaatcatgggggcacttccacccatactgttctcgtggtagtaattaagtttcacaatatttgatggttttataaatgggagttcccctgcgcaagctctcttgcctgcagccatgtaaggcatgcctttctcctcctttgccttgcaccatgattgtgaggcttccccagccaggtgaaactgtgagtccattaaacctctttttctttataaattagccagtctttactagcagtgtgagaactgactaatacacccatagttgagaaaacagcatctacctgactttggttaaattcattcaactcagcaaacatttactaaactcttattagataagaaattccagaaacataggtcccagtgtctatctgttatatagtttagagacaaaaacttgcatataatttgggaggcaagacatgaaatataaactactgaaatgacaactaaaaagagttaatgatcaaaagccaacatgagtagggcaggcaataagtgtcagagagttctgaggaggagagatttgtgtaggctgagagggtgaaggaatggttcaaaaagaaggctggagaagatctgggaaaggaaaccaggaggaagaaggcatttggggtgagagcacagcaggggcagacacatagattataccagtgttccccaaacatcaaagcatggaaccttggtgttacatggtccactgacaggacaaaccaaagaataataaagttatatctctttccatttgattttaatctttctaatacatgcaatgaaaaagtattaattcagcattaattgttaaacaccttagtaacacttgccaatctgaatggcattattttactttttattttttgtacttctctttaaacttttactccctatttatgataagggcttttatttatggaataacatataattttattcatatgtaaacttctatgggtaaaaaaaagggagttgctttaatggcagtcaatcatggactaaatatctgggtcactacctacccagacacaaagcagagtcaacctttaaagtaagcaaagggggctcagtggaaaagagaagaaagttaagctcttgtcaagatgatgcagggggcctcatgtcaggctaaggattctggaaaatattctgtaggactgtggtttcccaatttgcaacaaggtcaaattccttgaaaacacacgcgttatatttgagtgtggcatgcttcttattttcaagacagcaagaaatatggcaatcttcaattccattataccatttcattatacaaacttaaacacaaagtggaaagaagtaaatacaactttatactatatgtgaattacaaaagcacaatcacaaccacagtttttttttttttttaaagctgtctatatctattatgatatgggcaagaaacagatgactcacaaaatactcaaatagggtaatctgcagaaatgcttagaaagtgtattcatggtgtggagaaaccaaggattaatgcaatacccagggacaaggcgggagcctacttatagagttcacagagaactgcccaagcaaagagcaaagcagagagtgggtaggaaaggataaattgaagataaccaatatacaaacaaggctattttcacatatttcaaatacttaccaggtcttcgaatactttacctgtctaatcacgagctgtatattttttatagggaataagagtgcataggccaggcgcagtggctcatgcttgtaatcccagcactttgggaggccgagataggtagatcacaaggtcaggagatcgagaccatcctggccaacatggtgaaaccccatctctactaaaaatacaaaacttagctaggtgtggtggcatgtgcctgtagtcccagctactcaggaggctgagggaggagagtcgcttgaaccagggagacagaggttgcagtgagccgagattgcaccactgcactccagcctgggcgacagagcgagactccgtctcaaaaaaaaaaaaaaagagtgcatatagcatggacttaaacctcagcttgccattcacttctatgtgagtttcttaagctcaatgaatttaattttttcaataaaatgggagataataacagtatccactataaggctggtgtgagaagcaaatgaataaatgtatgtaaagcacttagcacagcatttgcctataataaatatgcatgctttgggaaaatgggggagggtcatgtgagctgccaaaatagtgaagagaaatttatgagagaaaagcttaagattgcagaaattatcaatttaaattgcattagcttagtatttcatatgagttgtccaaaacatcccatattattcaactattccatttcattgataaaatacttcaaaggcatacaaagaaggaaaatagtctagatcggtagaggcaggtggggttatagtggtggtgatcagtggtagtggcagggaatagacagtaaaggcctccttcagaaggtaatatttaaaataagaccaactgaaacataaaaggagttaactaagtgaggtgaaaagtgccccaagcagaggaaacccaacatgccaaggacctggggaagaggaaacctcctggattcaacatattccacgatcaacatgtggaagagtaaacaaggcgtggggagaactgcagctggagcggtagaaccttttcagtcatgtttaaagaatttaaattacatttatcccaagggtaatgagaagcctttgaaagactttcaagcaggaaaaaggcatgatcccatgatcggattatcatcattagaaaaccactactaaagagaacagggaggcattagagagttttgagttaaggactgaacaagaaaaataatgtttcaaatttcatttttattattttattgtttacaaaaattgtaaactgccgcagacgatttctctgagggctaactgtataagtataggttcatttggtaactcactcattccgtaagatatttattaagcacctaatgcatacaccggaactgtgcatagataggggacggaggagaaaactcacaaataagcagtctaaaaagtgctaagacttgaaaggcaaacgacacttctgagtggtgggtaaaattccaaaggtggaccaggcagtgtctttgctaaaacatttttcggtatggctgaaccataaaatgcatgggccgtattgaaccactcctttcacaagaatttactgagcactgactatatgctggtattgtatagctttggtgacatggtggtgtatgagaaatcacttaaaatataatagcaataacttttttattgtaaataaggctgggttgattatcaagagtgcatgagaaagaaaaacagagaagtgaagaacagtgccttcacttaaggagggttcgaatggcaataaaatacttttaattaaaacttctctgctgagaatagacagcctttgaaagcttgtgtaaacataaatgaactacatgtaaatatattcatgatattatagctttttaaataacattataacttttaaaatgtcaaatcctttgaatatgaaatgccatcccctctccccaaaaacatgaccaccatgaattatccagttgatcttaaatcaaaagccacttacttaaaagtgaaatgttcattccttacacttactagaaaaactgcttcaaatatgatcagaccttccctttgtcttcagagaattccgctgctgaaacagacccaacaagccagccaaggtccatctggggcagcttagggaaggggcaagacatgttccctgcccaacactatcttttccaacttagcccctgatcatgccaagacatcacagtgtaataatagtaatttaataatgtagtcggccaggctctgcccacagtagaaagcatgagaaaataaatgaggcttgaaagctaaacagagagaaacttctccaggcactgcctgcagcagggagatacctggtaatgaaatacccactgatctccattcattacacaggaggcaaaccttaaaagagagtctagaaaggtggatctctcaaaatagaaataaataaataagctcacctgccatggtggggtctctgaaaatgacttggaaggactgcctatagaatttttgtggggatgcagcaaagttttgtcagatgtcaagggaggtaattattcccgacttgcttgggcacatttgctggataaattggcctctttaccttcatctccccatgcgggcaccagataaagaaaccgtgtttaaactctacagtgttctctctggcttttaccatgaaaaagaaataaaaatgcatcctgggtgcttggcaaatcagcccagtgtcagatggggacccattatctttgaccttcacatttgtgccccttgggactcacagaaaatcctcaaaaactcttttgggtaaagatatatgatgtctaggaggtacccaccttcaggagaaagaaattgcctttgcaatataaaagttgcaaaagttgaagttagtgatttctttattttttatttccatttttgtctatctgctcaaatttttaaaatttacctacaaatgctggaagccttgtttactcaaccatgttatcaacatgttaagctatcagccatttctctcccttccctgctttcctctccaatcaccaagacaacactaacatttctccatcttaccttctttaaagaaaaattcttacagttaactgtctgccatctactaccacttccagaaccagtaatgaaatgtcagaggaggaacagttaattaaaattgtggaatcctactttgcatcctctcacagtcaatacatgtacaattagagatgcctttcagcatgtggtataactagtataagttaaactttgaataacacttgatcattaaaaataaaaaatcattaatgttaagcaaatacgcagtaaacatcttgcttcattggccataaaactcctttagctcagctcaactagtgtggtagatttaatattgggattcacttagatggtgctttttagtaagaaaccaaggaacatgtctacaatctgcaagtggtttatgggaataaaaactgtgcctaattatcccacatgggtttacctaagttgtcatttttttacaaaatttctcaagtttctccacaaacgtttagggaagaaatgacatagaatggtggttaagggttcagactctggagtcaaatgttgtgtgtgtttcatccctgcctctgctacttgctaaacatgacactgccataaccatttttcttcatttctcagagcctccatttccctgtaggtaatatgaagaaaacactattcattcacagggctactgtgaggatgaaatgagataatgtacacaaagcattttaaatagtgaccagaaccttgtaaagattaagtaaatgcaagctggtcctcctaattgataccttattcattcaataattatacttcctaaaagagtctggtaattatgtatttaaaacatattcacgaggtggagccaagatggccgaataggaacagctccagtctacagctcccagagtaagcaatgcagaagacgggtgatttctgcatttccaactgaggtaccaggttcatctcactgaggagtgtcggacagtgggtgcaggatagtgggtgcagcacactgagcatgagccaaagcagggcaaggcatcatctcacccgagaagcacaaggggtcagagaattccctttcctagtcaaagaaaggggtgacagacggcacctggaaaatcgggtcactcccaccctaatactgtgcttttccaatggtcttagcaaacggcacatcaggagattatatcctgcacctggctaggagggtcctacgcccatggagcctccctcattgctaggaaagcagcctgagatcaaagtgtaaggcggcagcgaggcttggggaggggcccctgccattgccgaggcttgagtaggtaaacaaagcggcctggaagctcgaactcggtggagcccaccacagctcaaggaggcctgcctgcctctgtagactccacctctgggggcagggcatagacaaacaaaaggcagcaaaaacctctgcagacttaaatgtccctgtctgacagctttgaagagagtagtgattctcccagcatgcagcttgagatctaagaacggacaaaatgcctcctcaagtgggtccctgacccccgagtagcctaactggcaggcaccccccagtaggggcagactgacacctcacacggccgggtactcttctgagacaaaacttccagaggaacaatcagtcaggaacatttgctgttcaccaatatccgctgttctgcagcctctgctggtgaaacacaggcaaacagggtctagagtgggcctgcagcaaactctaacagacctgcagctgagagtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctcgaaaggaacgcagctcctcacaagcaacggaacaaagctggacggagaatgactttgacgagttgagagaagaaggcttcagacgatcaaactactccgacctaaaggaggaagtttgaacccatggcaaagaagtaaaaaaccttgaaaaaaaaattagacgaatggctaactagaataaccaatgcagagaagtccttaaaggacctgatggagctgaaaaccacggcaccagaactacgtgacgaatacacaagtctcagtagccgattcgatcaactggaagaaagggtatcagtgatggaagatcaaatgaatgaaatgaagcaagaagggaagtttagagaaaaaagaataaaaagaaatgaacaaagcctacaagaaatatgggactatgtgaaaagaccaaatctacatctgactgatgtacctgaaagtgacagggagaatggaaccaacttgcaaaacactctgcaagatattatccaggagaacttccccaatctagcaaggacggccaacattcaaattcaggaaatacagagaacaccacaaagatactcctcgagaagagcaactccaagacacataattgtcagattcaacaaagttgaaatgaaggaaaaaatgttaatggcagccagagagaaaggtcgggttacccacaaagggaagcccattcagactaacagcagatctctcagcagaaaccctagaagccagaagagagtggaggccaatattcaacattcttaaagaaaagaattttcaacccagaatttcatatctagccaaactaagcttcataagtgaaggagaaataaaatacttaacagacaagcaaatgctgagagattttgtcaccaccaggcctgccttacaagagctcctgaaggaagcactaaacatggaaaggaacaactggtaccagccactgcagaaatataccaaattgtaaagcccatcgaggctaggaagaaactgcatcaactaatgagcaaaataaccagctaacatcataatgacaggatcaaattcacacataacaatattaaccttaaatgtaaatgggctaaatgctccagttaaaagacacagactggcaaattggataaagagtcaagacccatcagtgtgctgtattcagacccatctcacatgcagagacacacataggctcaaaataaatggatggaagaagatctaccaagcaaatggaaaacaaaaaaagcaggggttgcaatcctagtctctgataaacagactttaaaccaacaaagatcaaaagagacaaagaaggccattacataatggtaaagggatcaattcaacaagaaaagctaactaccctaaatatatatgcacccaatacaggagcacccagattcataaagcaagtccttagagacctacaaagagacttagactcccacacaataataatgggagactttaacaatccactgtcaacattagacagatcaacgagacagaaagttaacaaggatatccaggaattgaactcagctctgcaccaagtggacctaacagacatctacagaactctccaccccaaatcaacagaatatacattcttttcagcaccacaccacacctattccaaaattgactacatagttggaagtaaagcactcctcagcaaatgtaaaataacagaaattataacaaactatctctcagatcacagtgcaatcaaactagaactcaggattaagaaactcactcgaaaccacacaactacatggaaactgaacaacctgctcctgaatgactactgggtacgtcgcgaaatgaagacagaaataaagacgttctttgaaaccaatgagaacaaagacacaacataccagaatctgtgggacacattcaaagcagtgtgtagagggaaatttatagcactaaatgcccacaagagaaatcaggaaagatctaaaattgacactctaacatcacaattaaaagaactagagaagcaagagcaaacattcaaaagctagcagaaggcaagcaataactaacatcagagcagaactgaaggagatagagacacaaaaaacccttcaaaaaatcaatgaatccaggagctggttttttgaaaagatcaacaaaattgatagactgctagcaagactaataaagaagaagagagagaagaatcaaatagacgcaataaaaaatgataaaggggatatcaccactgatcccacagaaatacaaactaccatcacagaatactaaaaacacctctatgcaaataaactacaaaatctagctccctctccctctccctttcatctccgtctcccgctttccacggtgcccccctccctcgtctccgtctcccactttccacggtctccctctgttgccgaggctggactgtactgccacgatctcggctcactgcaacctccctgcctgattctcctgcctcagcctgccgagtgcctgggattgcaggcgtgcgctgctaagcctgactggtttttgtattttttggtggagacggggtttcgccgtgttggccgggctggtctccagctcctgacctccagtgatctgcccgcctcggcctcccgaggtgccgggattgcagacagagtctcgctcactcagtgctcaatgttgcccaggctggagtgcagtggcgtgaacctccacctcccagccgcctgccttggcctcccaaagtgctgagattgcagcctctgccccgccgccaccctgtctaggaagtgaggagcatctctgcccagccgccaatcatctgggatgtgaggagcccctctgcctggccacccagtctgggaagtgaggagcacctcttcctggccttcaccccgtgtaggaagtgaggagcgtctctgcctggccgcccatcatctgggatgtggggagcgcctctgcccggccgccccgtctgggatgtgaggagcgcctctgcccggccgccctgtctgggaggtgaggagtgtctctgcctggccgccaccccgtctgggaggtggggagcacccccgcccggcagccgccccgtctgtgaggtgggcgtgcccccacccggcagccgccccgcctgggaggtgaggagcccctctgcccggccgccaatccatctgggaggtgtacccaccagctcattgagaacaggccatgacgatgatggcggttttgctgaatagaaaagggggaaatgtggggaaaagaaagagagatcagattgttactgtgtctgtgtagaaagaagtagacataggagactccatttcgttttgtactaagaaaaattcttctgccttgggatgctgttaatctataacattactcccaacccagtgctctctgaaacatgtgctgtgtcaactcagggttaaatggattaagggaagtgcaagatgtgctttattaaacagatgcttgaaggcagtatgctcgttaagagtcatcaccactccctaatctcaagtacccagggacacaaacactgcagaaggccacagggtcctctgcctaggaaaaccagagacctttgttcacatgtttatctgctgaccttctctccactattgtcctatgaccctgcgaaatccccctctctgagaaacacccaagaatgatcaacaaatactaaaaaaattaaaaaaaaaaaaaagaaaagttcaaataaagtgtatgaaagaactttaaaaaaaaaaaagaaaaaaaaagtgcgaaaattagccaggcatggtggagtatgccttggggtcccagctactcaggaggctgaggctagaagatcacttgagcctgggaggcagaggctgcagcaagccatgattgtgctactgcactccagcctaggtgacagatggagactctgtctctaaataaataaataaataaataaataaatcctatttttaaatgctaaaaaaaaaaaagaaaatctagaagaaatggataaattcctcgacacatacaccctcccaagactaaaccaggaagaagttgaatctctgaatagaccaataacaggctctgaaattgaggcaacaattaatagcttaccaaccaaaaaaatccaggaccagatggattcacagccgaattctaccagaagtgcaaggaggagctggtaccattccttctgaaactattccaatcaatagaaaaagagggaatcctccctaactcattttatgaggccagcatcatcctgataccaaagcctggcagagacacaacaaaaaaagacaattttagaccaatatccctgatgaacatcgatgcagaaatcctcaataaaatactggcaaaccgaatccagcagcacatcaaaaagcttatccaccatgatcaagttggcttcattcctgggatgcaaggctggttcaacatacgcaaatcaataaacgtaatccaacatataaacagaaccaacgacaaaaccacatgattatctcaatagatgcagaaaagacctttgacaaaattcaacccttcatgctaaaaactctcaataaatgaggtattgatgggacatatctcaaaataataagagctatctatgacaaacccacagccaatatcatactgaatgggcaaaaactggaagcactccctttgaaaactggcacaagacagggatgccctctctcaccactcctattcaacatagtgttggaagttatggccagggcaattaggcaggagaaggaagtaaagggcattcaattaggaaaagaggaaatccaattgtccctgttcgcagatgacatgattgtgtatctagaaaaccccatcatctcagcccaaaatctccttaagctgataggcaacttcagcaaagtctcaggatacaaaatcaatgtgcaaaaatcacaagcattcttatataccaataaaagacaaacagagcgccaaatcatgagtgaactcccattcacaattgcttcaaagagaataaaatacctaggaatccaacttacaagggatgtgaaggacctcttcaaggagaactacaaaccactacttaatgaaataaaagacgatacaaacaaatggaagaacattccatgctcatgggtaggaagaatcaatattgtgaaaatggccatactgcccaaggcaatttatagattcaacgccatccccatcaagctaccaatgacttccttcacagaattggaaaaaactaccttaaagttcacatggaaccaaaaaagagcctgcattgccaagtcaatcctaagccaaaagaacaaagctggaggcatcatgctacctgacttcaaactatactacacaaggctacagtaatcaaaacagcatggtactggtaccaaaacagagatattgaccaatggaacagaacagagccctcagaaataatgccgcatatctacaactatctgatctttgacaaacctgagaaaaacaagcagtggggaaaggattccctatttaataaatggtgctggggaaacctggctagccatatgtagaaagctgaaactggatcccttccttataccttatacaaaaattaattcaagatggattaaagacttaaatgttagacctaaaaccataaaaaccctagaagaaaacctaggcaataccatttaggacataggcatgggcaaggacttcatgtctaaaacaccaaaagcaatggtaacaaaagacaaaattgacaaatgggatctaattaaaataaagagcttttgcacagcaaaagaaactaccatcagagtgaacaggcaacctacagaatgggagaaaatttttgcaatctactcatctgacaaaggactaatatccagaatctacaaagaatcaaacagatttacaagaaaaaacaaacaaccccatcaaaaagtgggtgaaggatatgaacagacacttctcaaaggaagacatttatgaagccaaaagacacatgaaaaaatgctgatcatcactggccatcagagacatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactgggtatatacccaaagattatgaatcatgctgctataaagacacatgcacacgtgtgtttattgcggcactatttacaatagcaaagacttggaaccgacccaaatgtccaacaatgatagactggattaagaaaatgtggcacatatacaccatggaatactatgcagccataaaaattgatgagttcatgtcctttgtagggacatggatgaagctggaaaccatcattctcagcaaactatcgcaaggagaaaaaaccaaacactgcatgttgtcactcatagctgggaattgaacaatgagaacacatggacacaggaaggggaacatcaaacaccggggcctgttgtggggtggggggagtggggagggatagcgttaggagatatacctaatgctaaatgatgagttaatgggtgcagcacaccaacatggcacatgtatacatatgtaacaaacctgcacgttgtgcacatgtaccctaaaacttacagtataatttaaaaaaataataaaaataaaacatattcacatatttacgtattcatgtatttaaaatatattcatttattttacactatgtgcaactcatttttctacttaagaattagagagatgacatttcggaggcccctaattccaaatgctgccgcctgtttttagtacagatctgtgttaagcaaaggaaaatgaagcggtcaaatcgcctcagaagcttccggcttccacccctgtttgtaaacgaaactccatattagtcaaactacactccccagggagcacctgtaaaagtccctgatttacagaagtatttactttagggtatggagtttgttttttcaggtttatctctgggagagcttggtgaagctgacagtccagcaattttattaaactgttcaatttcagcattttttaaagagcatatataaagaacaccggcagtagctatttaaatttcccagtggatgctagaaataataaaaggacacttaaatgaccatttttgagcagagccaacagcatgtgtcctaattatccaactatgtgaaaaattctgtggatttttaccagagcacaagggtgtgatatgcacaattcagaacactaacggctacctcactagggtgtagagaacttttcaagtctaaatataaggtcccagtctgccagggtaagtttttctgctactttccctcttgatgaacttgttagacatgataaatggacaacatggtaagaagttgatatggtccactgataagcctctgatgaagaacaagtaaataaaaaaccattgtgctaagtgctctccttcatttattctcacgatcacattctgaggtaggtattactatgcacattttacaggtcaggaaagcaaagctcacacaggataagtgccttatcctacagtttaagtatccaagctggtgttctgattttcctccactcacctcttcctatctcttctccacccacctcttcctatctcttctccacccttctctgccctgctggtggtctcttccttactgatctctacagactcatctcccgtgccctttggtttctatagggctaagacaatggcaggcagcattaagggatcagagaattggaggaaagagtctgggggtatctattccccatttcctctctcctcccctcacactgcacaactgagacttttgacaagtgcccacatttttctagctttgactataatttctgtcagtggccctttttccctaattcctagctagggctctcattggattcttgtaattctgttctctgtctttgctccttcagactttccatagttgcttcaccatcttttttggttcccttaaatctacccacacctctgtcaatcttctgttcattaaactctcttccaacctctcagttttggtgtcatccactttctgctggagaaaggagggtagcccctagcagttggtacctcctcctctctagcttccctttcatctacccacaaccaaccactcacccttcccttgtagccagtcacaccacaagcaagtctgtgactcagcaaactggctcccagaaacaaaccctaggagcataattgaagatgaacccaaagatacagttataagtatgctcgtggagaatttgtaattttttaaaaaatggtagttatctaagaggacttgattaatcaatgaagggacattcataaaatgaaaaattataaatgattaaaaataataccataacttatatttcatgacatgaacatattctcaatatattaacttcaaaagggaagatacaaagttgtgtgtagaataactcagtttttctttgtaaaaattttgtatacatggggagaaaatggtccaaaagagaccatccaatagaaatacagtacaaggcacataagtaattttagtgtcagtagttacgttttaaaaagttaaaagaaaccagtgaaattcatttagtgatatattttagtccaacatatgcaaaataatatttaatcatgtaagcaacagaaattaataatgtgatatattgaattcttcttttgcatatgaagtcttagaactccggtgtgtagttgacactcagagcacatgtcaactcagtcttgctacattttaaaagctcaagagccacatgaggatagtgactaccagattggacagctcaggtaagcctcaaaagcgggtgtgtagagtaggaagttgaatgttcttcactttcttattatttttctccttttttaccattaccatttactactgatgcatgtcacctctgcaattagaaaaacaaattatttttaaacactaagagcaaggcttttttcttctgtctctggaacactttttggctcatgtcctttgcaattcacagactacacacttactagtatagaaaggtgccctcctttcttcccctccctttacattttctttggatagctacctatcttcagccctcaggcataagagtaagaatcaaatgttgattttcttcagagtggctgctgagccagctcccactctccagtggtgtgacccggaatctatcaggcctcacaccactgttttagcagctctgaatggcttgtggaagggcatggaatggggccagaaactgcttaatttgaggttaattaaatagtgatgacaagccttaatctccaacttgtcatcagattgtaaacactgattgcagctgcagcaatctgcaataaacctattgagaggaatcttgaccagaatgaaataagtacgttggttacccagatgaggctgggagaggtgagatcagagaaatctaggcttttgcagtaccaggagaaatggagacctgaaaagagggaaattcatgggcgaatgtgtcaattctgattcctgtacagccctatcaaaaaaaagaaaaaaagaaaagaaaaaataactggatcccatgcacctggaaattggaaagaacaagggcagaaatataaaaccactaaactaaggacctggaaaaagctgaaatagctttacatctattagccattgatgaggtttccatgaaaaaatatgtctgagccactgcatgccctgaggccgctggacagatggttataccaccagagtgagctacagcagtggctttctagagtgcaggcaaggatgacagttacagtgtgttaggtctctactgtgtctcaagcacatcacatgtaacgtatatgataattctcaaaagtactttatgaggtagctattattttctccattttaaagaggagaatgctaaatctcaaaggagtatcctaccttgcttaagtacatgtaacaaatgggttgaacccagactgtctaatgccctaatgcaaattctaaatcacaagaatctctgcctccagctttgaggcaatgttgaagtgggaaaggggaaagaatagtcaagttcctgaagaagatgggaaaaaatgagtcaaaaatctccaaagaatagggaagcacaaagggctgaggtaacaaatgccagatgagtaaacatgttcataacactgcaccccggaaagtgcccctcctggctccattttcatggagaatgctttctcattcttcaagatccagcacaaggccaattttcacctcttctgtgaagccttccccaaacctcctagtgagagaggcactttaaaaaaatatgtgagatgcattgagagacagatggacaccataaaagctgaactcaatattacatgtgaagaaaatttacaaaaaaatcttaatctgagtgtcagaaaaattggagtagtgaaagaaccattacagttattgtcaaatagttaattaactattatgtaggtttaaatccatgtattcttccttaaaaccttttggaacaagataaatcattctcatccattcatttattcattccctagcactgtgataacactagagaaataacaatgaccaaaaacagacacaattccactctcgaggtacacatgtttaaaagggaaaacagagtaatgatacaaaaatcacacaaataaatggacaattatgacatgtgttccaaataagaggtaaatgagatgttattattttatccaggatacaggactggaatcattaaagagaatacacagggaaataagctgcagttcattatttggaaaaagtttcaaacaatccacacagaaatggccccacacatgagcctgctctcttctgggcattggatgtgtcccggctgaggcagggaagacaagggtgcatccgtcgataacttctcaagtctcttctgactctaagaaactgtgaccctatcattccaaacaaaatattttctcagataagaattagaattggctaggttgaatttccaggagacttaggaaatatgtacagagaataatcacttcctaaatagagaggggagtcaagcaaaactgagtcttctaaactgctcggtagcattctccttctcttcgcacatggacacacttctgctttatgcactgccctgacagcttcctgaggacagaggctgatggtcttgctcatcactgaatcatcaatgcgtggcacatattaaatatttgttaagtgagtaaatgaatatggtactaaaatgtgcatactgacagaaacttttttctgttgtggcccttgtaggtgaacttccttgaataattaatgaacatgaaagtcagtcaatcactcacctcctgattaatagtcagggtcccttgtccaaacagccacttagtccattaaaaattaataattttctacagaataaatatatgctgtacatggtacatcaagggttccacttttaatacgcaattaagtaatgcagaaagactaggaatctattaactaagaaagagctccatgaacttgccctccaagtcatcattcatttactatccatttctcttccaattttaaaaaattatttagccagaaaaaaagtagttctgaaaacagagtaaataacaacatgttgtcatattttggctaacatttgcaggccgacacaatgtgtgtttgttaaagatttgagatatgctattccttctgtgaaatgacgaatacattagggcagatcaatacaaaactgaagctctatatgtaaaatgttaagggtctattcattgaaaaattatgagccatgttatagaacttaggtcagagttaaattattgatctacattcatttttcccctttccatgtgactatcttttgattttttataacatacattattgcctatgtagaaaatgaatcctcttcttctagagctagtgtgtctggtgactgacaattttctaaaattaactgttgtgttggtagcatttagatttgtaaattgaactccccttgcataaacatttaaacattgaaaataaaatctgtaaactttggtagcatgaactcaaagggaaaagaggataattttcattttttaatacaaagaaagcaaagaaaaaaaggaaaggttatttttcttaacatcattctactactttatggttcttgatacatttcattgatgaggccaaattgtattcagttgactttttacaaatgactaaactgtattgctaagcaaagggatgtaatcaacactttgtgagctgaagtctcaattttcagacctaaagcttactcaagatgtataacctcaaattctgtaagcaggttagatgtcttgaaatacaaagactctcatcccctatcagcccccaaagtgacaaaggaatgtgtcttcaatgaagattttctctcatctgctgaaaagggaaaatgtgcaaatatttcaaagaaatgtagattccacagacccacattaattcatgaaaaaggaagctaatgtaagagttcttagtaggaatgatctttgatttggggctgtatttggtcagtaacttttgcctactaggagaatattttctctttaacgaagtagtatcagacacagagggctcttcattttctctaatggagatacaatcatttagattcgtgctccaaatgaggcagaaattacccctaatgtgtagtttgaacatttgtatcaaaatacagtgaaatgctgtttcagagtctgatgagaaaaatatgtgagctcacagaatgtctgcctctctcaggtgcagaagtggtctactgctttttttttcttttttcttttcttttcttttttttttttttgagatggagtctcactctgtcacccaggctggagtgcaatggtgaggtctccgctcactgcaacctccacctcctaggttcaagcaattctcctgcctcagcctcctgagtagctgggattacaggtgcacgccatcatgcccagctaatttttgtatttttagtagagatggggtttcaccacattgttcaggctggtcttcaactcctgaccttgtgatccgcctgccttagcctcccaaagtgctgggattacaggggtgagccaccacgcccggccctctgctacttttcttcacattgtcactgcaggaatcacctggctctagggggatatcccacagtctcacataaataccaatccctgtcgctggaacaagggggtcccagcctcacagaaggcctgagggactctgtttctctacaggtcagctccaaagcagagggccctttgcaccataaatcaatgtcatccacagaaaactccaggagaaagttaaataccagcagcaaacaatgtctcttgtgtagcagtctctcaccactgtttctgctaggtgacaaaagcagtgagaaaagcagaggaagcaagggctgaagacagaaaagtcaaagaattgcagaacttgagagttggaaaggggcagagtccaaataggaaaagacttaagcttcctactgtgttgtgctatgtagaatgctgtatgaggaagggcagcaggctttctccccagaagcccagctgaaagtcatccacactttacatggtcccctataccaggcttcagcccccttggccttggttttctcaacacacagtatggaatccatttctcatgagatggacttcattaaacacactcatgagaccaacatataaaaccagaatgtcaaagtagtagtctacgatttgcagtatagctgttgcacagatgtcagaaagaccaatacattcattcccttcctgtaaatgtcttccctgcaaaaccaaatcctaatcaggcagcaatctgacatgtaaggaatctgaacaagaggagttcatctgatgaactgaatgttaaacagcgtcaggggagatggagtcaccaatgggaaagaatacccaatgtcccttggctgcagctctctacatccattgccgtaacagaaatggccttgccaatagaaaaacaattctccaagtttctcacaggaggtcccgtcccctccaaagagagctacatgtgtattctttgtgtatttttatcattgagaaacataatttgaatgggaaagcctttctttcgttctaaaaaccctgcatcatttttctcattgcaggttaaaatatgttcattgtaaataatgaacatacggaaaagggtaaaagttattctatttcttccgcccagaaaactataggtggataatctttcagtctgtttctatgtatacatcttaggttgtccatataaaattatcattttgcagataaaaagcagtcaattaggtgcaattctacatggtccaatctcatatacatacgcacattacattaaagtcaaatgacaccttaacttctactttgttgcttttctttgaattaactagggctcatatacagttttccatgttactcggtaataccataattgattctcttgcacgcacttgtttaccaaaacttctcattatttccttagggaatattcacagacatagaagtgcttggttaaaggatttgcacacacacccattcatgcatatactgtctaaggttgctctcatcattaacagcagagttgagtagttgtgaccatactaccaaaaaacctgcaatatttaccctttagtcctttacagaaaaaggttgccaaccctgacctagaatccataattaactagatacagaatccagacatccattcaacaataggacacagacttcctatttttaaaaaattcaccgtgactacaagcagatctgcatttaaaatattttattcccattagtatttttaattggtccaaatgctctatgtgatataacttcactatcattagaatagtattaaagaatactattagaaaaatgtagctccattatttttactacagaaattattataaccgaagacataaatgcgaaccaaataaaacaaaataagttgtaaaaattcctttcttcaacaattgcataataatctataatacacatagatatacatgttcttaaatatttcatgtaaaaattggttactatttaataattaattttagaaacattaaaagaaatttaacttctgggtctttgatttgaaacagctaagaattttagactggtttccatttttaatcatgatcaagactcagaaacgtagctaagaaaaatcatattgtactttttattgaaaaggaatcacacagaccatgtctgaattattataaaggcttcattaattagattttaatctacatgactataccatatgctaaaaaaccatccaaacaaactctatgaaacggttttactgctattacttaaagagccatttaaaagaatttctacgggataaagactgggtgatttatcatagttttatgctcctttaatctgctccatcttcccattgtaaaataaatattggttttaaaataaatggttctgcccaggttttgatgagaaaaattgccctgtaaatcacaagctcacgtgtgccaaactctaagtccaatgttaactagcctattctgaagaaaaataagtcaattttatagaacaaaatctaaagaagacaattacttaagtgtattttcaaagctgcaatgtaattaatctgagatatgagcttctgtaccccaagttttttaattctcaaaataagaactagtggatatcaaactggtcctccaactggattttttaaaaatgggttctgtactatagtttttattatattctttccgaatccaatatacaagttatgtaactgaaaataaatacaatgagggttatatgataatgtctgagggttatatgatgacatctttatcaatcacttttttcatacacagagagccaaatcaatttaatagtcaggttcttagaatatttcatagtgttctgaaaaattgaccttacagtatacatattttcctataataagcatagtggttaaaatgctctggaagttatgaatggtttaaagcagtgcttcacaaactatttaggatgtaaaactagttgactatatttttcactccaatatgttgtgggttggtgatacttttataaaatacaataaaaattgcacttggatttagtggtagtgtcaaactgctatgacagtctctaaaccagcactgtccaacagaaatatcataggagccacatgtctgattttaagctttctagtagccacattaaaaatgtaaaaagaaacagttgaaattaattttaataatattttatgtagtccaatagatccacaaccttatttcaatatgtaatcagtatacaaatataatggagatatttaactttttaaaaaaattaagtcatcaaaatccagcatgtatattccacttacagcatgtccccattcagactggccacatttcaagtactcaacagtcacatgtagctagtggctgttgtgtgggaaagtgccattttaaaccattactcccaaactctgcacctccctcttcatgaactggtccacatacaacactttgagtagtactgtctaaactactgctcccttaaaaatggcaccttcatttctcttctataattttctactctgtgttttaaattgagggctccattccagataagtccaacacttaaagaaattaacaaactcatgattgcagctaactttatacatcctttcaggaaaggaatttgcatttataagggatggatacggaggtcccctctgctctcccttctctagaagcaatcactattctgaatgatattggtttctttctttcctatccatgtttttatactttttctactgactatgttcttaggatttaaataaagcaaagagaaaatttgtttgcacattgctgagatatatgaatttaatgcgtttagctcatacaaatcctgaccatattccatggcaaccactgaaaccgaatcacacacctttctacgtttgcaccctctgatcccctattcgtccttcataccacactgctttgatatatcattttctttctgctctgtatttagactctgttccaccttctagcctggataatttctacccattgagatcaaagcttaaatatcacttcttcaagtaacctttgttgatctgccctttgccctggtaaaattaggttccctgtcaaacactctcacttttcctatactgcacttaccaaaattgtaaatagtttctgttgttgttgttgtttttgagatggagtcttgcactgtcgcccagggtggtacaatggcacaattggctcgctgcaacctccacctcctggattcaggcaattctcctgcctcagcctcccgagtagctggattataggtgcccacagccatgcctggctaatttttgtattttttagtagagacaaggtttcaccatgttggccaggctgaagtagttattttttttactgatttgtttaatgtctctctcattcataaaaatatgttagcaccagcataattaaaagtatacagtaggtatccacaaatattaattgagtgaatgaatgaattttcattctcagaagccagacttaacctggtcattatgtttctcaatctctagtcatgacactagcttacaatgtgtatatcatggatatatatacatagggtatccctgttaattagaaggtatattttcaagagtatggccataaagaagttattcatggtatattcttttgaccttctattttcaattgtctctatatttagctcccatttttcatttctaatactgtttgtatttctctctctctctctctctttgttcttctctctttgtagttgatcaagtttgacaagtgagaatgtgctgttttagtctttaaaataatcattttttgctcggttgatcttctctactgtttctttgtattctatttcatttttggtaatatttttgtattattccttccctctactgtatttgggtttactctgctattttatttatacctttttaattgaatccttaattccctaacaatgtctccttccgtttctaacgtatacatttatgagtctataaatttccctctatatacctctttgtgtcccacaagacttaaagtatgtactaatttctatcatcatttttctttgactcacaaattattgacaggtacagttttgagtttccaaatgtataaagttttgaaaagtatcagtttctaatctcctgcttttttcctctgaaataaagaattagtaaatataatttttattcatcagcattaagactttctatgtgtgtatattatctgttagtggagtttgaagttctatatatgtctatttgtccaagctaaccggttatgtggtttaaatattctttatcttttctaagcttcttagcttgtttgatttatcagtgtctgagagaaaaatggttaaaactctcagattatgattatatgggttttcaatacttcttggtgactgtgtcaatttttactttctatatttttaaaaggatgctactaggtaatgtaggctcaggattaactcttcctggtgaattgttcttttatcattaaataataactctttatctgtaataatatttttgcttttaaagtatattttgtccgatattaatagtgtcaccagctttcatttgaatgatatttatatgatgtattatgtcaatttcatctattttctcttaatcttcccatgctattatccttaattgggttgttccttgtaaacagttaaagagagtatagctgttctctctatccaacttaagaatctttgcctgcagacagataggtttaatcatttgtatattggctttgattactgattatttggcctcatttcaactaattaatctacagcttcctaaaagtcagtaattatggcctctcactgaaccaagtactgcataccatagcaagcattgctgtatctatcttacactcataatttagctgttctcaataaataatttagacacattggcaaataatattctcttaaagcttcaagctcataagtacttatatatataacacagaaaatccccaactaagatggctaatccactactactcttatttctttacctataacatgaaaataagtgaatccacttgtcatctacctccaatgttgctgtactttcctcttcaacctcctcatttttaaaaatttctatcgggaacagctctcattctgtctcttctacctttcttcttccctatcccagtctctcacctgttaccttgacaattgaattagtatcttttctctccctgccttcatcctaccacctaacaatccaatgtttcctccagttaaatgagggtcgcatagtataagttaagaaatttgaactttaccctacagctcagtgtttctcaaactgaacccaaaggcacagtatcatagctccaaacattctatgagaatatgctttaggtttttatggttttattccaattaatgtcctgaagaatctaaatgacaacctgataattgagctatgctttccaaaagcagtgcctgagtttgtcttttttttttcctccatcaactctgttctgttctcagtatcactggaaccaaacaatcactttaaatgacagcttttaactttcagtgtgtcagtgagcacatctggctgctaggttggcatgtcctaatgctaaaattgtcccatgtctgctattgtgctcttcttgaagataatttgcaatggaaagatagtgtcatggaataagactttaatttattaagttatttaattaatggagactttgatatgacatcataaaaactcatagtgtggcagagtaatggtctattttaattgttatgggctaatgagaaaagaacaaaggcagaattaacatgtaaatgatgcgtttatatcaaatgaaagccaaatgatattatgggacagtgcaaaaggaagtttcccaatttttcaaatagagaaaagtggtgagaaaattgagtcatcatgtggctctgagtagtagaggcatgccaaattaagagtctttgccatagtagtcagcacactttattgatgaaacattaatttatcaaatatatgttaaatacttcatcaataaacagtgagtgttaaacactgttctaggcactaaggatacagaagtcataagatagtcaactctccagtgtcacggaagttatattctgacaataaaaagatgaacatgaatttataatacaacatcagggagtcgtaagtcttgtgaaggaaaacgaagcagggcaaagagatggaggatgatgagggaggaggaaagctacagtaggcaagatgatcaagggaggattctctgagaagatgacatttgagcagacacctaagtgcaacaggaggcaaaggcatacaaatatctcggggagaagatttccaaacaaaagcaagagcaaatacaaagatgttgagaagaacagcaagaaaaccaatgtcaacagactgcagggagaaaggagagtggtatgagactaggtaaaaagaagagggctgaatcttgaagagccttgaggtcatagcaaaaagcctgaatttaattctaaggatgatggggagttactacaggttttttgttttgctttgatagagtctcgctctgtcacccacactggagtgcagtggtacaatcttggctcactgcaacctctgcctcctgggttcgagtgattctccagcctcagccacctgagtagctgggattacaggcatccatcaccatgccccgcttattttttgtatatttagtagaggcagggttttgccatgttggccaagctggtctcaaactcctgacatcaagtgatccacccgcctcagcctccctattacagggtttatacagttcatgcagaataccagaaagggagatggggactgtggggatggatacaggtaggcttgtagatttgctagagaaaataaggtagtttcttctgattgtttctctttctccagtgaaataagaagtgagacaatcaactgattgagagagctggggatggccattggagagttgaggtacaggtgaagatataaaatagttttctcagaaagtagaagtattaggtaaacaatgcaggatcaccgtgtagaacagaggatccactgcagtcagcatagttgtgtgtcctccatccatccacactcaggcccaaagtaggtggaaagctgaatgagggtcatagttttgccagataagaatgacagagaaagatgagcaaaggagttcagtgtgcatgtaaagaagagaagaaccatagcatctgagctgagcaaggaggaaagtgaggatacaggaggatgacggattgtacataaatcctgtaagtcaacagattggaggccccacaggatcaaagaactgttggagtagagatgctaatgtcacctgaggcagcagccctgaaaagataggaagtggtggtcagagagtgggatgctgtgaaacatactttgaaggttagcatggcatttcataacaagggcactattggcatttggggaaaacaattcttcatcgtgcataacagtctcatgtactgaatgacatttagcatccttaacttctgccctctaaataccagtagcactccttacatttgcaattactccctaggagagtggtacttcctagattgtgaaccattggcctggggtatgactatgaggtagggagagatatttgcaagtgagaaactcagggacctgatagaccaggtatgagtattctctgtggatgtttttactgagaatgatgagtataaagacagggcgctggggggaacgtcttcaataaatacagaggagtaggctgtagaagagttttatggcatgtgctttaaaagcctctgcggaggaagagaaaaggaactgtctagaagtgacaatgaacaataccagaagacaccaactccactgtcagacactgagaaaaaaacagacacccctggagagggtgatggggaagcctccttaagagtttgccaagagtatcaagcagctatccaaaagaactttctgtgatgatggcaatgttgatatctacgccatcctataagatagacaataggcacatgtacttcttagcccttgaaacgaggccagtgtgtctgaggatgtgaattttttactttgatttgaacgaatttaaatgtaaacagtcagatgtggctactggctaacaaattggatggggcagaacagtaaaaggtgaaggaagcattcagaagacaaaattcttcttaatctctgagtcttgaggaaaagggcaagggcaggtatgagtctagggaagtttgtacatttgtagcaggaagaggtgaggagcatctaatagcacaatagcatcagcatttccaataagcaggattccaaaaattcattttaatttatttcagcctcctctcagactaaattctataccatattgttgtggaagacccttaaaaaaaaccctcaaatatttaaaatatcaccatcatgtaagaattatttcttctcctaagaagcatctggtattaatagactatgactatcgcgtgttttctaagatctaagtgtcccttccctccaaagactggctatctatatctaacaaaggaaaatgtaacatttgaaaattccctgttaaaagattttgttgtcatttggaaatcatatttcttgctgtttgcatttctattaaaaatataaagaaatttgttctttggtatcccaaatgaagtaaaagtattctaattggttgcattcacaagtctacaatttgcggcttaacaaaattatttttgaaaaggtcataacctgtacccacatgcccacccaaccacacacacagacatccagaatggtcttgtgatcatgtcttcagaagtttggctgcaaagttacaagcaacaactgtccatctgcacccaccaacctagtgaacaatgccagtctgggacccaaggactatttactcaacagaagaattccaacttcaggcaggggataggcgaagtccagataacatctagatatttcttgacattgcatttgattggaaataaaggaaaagtaaagcatttctggttagtttctgtttcttagtgtctctagttcccattttatttcaatcaaaatatcaaaatactctttagcccatagaggggacagagttcctagtttaataaaccctaaaatatataattaagataaagcctctgtagggttactcagcacaacactataattgctcagattccctagtggattctccagtcaatttctctgcatccttgaggcaaaatcttttccttaattgtcctcacttagaccaggtgctaggtgtccttcctagcctgcaggtcttacaggcccattcatccctaagggggtcttatatattaaccttgcttctgaactctaagcactggcaagtcaggcagaaggcccaaaggacctaacagcccataggtaactacaatgttggtaaggtggattctgccagatgccagccttggatccattttgggtccctacagatttatgcttctactataatgaatttcataatttctagtatgtgacccagggttgaactaagaagttattcttgctttcccctttagttttccctaatgggactttgatcaacatgaaaactaaaaatatcctggtgctagaccattaacactagttaactattccagactgtggccactgtcaaagacagccatcttgtaattgaattccactggggacaagaagactcaaaacagagtaggtgaatggattgcttaaagtccatctcagctactaaggagaatgaagagcagcagaaactgaattattaattcccaactctattcacaagccccctctggtggaggaagtattagtaatgaaacagctataacaataaccaaaatttttttaaaagagaaaaggcaatccacaacaaaacaatcagcccctgcagaaatgagagtcaagtgtagtgattagcaaatatgagctgcaacctgaaaaccacttacagatgaagcagtatgatgaatgatttaccaaaaggtcaacaccgctcttttgtcttcatcacccatcagttttccatcgccctcaatttgtctggcacataacagaaagcagggcataaaatattccccataaaaattaaccttactttgcaacattaaaaaaaaaaacttatagttgtatatagttgaagcgtaggggccagcttctcaattagtactcctagcatacagtagaaaaagcgttgacacttaaagccctattacaagaggtaatgttcttagcaagttccggaactctctgccctattcttgccttgctgacccactattctcaagcgaaggaaggggtcagtaatccccctaccaaataccacaccaatggtggcaggaggggagcatgtgacagcatttccccttttactctcctggaggccaaacttctttgcaatctctgcttttagctagcgtggatgccagcctttcaaccttgctatgcctgcaatactttctgacagatgagctatgagatgtaccaccttcccactcccatttgacaacctttgtacaaaaagaaacacaacgccaagggaaagtatatttttaggcatgagggattctgaaaatgaacatatctgcaaacttctagatccccttaaccagacctgaaaaagacattaatctattttaactaaactgattaaattgatttaatcagaaagcgggtcacttccctcctccctatcctgtcgctgaatttactaattgtttctccggctttgcccaatcaataagatattttgcatcttgcagatataatgtaagttatcagttattaaaaattcctcttcccggtctctggttaaagtgggtacctaaatatctgcttatttatttacgtcgttgttatttgcagatttcttttttaaaaaaagcagaattaaaatgaaagaaaaggtcaaaagagtttggaaaaaaagctatctacagggatgttcatcactgcatcatttataatagtaaaacttggaaatcttaaatttccaagcaaaagaagactgttcaaattaattatggtatagccataaagtggaatacagtcatgcatcacataatgaagttttgatcaatgacagaccacatatatgatatcgatcccataagattataatggagctaaaaaattcctactgcttagtgacgttgtagttgtcataaagtcattgtgcatgcattaccttttctatgtttagatatgcaactacttacctttgtgttacagttgcctatagtattcagtaaagtgatgctcacaagagtatgaaattgtctaatgacacagttttcattaagtgaggcatgactacactatgcagacattgaaaattaagtggtggaatatttaataacaaaaaaagatttgtggtactattaaggggggaaacacattgcaaaacagtagatactgtaatatcatatttattgagagctgttatctttgtataccattggtttgacaaacattcattggtcagccatcttccattcataacctcttctctccagcattccttgcacttgggaattgttctataaaataaaatattaaagaagaaggctgctaggtagggcttttttttctttttttttttttgagacggagtcttgctttgtcacccaggctggagtggagatggagtctgactctgtcgcccaggctggactgcagtggcacgatcttggctcattgcaacctccgcctcctgggttcaagtgattctcctgcctcagtctcccaagtagctgggattacaggcacgcaccaccacacctggctaatttttttttttttatttttagtacagatggggtttcaccatgttggccaggctggtctcgaactcctgacctcaagtgatccacccgcctcggccttccaaagtgctgagattacaggcgtgagccaccatgcccggcctaggtagggcttttcttcttgtctgattaaaaggagcggatttatctaacaggtctctttttgtatttatcctttatctttccaatctaaacataacgtctggaggaacagcagcttcattgtgaccatgaagacaaaaaaataacacgctaagaacagtagaagagaaatgccaaaacatcagctctagattatcctctaaagacttggagaaagtcactattggttggattttctttattttgcagctgaacacattcctgatacacaggagattctgtttttgttttttgcttatctgtggcttttatattttctaccatagtatgtactgttttatcataagaaaaaaatactggatacaagaaaaagggtcttttgtattcttcaagagaaatctagaggctgtgagttggagtctcaaatcatccaaggaacaaaagcacaggcaaagaagacatgccaataataaaattcttagagctgcttaacattattaatattttcattcccttcaacagaaactgtttacagctattagtattactgtttttcgagtcatggaacacttaagatctactatggtgtcaggtgctacttaaggcaccaagtatccaaacaataaggcagcccatgaccaaaaggaaccgtaacaagcaaacgaagaggaaaaacctagcagggtaaaacacactgcctaacattgctcagctggttaatggtgaagccaggactggaatgcaggtctcttgacacctaacgaccttcatcaccctatcatatgcttaacccacttaccatttagaagaaagaagtgcagcttgctaccagcacaacgctctcggagcaaacgggaaatgggttaagcattaatatctggctaaaagatgtaagaaaaactctggtgagagtatttaaggagaatgatctagatgggggtcaaaaaacatcagagacagaccttgttcttcattaactagtatttatagttatagcaggattgttttccctaaataaagggaaaggtctctttgagtggggcagaaaggattccactttttggctgggtgcagtggctgatgcctggagtcccagcactttgggaggccaaggcgagtggatcacctgaggtcaggagttcaagaccagcctggttaacatggtgaaaccccatctctactaaaaatacaaaaattagctgggcatggtggcgggcacctgtaatcccagctactcgggaggctgaggcaggagaattgcttaaacctgggaggcagaggttggtgagctgagatcatgccattgcactccagcctgggagacaagagcaaaactccgtcctccccaccccccccccaaaaaaaaaaaagagattccactttttatctatctataccacaccgaatcagtcgatcaatccactgaccacagattgtaatctcggccaaccactatagtggggaaagaaaacatagcagtgcaatcagctgttggataccacaggcaacttgacaagtcagtgacaacttggcctatttattcatcttttaaccgtttgttctggtgtctgtgtagtcacaatcaaagaatagtccctaggaatccatggagtttcattgaaatggagttagggctttggatcatatgcagaatctcagtactattccaggagaagggcagccacattgcctctgaatggccaaaacatagggtagtgaagagtgggagaatatgccagcccgaaatatgccactttagcctaaggattatgtggagctaaaggcacattaaaatacaaaacaaaacccagcaggtgcaagaagtgttctctaaccctcccctttttcttcctgaaaacatgaaacaaaacccccatatagaagacgtccagctataccagaaggaaagtctcattcttatcatcaaggatgggaaaatgagactaggaaaagtctgtacaaacagatcttgttaaaataattcttatcttcctttagcctttccacacagttgagttacttttccacaactgcctctctttgttcaacctaatataaaaccatctaggttttgccacttctttgagtcttcatttccttatgaggtatctcatgtcacataaaacttatattaaataaatgtgtgtgcttttctcccattaatctatcttatattcatttaagtcttaggcccagctgaaaagaaaaccctaaaagagtgtacaattttgcctcctctacagtatccatcttgaaagctgaaagttcactctcaatatgccttaagaataagaacaagtgggggcatgttttttagccatagttattcgtaacccaaacaaacaagtaaaggataatataagtgccaaaaatataaatgttgtctggattcacacatatcttatttgagtgactgtcattttatactgtcgtaatctgtttgcatgtctgtctttccactaaactatatgctccctaaacgcaaggacgatttcctttcatctttgctaagaatgtccaagccttcctccttccaaggctcgaactggattccaactataaaagtctataaaatatgacagctatttggaccgaaatccttcattccaaactatcctacttaaaaaaaaaagtcaactttttaacatttccaaaatatcctgaagggagggaaaaatcacacattaaattctgtcaagtaacatttacctcctcaagccctgactaatcggaaatgactggacttggcagctccttttatcacgtggtctatcagctaaatttagctcctgttgtgccaattgaaaaatgccaacatcccttcccatctcatacaacatcccaacccgccaatgactctagggtctctctggcaatctggtgtgaccactcctcatcagatcaaaatataaattacaaaccaaacttaaagtgtccaagtagccccatccagaagagcaatgatgaagttagaagagacgaagacgagaagggtgccagattcattactattgattccctgctggtctttcaatgtcacggaaagatgtccattatagttctatgaagagcatttggctcagtttaaactcttttgttttcagttcctttaaaaacaaaaatcaaccacgaaggataaacaactagaaattaatggagcccaaagggtttctgcagaatgagaagccttcatcactgcaccctaattatgtaaatctgctcctgcagagtccagtacatttatttattaagtctcaccactgccatcctggtaacccagagaagaagccaatctataatgactcaagccacatttcaaaatagactccaaaggacacatgatgtcatttgctaaaatgactcaatccagatggaaagcattctgacctatacataattgattgacctttgctatgctttccccagttatttatatactatcatatgcatgaatgtatatcagtggtatttacacttggcagctacttttaagaacacattattcaattgggatttgaagctttttacgaccatttcctgaccaaacattcataaatgacgaacaaggaaagatgttatcttaaaaataatgtttaataggctctggagagtttagagaagctttgctactctagttattttaaattacaggggacaagatctatgtacataaagctgagttcaaaccctgaaactgaggataccaaaggacattttatttactttccagtttggagctcaataatgatagtaaaatatgctgtacagaaggcatggaatgttttagatacatgtgagaagagcatcaactgtggtgaaggtagttagagacaataacaaattatcagaatctaaccatggatttcattttccaaaagaggttagctgcaaattggataatacccagataatcaagatagtttcaagatgatcatagaaggggaggcagatagattagggaaggcaaatatgaagcaagcatgtctttactcccattaggaatacccaaggcagacatccataactgattactgaattcttaaccacagagccctcacttggctcaaaatacttttccaatagtactccaggcaaacaccatcaaccaaacagacttgtcctaataacataaacagagaaagttgtatcttatttactgatcaaattaattctatttattgttaccatatactccaagattcaatctaaaactaaacaggtttttaaattcaaaatttaaagtcacatctctgaatcctaagaaaacgttaagtcaaatctagtagttttccatacttcatggtaggctagaatgacccttaatgtaaatgaaaagcaagcaggaaagctaaacaggagaagatgaaaatgcttatatgttcacataggaatattatatagcagtgaaaaggaaggaactacggccacatgcaaccacaggaataaatcttagaaacagaaatccaagtggaaatagcacatggagaagactacatacagcagtgctttccaagtagtgtgcctcagtaagtgggttacaagtgttcccaatccccttagttctggggtgaatagtacctggagtagccaaagtcttgtgtcaagccagagcatttatatcaggaggttctagaatattttcaagttctatgtatgccatgatggaagaagttaggaagcactgacatacaataattctttccagagattaaaccattataaaaccattttataatacttaaaaactaaaatgtatctgcttaggcatatatatacatatatatatatatatatatatatatatatatatatacacacacacacatatatacatgtgacaaatttatttcaaaatgataaaagaaaagcaaggaaaacatgaatggatacttcatccagtacatccattcattcagtataatggttactgttggaaacaataggcaggagatgagttaggtacaaaaacacttcagtagatggtaatgttacagttcttaaggtagatggtggttcatgggtgtttagtttattatactccaagcatattattttataaatacaacatgttatatactacttttctcaaaacatcaaggttaagaaggaaggaaactttttagctgattctgagtcaatttttcacagttgaatctcaatatggcaattcaagaatagatacaactacttttggaagactgaaactcagaggtcaagattttgtcctcatgcaactagaatagtccaaaggtttctaacagtcaactcatgtaccctatttaatgattacaagattttgttctaatccaaatagagtattaatgaaaaattgttgtaaacctaaagttacatttccctactgaaacaaaaacatcacaaaacccatatgtaagcctcttagttaagatccatttagttataaaaaacaaaacccaacctgaagtgttcaagtaaaaggattctggatgaggaattagaggtatcctacagcacataggatagcaagtacagccaggccttatgaagaaccagagccagggtgtaggcagcctttcagatccgaggttgaaacattctctctctcttgggctgcaggttcttgtgtctctacttctttctggaacctttactttattgtccctacctttagctgtgctttttctgctttggcatcgacatgaccaaatatttgtatctcttgtgatttaagtttaaaccaagtagtgccctgaagacaatttcaaaatgcccagaggggaaaaagaatctaattaacccaaccaaggtcaaaatctgtctacaccgggtttaatcagacacagctgtacataaggagttaccaattccaacaactacaggggccaggcaggtaattaaaagtatgatgctgaccaggtgtaaaaccagaagctggaagaaaagggtcttacaacaaagagaactcatgctgcctctccactttggatatgtaataatagaaatccagattttcattgaaatttcttgatttttaaaatacatctgtatacgttaggccacaggcttctactgtcagcgtcctacaaaaaatgaattgtgaatatttcagtttcggggggtcacactgggcaaacctgacttagataccagccctttgggtagaagagcaggtctcacagaagggctcatggtcaggcagtactgcaacaaagcctggattatgcactactttacacaccctccccatgaaatacacacatcagctaaacttctaaaaatatcttgttcaaaatcagatactaagccgggcagagataatcatcatgtagctttgtatgggttcatagtaaaaagcattaaaaaacaaagaaatcacacaaaagcaaactagagccagaaaaacacagcaccatcttcttcttttctttctttcttttttttttttttttttttttgagacagaatctcactttgttgctcaggctggagtgcagtggcgcgatctcagctcactgcaacctccgcctcccgggttcaagcgattctcctgcctcagcctcctgagtagctgggattacaggcacgtgccaccacacctggctaatttattgtagttttagtagagatggggtttcaccgtgttagccacgatggtcttgatctcctgaccttgtgatccacccgccttggcctcccaaagtgctgggattacaggcgtgagccatggcgccgggcccatcttcttttctgtccacagccaaaacatcctgccacaaaaggaccatttgttacaaaacaactgcatattcttttttcagttaactgaaggtaacacaggccctcctgtgtcaatttcttcaccatacaaaactgggagacacagaagtcatagcttaagtaagtgtcacttcctctcggaagcccagcctgagtccctgatcttgtataaggcaaatgtccctttacaaagcacctgtttcccttgctgtggtgcctaaccacagcacaactgatattgtatatgcacaactgtctatttatctcttccacataggtgagcttctggaaagcacagatactgtctaatcctccttctctgttcttaacacctgtttgttaaataaatacattctgtagtcagacatgtcaaaaattttattttttaatttttagcagctaattttaaaaatgctgaatttagactagattcctccttattcttttgtacgcacttaaaaattttcaacaaaacacttaaaatcttttactcagaaaagaactacacatatcactctgaattactacagactcaatatcacattgttgtggggctttcaagaatctgtgcttatatttaagctaaaaatccttcacagcacctcctgtcagtttgtagatacgcatagattttctcaatatacctgtattgatatagatataaatatacctggtatagaataaggcacggtaaaattctctacctagacataaaacccatatatttaaacttatgagaaatctggagaagtacagtatatacatgtccagcaagacttatgttccattttaaagaaatgagccttggcaaatttccctagcactgagaactgtttagcaagaattaatttttaaatgaaataagctaaaaataaaatagatgtagtattatttatacttaagtcttgttctttagcaattattaaaggttacactggtatgttttatcattggtaactggactcaagtttgaccaaatgtttctctttacccatgaaaaatagttgcaatgttccaattttgactgccattccaggtctttggtggcccttcatcaagtgcaatttggtagcctaaatgatatgggagggacagagcataatttcatggcagtaagtatagctgagacagaaaggttaaacaaggtccatgtctttggacacttgaccctaagttatgacagattaactttaaaagacaatgttttatcttgaacagaggggagttttgtcttctccttccagctaggtggaagtatttggcaaatgtcttctttggaaagaattatttagcaatggaattataatcggaattatttagcaatggaattataatcaatgtagtaaggacagaaaaagcaaactaaggacaaaggaataaatgaagaaatgacagccacacttgccaaggtgaattccattcagggaatttgccaaatgaaaaggatattaacattaacttaagcaggtttccttacttcaggaattgtctgtctttaatattcataatggtcctcatgaattttccaaaggatagagtatgcagcatttatgattatttaaaggctttataaatgtaactgctcttgggcatagtggtgctatcaggcagacctaggttgaaattctggctctgtcagcggctgtgatttcatgtgctaatttcttaactcttatgagcctcaattaccttgtctgaaaaatcagccctttcatttatatttcaacagaacttctgcccttgatgtccctttgaagttatttcccataattagtcacagatcatagcatcatcagctgcaatcatcttatctccattctattaacaaatttacatacattcttttgtatgttcaacaaacagcatatgccaagctgagctggcaactggacaaaaacatattatatgtggtttctgaacacccagagctcactatcttgttggggagaaaggcagtgaggaaatagtaatgcagagcagtgacaggtgcccataaggggttcgcctagtttggagaggagaaaacatttgagttgaaatctgaagagagaaaatgaagccactggagatgaagaaaacaaacttccatggggctgagggaacaagaatgtgcaaatgctctgtgggaggcagaaagaaagagattttgaggaggaaaaagggcagtgtagtttgcgtgcaaaaaccaggtgagcaagatgggagaatcaggagaggctttttctttttttttttttttttaatgtcaacactgtttggtgtttatttggtgagcctgagggcaattttcattctcatttctttttcttattgattatttccaaccctttcaacagtgaacatgcgttgcttttgcaattacaacaacaacaagaatccctatagacaaagcaaaaaatatatactttgtaatgtttttaaaaaacaaagattaaactacactaaaatataaggtgattatctctgaatgataagttttggggcagttttttttttaccctcatcactgctttccgaattccaaaggtaaaaagatactacttgaataagaagaaaaataaagagagttgtgtttcaagctttccctcttcccttcttcccaccctatctaacacttggaatatcccatgagggtctccaacgtcagcaggaactaagagccaagagtcgactgagagatgactttctttctctttcttttttgttgtgtggtgaagaaagaaatcataatctgacgtctaaagagcacttcactgttgctcttggttggactctaaatcacattgggaaaattaaaactacaatgagaaacatcttacaccagtcatgatgactattattttttcaattttatttttattacactttaagttctagggtacatgtgcacaacgtgcaggtttgttacatatgtatacatgtgccatgttagtgtgctgcacccattaactcatcatttacattaggtatatttcctaatgctatccgtccctcctccccccaccccacaacaggccccggtgtgtggccccggtgtgtgatgttctccatcctgtgtctatgtgttctcattgttcaattcccacctatgagtgagaacatgcagtgtttggttttctgtccttgcaatagtttgctcagaatggtttccagcttcatccatgtccctacaaaggacatgaactcatccatttttatggctgcatagtattccatgttgtatatgtgccacattttcttaatccagtctatcattgttggacatttgggttggttccaagtctttgctattgtaaatagtgccacaataaacacacgtgtgcatgtgtctttatagcagcatgatttataatccttttggtaaacacccagtaatgggatggctgggtcaaaaggtatttctagttctagatccttgaagaatcgccacactgtcttccacaatggttgaactagtttacagtcccaccaacagtgtaaaagttttcctattactccacatcctctccagcacctgttgtttcctgattttttaatgattgccattctaaatggtgtgagatggtatctcattgtggttttgatttgcatttctctgacggccagtgatgatgagcatgttttcctgtgtctattggctccataaatgtcttcttttgagaagtgtctgttcatatccttcgttcactttttgatggggttgtttgtttttttcttgtaaatttaagttctttgtagattctggatattagccctttgtcagatgcgtacattgtaaaaactttatcccattctgtaggttgcctgttcactctgatggtagtttcttttgctgtgcagaaactctttagtttaattagatcccatttgtcaattttggcttttgttgccattgcttttggtgttttagtcataaagcccttacccatgcctatatcctgaatggtattgcctaggttttcttctagggttttatggttttaggtctaacatttaagtctttaatccaccttgaattaatttttgtatagcgtgtaaggaagggatccagtttcagctttctacatatggctagccagttttcccagcaccacttattaaataggaaatcctttccccatttcttgtgtttgtcaggtttgtcaaagatcagattgttgtcgatgtgtggtattatttctgagggctctgttctgttccattggcctatctctctgtttttgtaccagtaccatgctgttttggttactgtagccttgtagtatagtttgaagtcaagtagcgtgatgcctctagctttgttcttttggcttaggattgacttggcaatgtgggctcttttttgcttccatgtgaactttaaggtagttttttccaattctgtgaaggaagtcattggtagcttgatggggatggcgttgaatctataaattgccttgggcagtatggccattttcacgatattgattcttcctacccatgagcgtggaatgttcttccatttgtttgtatcctcttttatttcattgagcagtggtttgtagttctccttgaagaggtccttcccatctcttgtaaattggattcctaggtattttattctctttgaagcaattgtgaatgggagttcactcatgatttggctctctgtttgtctgttattggtgtataagaatgcttgtgattttttgcacactgattttgtatcctgagactttgctgaagttgcttatcagcttaaggagattttgggctgagatgatggggatttctaaatgtacagtcatgtcatctgcaaacagggacaatttgacttcctcttttcctaattcaatacactttatttctttctcttgcctgattgccctggccagaatttccaacactatgttgaataggagtggtgaaagagggcatctctgtcttgtgccagttttcaaagtgaatgcttccagttttgccaattcagtatgatattggctgtgggtttgtcatagatagcttgcattattttcagacacgtcccatcactacctagtttattgggagtttttagcatgaagcattgttgaattttgtcaaaggccttttctgcatctactgagataatcatgtggtttttgtctttggttctgtttatatgatggattatgtttattgatttgcgtatgtgaaccagccttgcatcccagggatgaagccaacttgatcgtggtggataagctttttgatgtcctgctggatttgttttgccagtattttattgaggatttttgcatcgatgttcatcagggatattggtctaaaattctcttatttggttgtctcactgccaggctttgatatcaggacaatgctggccgcataaaatgagttagggaggatttcctctttttctcttgattggaatggtttcagaaggaatggtacccgctcctctttgtacctccggtagaattcggctgtgaatccatctggtcctggactttttttggttgctaggctattaattattgcctcaatttcagagcctgttattggtctattaagggattcaacttcgtcctggtttagtcttgggagagtgtatgtgtccgggaatttatccatttcttctagattttctagtttatttgcatagaggtgtttatagtattctctggtggtagtttatatttctgtgggatcagtggtgatatcccctttatcattttttattgcatctatttgattcttctctcttttcttctttattagtcttgctagtggtctatcaattttgttgatcttttcaaaaaaccagctcctggattcactgattttttgaagggttttttgtgtctctatctccttcagttctgctctgatcttagttacttcttgccttctgctagcctttgaatgtgtttgctcttgcttgtctagttcttttaattgtgatgttagggtgtcaattttagatctttcctgctttctcctgtgggcatttagtgctataaatttccctctacacactgctttaaatatgtcccagagattctggtatgttgtgtctttgttcttattggtttcaaagaacatctttttttctgccttcatttggttatgtgcccagtagtcattcaggagcaggttgttcagtttccatgcatttgagcggtttttgaatgagtttcttaatcctcagttcttgtttgattgcactgtggtctgagagacagtttattataatttctattcttttacatttgcaaaggagtgctttacttccgactatgtggtcagttttggaataagtgcgatgtggtgctgagaagaatgtatcttctgttgatttggggtggagagttctgtagatgtctattaggtccacctgctgcagagctgagttcaattcctggatatcattgttaactttctgtctcattgatctgtctaatgttgccagtggagtgttaaagtctcccattattatcgtgtgggagtctaagtctctttgtaggtctctaagggcttgctttatgaatctgggtgctcctgtattgggtgcatatatatttaggatagttagctcttcttgttgaattgatccctttaccattatgtaatggccttctttgtctcttttcatctttgttggtttaaagtctgttttgttagagactaggattgcaacccctgcttgtttttttttttccatttgcttggtagatcttcctccatccctttagtttgagcctatgtgtgtctctgcaggtgagatgggtctcctgaatacagcacactgatgggtcttgactctttatccaatttgccagtctgtgtcttttaattggagcatttagtccatttacatttaaggttaatattattatgtgtgaatttgatcctgtcattttgatgttagctggttatttcgcccattagttggtgcagtttcttcctagcatcaatggtgtttacaatttggcatgtttttgcagtggctgttactggttgttcctttccatgtttaatgcttccttcaggagctcttgtaaggcaggcctggtggtgacaaagtctctcagcatttgcttgtctgtaaaggattttatttctccttcacttctgaagcttagtttggctggatatgaaattctgggttgaaaattcttgtctttaagaatgttgaattggcccccattctcttctggcttgtagagtttctgccaagagatctgttgttagtctgatgggcttccctttgtgggtaacctgacctttctctctggctgctcttaacattttttccttcatttcaactttggtgaatctgacaattatgtgtcttggagttgctcttcttgaggagtatctttgtggttgtctctgtatttcctgaatttgaatgttggcctgccttgctaggtttgggaagttctcctggataatatcctgcagagtgttttccaacttggttccattctcctcatcactttcaggtacaccaagcagacgtagatttggtcttttcacatagtcccatatttcctggaggctttgttcatttctttttactcttttttctctaaacgtctcttccggcttcatttcattcatttgttcttcaatcactgatattctttcttccacttgatcgaattggctactgaagcttgtgcatgcatcacgtagttctcatgccatggttttcagctccatcaggtcatttaagttcttctctacactgattattctagttagcgattcgtctaatcttttttcaaggtttttagcttctttgcgatgggttcgaacatcctcctttagcttggagaagtttgttattctgatcttctgaagccttcttcactcaacttgtcaaagtcattctccatccagctttgttcccttgctggcgaggagctaggttcctttgtaggagaagaggcactctgatttttagaattttcagcttttctgctctggtttctccccatctttgtggttttatctatctttggtctttgatgatggtgacgtacacatggggttttggtgtggatgtcctttctgtttgttagttttccttctaacagtcaggaccctgagctgcaggtctgttggagtttgctggaggtccactccagaccctgtttgcctgtgtatcaccagcggaggctgcagaacagcaaatattgcagaatggcaaatgttgctgcctgatccttcctctgaaagctttgtctcagaggggtacctggctgtgtgaggtgtcagtcggcccctactgggaggtatctcccagttaggctacttgggtctcagggacccacttgaggaggcattctgtccgttctcagatctcaaactccgtgctgggagaaccactactctcttcaaagctgtcagatagggacgtttaagtctgcagaagtttctgctgcctttttttcagctatgccctgaccctagaggtggagtctacagaggcaggcaggcctccttgagctgcggtgggctccacccatttcgagcttctaggccgctttgtttacccactcaagcctcagcaattgcggacacccctcccccagcctcactgccaccttgtggttcgaactcagactgctgtgctagcagagagtgaagccccgtgggcatggaaccctccgagccaggcaccagatattatctcctggtgtgccctttgctaagacagttggaaaagcacagtattagtgtgggagtgtcccgattttccaggtaccgtctctcacggcttctcttgactaggaaagggaattccccaaccccttgcacttcccaggtgaggcgatgtcccgccctgctttggctcatgctccgtgggctgcacccactgtccgacaagccccagtgagatgaaccgggtacctcaattggaaatgcagaaatcacccatcttctgcactcctcacgctgggagctgtagaatggcgctgttcctattcagccatcttggaacctcctcccatgatgactataagggaggcttttaaatggtggaaatgaatggtttccaccaggacagtggcaagattcaattatcattttaaaaatctctgtcaagctacagtgtggaaaatggattggaaggagacaataatggctgcaagggtatcaattaagaggctattgtagcaaggatgataatttaaactgcaattggaacagaagatatggtaaaatgtgacaaatctgagagatatttaggttggtaattaattgggtaagagaactgtggtacattttacacataaagtcctaaggtgcagtatttgatttggtctataaattgtactccaaatcagctgatgcttttatagttagagagaattatctcagtagacgtaatacttctctttcaaaaactgtcatggttcttaatcatattccacaatggtcagtatggggatgtttatgcctcatggaatagagaaatcaaaaatttaaatctatatttgatgttaaatataaatagtatcttcttataaaaatacattaccattactcttagcttgatatattgtaaattgctttattcacctcctcagccatttttcatcagcagtagtatatgtgctccctgttcctggcagtgattcactggatgagaacataaatgtatttgtgggaatatgtatgaacgttgctctgggaacaaaagaaacagttctgttataccacattggtggtaatcattctttcccaaaatcattgcttgatcccttaaacaaacaaaacaatgtgaaataacaagcattgcaaatacctaagactttggtgtattgactgcctatctgtcaaatttgacaggaaggattaaccatggtttcaatatttacacttggattttgaaagactagataccaagttgatgactctttgaaaataatatagaaaagtatatataaatacataggtaaaaaggatgggacaaaagtgtcaatggttactgctgaaatatggttttggagtgcaagtataggggatttctgctattcattttatgcttatgcaatgtttaagttttaggagcaggtatcagtttctaagaaaaatcgaaaaaagagcagatatgaaaaacaagatcaataaaatagtttcactgtttaataatgccaggttagtgagaggcaacattcatcatggaaactaaatgcattacactagactttcactatttataattatttttctaggaccatgatcagactggcccacggtatataatctacaaattgactactgatattgtaagagggctcagccatattcaaataccatctattaaaaaaattaaatatgctaattcgccactacaatttaaaattcaactgtaggtaaataaaagtaaattgtgccaatatgcatgtggaattacttgcttctgatcaactaaaaaaaaattagtaagaaatctggtgaacatcgtattggtaaacaaaaacaatttttaaaggaaagtggcaagatccatgtccagtctgatccaaggtgttgccagaatggcagcccgagttgagagcagaaatgtgtttctcctcacacctttccaacttttaggctgtggtcacttcaaactaagaagcaaatcacatcttagcccatgtagtaatgaggttatccacactagaatgcataaacgtcaccttgtggcttgttaaaaacacagattcttgcccatcacaagattatattaaactgactagggtctctaatataatgatgaataaaaatggaaataataaacacatttatgatctcaacaagaaaattgttaatatttcaaattaagtatgaagtctgctgtaggactttttttttttttttcgagatggagtctcactctgtcactcaggctggagtgcagtggcatgatcttggctcactgcaagctcctggggttcaaacaattctcctgcttcagcctcccgtgtagctgggactacaggcacctgccaccacacccagctagtttttgtatttttattagagacaggatttcaccatagtggccaggctggtctcgaactcctgacctcatgatccacccgccttggcctcccaaagtgctgggaatacaggccgccctgcccggcccctgctgtagttttttaaaataaatatttatctgattaaggaagctcagctctattcccattttgctgagattttaccatgaatgaatgtgtttgtcaattttttccccttatctattgagatgatgatatggtttctcagttttactctattaatatggtaagttgcattgactgattttcaaataatcagcttgtattcctggaacaaacccaacttgataatgatatattattctttttatatatcactggatttgatttaccaatgttttggctaggatttttttttcatttatcttcatgaaaaaaattgaactgtggatttattttcatttaatacccctcatctttggggtcaaggttatgctggtctaatgatgtgagtttacatataactgatattgcttcttccttaaatgtttggaagaatttgctggtaaatttaaatgggctcttttttgtgggaagatttctaattatgaagctaatttctgtaatagatataggataattcagattccctaaaaatatatcaaatttagttgtatttttaaggaatttaaccatttcatttaaatgttcaaatttactggcataaaatcttactaatatcttttttagtgcttttttatttctgattattatttcaataatttctgctcttatctttattttcttctactttctttgcatttattctgtttcttttttagattcttgatactgattactagattactaattttcaggctttcttcttttctaagaatttaaggctataaatttccatataaaaactgctttagctgcaacatcaaagcttgatatgttatatcttcattatcagaaatatttttaatttttgttgtgattactttctttgaaacatagggaagaaaatattacctaatttccaaatattggaattctatcattatcattttattactgatttccaccttaatactactgtgaacagaagataaactctatggtttaaagcctttgacatttgttcagaagtgcttatgtctaggtatatattatatttactaaatctttaaaaatgtatatgcttatttggttgttgcagtgttctatacataagattaagtttgttacaagtggtgtttgaatcttctatatgtttactgacttttttgtttgttttgttttcagacagggtctccctctattgcccaggctggagtgcagtggcatgatcacagctcactgcaacctctgcctcccaggctcaagtgatcctcccacctcagccttctgaattttttggttttgtagagatggggtttcgccatgttttccaggctggtcttaaactcctacactgaagcgatctgcctgcctcggcctcccaaagtgttgggattacaggtgtgagctaccaggcccagccgtttactgacattttgtcttcatattctattaactacctgaagaggtatggtaaaatcccaactaaggctgaagatttgtatatttctctttttcagtgctgttatttgctttcaaatattttgagaccatgctatatgtacctatacatatagctatgtctgcttcttttggaatactgtgtgtttgcacaatgtttctctttttacaactttgaatctttatatggatttatatttagactgtacctcacatagttagcttatagttgtcttgttttaataatccagtctaataatctgtttttaaatagaagtatttagtgttttgtattaatataattaaggttatatttatattcttatcactatcttaatatattctttatttgtctcacagttttctgttcctaaattctctttttgtcttcaattaatcaaatatattttatattatccattttccccctctatcagcttggtaactgtacattctttaagtggttaccctggaaatgaaaatatgatttcttgacttattagaatctaccataattgatacttttatcctgtctggataaggatttcacattattttaacttcatttaatccactctcattctacctgttattgtttgttgcctttattttaattccacaaatattttatttttcaagctttttattatggataattcccaacatatacaaaaatagacttaataatctaatgaaacgttcatatttatcatcctgctttagcaatcattagctcatgaccaatcttgttccatctctatccccatccattttctctccaaatatattattttaaaacaaattccaaacatcatattacatttcttatgactatttctgtatgtatatccaaaagatgagtatgctttttataatatataactatgatgtcattatcacacatacgaaaaaataatgataatgggccaggcgcagtggcttacacctgtaatcccagcactttgggaggtcaaggcaggtggatcacttgaggtcaggagttcaagaccagtctgtccaacatggtaaaaccctatctctactaaaaaagtacaaaagttagccgagcatggtggtgtgtgcctgtagtcccagctactcaggagtctgaggcaggagaatcacttgaacccgggaggtttcagtgagcagcctgggtgacaagagtgagactctgtctcaataaataaataatgcataataccatcaaatactctggaaatactcaaatttccaaatgtctcaaatgtgataaccatttttataggtattttgaaatcaagagccaaataaattctgcatactgtgattggtttatttgtcctttaagcttaatttaacctattgattctccctcaatctttttttttttgcccccttgctatctatgcattggagaaaggggcttgttggaactgaagttttccacgctctgatgttttttcccccatgggtattgtattaaataaaatgcttcctagctgtaatttctgtttgtttgcagttagatctagaggcatgcagattcaagttcatttgttttgtttttggtaagattacctcatggctagtggtttatgttcttttctcttttcccataaatattcagggcctggatccgttaattcattaaaataaaaaaataagaatattacacttttaaaacatttattagcaggaatcctattatcaagagaaaattcccccatctatgtttacttagtcatacaagagatgtggaacaaatgcttgattttttacatttgtataccatttttcaaaacaacaaattggttcactaacatctttccatggtaaccaatcggttataattattcttaatgttatgaactcatggatataaaatatttgatgaatttgcatctgctgcagttactgtcaatgagtgcttaaattgttctatctttagttataggacttacactccactaaacattactttgattgttttaaacaatccatattcatagacacttacttatatatttatactttttggtgttcttcatgccctccttcatttacatgatttcaactgggactatttcctctgactgaggagctccttttaatagttttgatatagatatgctgataattaattatcttagttttaattttctaaaaatgtcctttttgaaggatgtgttcggtaggtataaaattctgaattggcaattactttcttttggcactttaaccatggcatcccattgttttcttggttccattgttttggtttaaaaattagctttatgtctcattggtgtgcctttgaaaatatatcttttttcctttggatgcttttaagatgcatttatttgtcttcaatttttaagcagttttactacaatatgcctccatattttatttggctttttttttttcttacacagtttcttgaatccatggcttgatgttattcattaattttggaaaattctttactgctattcttcaaataatacttatgccccatcttccctgaaatctcctcttgggcctccaattgcctgacacagacctttacactaaccaatatgtctcttataaaattttctttatttttgcattctcttttccactctgctttaatctggatattttcccttgatctattttccagatcatgaatcctctcttctgttgtgtcaactctattattaaacctatctacttagttttaaattacacttactgtaattttaactttcatgttgtacatttgattcctttcataggatctagatctctggtgaaattctctgtctcttcttgaacatattaatctcttatctgaaacagattatagctatagatcttatagctccaatttctcagtcacttttggatctgttacttttggttggttttctgtcttgattattggccatttgttcttgtttcctggcatgcctactactttctagtgaatgacagatacactttttatggaaattgtacaagttttgaatgatgttatctttctccaaagatgatttgattttcttctggcaggcagatagagtacaggaaaatcatcttaatccagttgaggctggtatatttccagtttgctcttaccctaggttgtagttcttcaggggcctcaaggaccttgagtatttccatggtcctacttctttgaaagccctgaactctgtgagacactgagactgctacaatatctgctttgccatttactcctgtatcagatattttcagctttatattttgttgtctctccctgggagtgtacaaaaaggcctcaagggaaaattccatgcagtatgttgaacttacatctctgtggctcctttcctctgggatcttgtttcctccagtcctttgttggtagccctgaactccactggtcaggaaagaatttaagctatttccactttagaaactaaaatcttaagttacgctccttgttgatgtattcatgcttttattttccctgatttttaatattttaaaagctggtcacattctcatcattttggtatgatcacaaagaaacatgtagtaatggaaaacaaagaagtattgaccttcactaggcaatcaaccctcagataatgtcaggaaatctgaagctttctcaagtaggagtatggaagagtggagaagggagatgtgttatttatcacagacaatactcagcacaattttattgctccttggggaatccaaagcttttaaagatgatattattatttggaaggcctccagagagcactaagtattaaaaatagcacctgcattctgctaagtcaaatcacctgtttattatccagggtgatgaaaatcatttaataaaatattacagacgcttgttcaaaatcatgcacacaattcataggctcagagacattaatgtctatgcctggctcactacatatttgttaaattgataactcaggtggacattagttaatattaccactttttaaaaattaatgatatcaagttatttgaaatagccagtagaaaacctctgcagtaacatttcccatttttcctcatacaaaatttacataaaacctttgctttgtaatagccactatcttttttctttagagaaccttctcctcctcctgcctttagaatataaatataagaatgtgactcaggtctggtcagtccctgttcatcccattggccagagttattggttcagaaatgagcatgtgatctacattattccattgagactcagtacttggattttatgaacactactggaaagagaattgctgctggttggtaaagggatagaatgaaagattcaatgtggttatcaccacgtaatgaagacctgcctaagactgaagccaaaactacttaaaacttctcagttacatgaatcaataaatgccctttgttgcctaagccagtttattaggactgggtttcagacctggaaccaagagttcttactaatatagctataccaaaaaagtgtgtagcagcaaccaagtctgtcaacaagagtgattaaccctcaggtttaagaacaaaactgaaaagacgcagtagcattaggaacatgtttttgtggtgataagatttattccagtccactgataatgttttactttcccacctacatttacaggatgcccaagacatgaggcctgaaatttatcaataatatcaaataacatagccccattcttgaagttccaaagttagagtattattggcatttttcacctattcctcacagagcttagttatttggggatgaagtaagttacagaagtttccaaaaaagaaggaaatctctatgtgtttcatgtttttaaaattctgtcttcggctttggcttaagttatggttactgatggtagctgtaagtaatattcccaggagaaaggctgcaaataaaatgagaattcctcagcatctttattgtccttcaagtggacacgaattcaagcaggtgcacatactgaggatcatacatttctactcatggcatttaattaggaggaaagtaaaatgtgcagggccagaactttaaatattagtttaataacctttatgcacctaatttctgaatgattttcttactctctggagaggcatctaatgtcagacagtggcattaaggtgaaattaaggtgagtcatggtaactgaaaagccatgaggcaggcacatgtcagaattattaattttaaaggatatatgaaatattttctcctctgaaaatatgcccagttaatgtatgctgaacttgaagtatggctttatttccctcattcacaactaatcactgtctccaggaggaacagactaaagagagaaagattacaaaagaagtatagccatttcaaaatccccaaacaaatgagaaatcaaaagaacaatgacaagcttgttggttatgtagagtaaaatttttagtgtgccaatcatggctgataccatgttttgaccatgtcaaaattcatcaaggcaggagttttcaaaccttttttgaatatgacccacagtgaaaagtatttctatatctatctgtaatatgactgtgtatgcatatacatttacaaaactcttaccaaattaaatgaactctcatattttctattctatataatttcactaaaagcaatccctaaattgtctcacaactcaccagtagcttacaagttgatataaaacatataatttgacatatattccacatcttaggctaagagaattacacatattcaaatcattaccaatgccaatttcagattaagactgttctgaaatgaaatcaaatcaactctttctacacagtggaaattcttagaccgtttattaacttcactaaatattttcataaagcatttgaagcaagatgctttcttcaggataacacctccaaacatactttgtatctttcgtttttctttttcttttttttttttttttttttttttttttgagacggagtttcactctgttgcccaagctggagtgcagtggtgggatcttggctcactgcaacctctacctcctgggttcaagtgattcttttgcctcagcctcccaagtagctggaattacaggcacatgctatcatgcctggctaatttttgtatttttagtagagacagggttttaccacgttggccaggctaatcttgcactcctgacctcaggtgatctgcccacctcggcctcccaaagtgctcagattccaggcgtgagccaccacacccggcctcagaacatactttgaaacaacccaatgcaagctcaccacctcaaatccagatccaaagacgacactatctttaaaacaaacaaacgaaaaaccatgtctctataaaaaggaatgaaacataatgtcacagggtgatattctaatgagacaaagaggtagtcccattatctgttttgttttacctggtggtatcaactgttgtttcatcactgtttctgtgaagaacatgttttcttaatgaacccttgagaaggacagtgatttgatgaatgaaagatgtgacacatgaaacaaaatattcctcattccacacctgtgtatataatatcatttggctctccaaattatcttaaagtttgaatctcatttcttccttcctcaatattttcttttaccatggaggcagggacagcaaagaaatgtttcctctccagatccactattaactgaaaattccagtgctctgaatacttgtttttttttttttatttttaaaaagggacctgaatttctattaaaggatttcctttattaactcctgctgaagaatttacatattggcaggttggaaagtaagccctgtaggaaagaaatcggacttgtttttcatcatcaacatgacggtctgatgatgggtgtatgagtttcctgttgacacccatgtcacatttactgaattactgttgagaccacagggtagacccagcttatacaattcttttgtcttctttctgcttcacagatcattcataatcacacacggggtaaaaaatgagggagcgaaaattgtgtaagctaattttcactgttgctggaagcggaagcaaatagttctcagagctgagagtgaacctgggtggtgaagagcagtcagcattaccggtggcaagttcagcattctgaccaaaatgagccactctgaaccctggtgttcagtcaatggcggtttcctcaaatttgtccttaaaagttgaaatgtatcatacttctgctcagccacccttaagaaacttgagtgtatgagtgtgtgtgaaatacaaataaaacctacacagctattgtctggattgaacaaacaagcaaatgtgctcagttttccaaacaattgcagatgctgtaataattcagaaaagtgtgtgctgagcagtgggggatgctggcatgctctgttagaatcattgtggctgggtgcggtggttcacgcctgtaatcccagcactttgggaggctgagatgggcaaatcacctgaggtcgggagttcgagaccaggctgaccaacatagagaaaccccatctctactaaaaatacaaaattagccaggtgtggtggcgcatgcctgtaatcccagctactcaggaggctggggcaggagaatcacttgaacccaggaggtagaggttgcagtgagccgagatctcgccattgcactccagcctggacaacgagagcgaaactccatctcaaaaacaaaaacaaaaagacagagtcattgctaaccatgttgcttagcacaattttggaaggaggcatgatgctggcacagaaaacccttgtcagaaattcctattccttaattttatgctctttctttcattcttttctcacttcattgtcatacaggcaagtgaaaaagagtggaaagagaagaggcggtgtcaaaggaaaagagaaaaaatacacctgactcctgttgtttatgattgtcttgtcagttaacacctgggcaatcatcaaccatgtactttccttgagccaggtccttaaagaacccaagatgaaggaagtagacagaagcagctttggggtggttagggtagtgcttctagaactttaacgtggctacagatttcttgggagtcttgttaaaatgtggattctgattctagagtggggcctcaaattctgcttcagttggtgatcttgttaaaatgccgtttccgattatggggtggagcctcagattctgcacttctactcttagggaaacccaagcctcagggttagtctttgagcctggggcagtggcctatcctgggcctttttctttacaggtatttcacttgactacttctccttttttcaggggcctgcagtaaagagaaataaagcatgacatagtctgaaaagcactggttctagaatcaaacaaacttgggttggaattccaactctgcaactgatttgcaatctgtgtggtcacaggtgagttttttgaatccctcttaaattcattttctccatctataaactgggtatgccattttttaactctcagggcagctacaaggaacaaatgagatcatgtgcatcatcaggtaggttcacattcattatgaaatgaatgactaaagagcctaaagcacaaccgttctatctacaggtaataaaaaggaaggtagggtgcaacaatgtttaaatacatctttatttttcttaataccatgactttggctcttccttagatctacagctatgggttgtgtagagttgtaaccacattaagccaagcatgtcttcccatttcgaatacttttctgactccagaaattcattctctgatcatgctttcagtaatgacaaaatccagaacagattgggtttttgaaaatatttcttgctatatcaaatgaggaaaatttgaaaatatttcttgctgtatcaaatgatgaaaatacatctgatgatttacttgccctcaattaattcagttcttaggcttgctcttctggacttctctggctcctgtttccaacaacagatttcccttcttctcaagctcccctcttcccagtctctctcctccaatctgaaattgggctccctttgctcccatagtaaataaggcaaaagtgtcccttcattcccatgtgatccagctggggaatctcagtttctctaaaggaatcaagaagatacttcagagttaaccagaggaattaaagaaaaaacagttaatgccagccttctccaaccttcccacatcagcagactgaacaaagcgctcaaaactcagggtttaataaagagggaaaaaggaggaggagctactttattgggtgtagtagagacaaagagggaaatagaagaaaattgtgaagtagtgacattagctgccatgtcctacctcctctggcagttctccagggcagacagggctggcagcggatgggtgttataactcctatggatcatgcctgacccttctgggcccgtcatgacttctgtttagatgacactaaagggtctcagggcagcatcagagcaggaaggatgtgccaaccacagaagtgccaactcatgacaagaatcattgctcattcagggattgctgcccctgccatcaccccctctgtcccaggatctgcattccgctgttctctctcctgcaagctgtgacagcagaagaggggcctccttcccattagctcatttccatctcggacttagtcaaaggaataaattattgtcagctcatctgtcttattagattgagccacatgatattgccatgttgttgctccaatactggcaatttcatgtgattcaacctcatctgctgtttagagaaaggaagtttcactgctatgaaaaactaaaccatttctgtggctgagctatgctgaccagaacagagttatctcaaattcatctactcaaaagctgcatattttaaactgaaatgcactgagcgtcttccttatccctactttccacatttctaagacaagataaattcagcaacattctttagaaaacattccatctccaacagcaactatcagtcaaacaacagggaatcattgtgcatttactctgtataaagcataagaaggataaaaaaaataaacacaacatcttttctgtccctaaggagtaactgacgtagctgaagaaagaagaggggaaaaacaccacaaaaaatgtaaagaatgaagcaacaatataaggaatgtcacaagacagaccatgatcatttgctaaatgagtggaatggaaaataagtacagtgagttgagaggcaggagcaatcacctagaatctgatgtgagccactttctatctaatttagctcatcaatcacctcaccctcccacctacttactgtgggaagttatcacagaaaatgaaaatctcctctctgcctactcataactcccagatgtcggttccagaaatgtatgcccagcaggtctcagaccactcccactcatttattgggtccatctcaggaaaagatgggggaatggggacatttacactggatgcttttctttctctaggtgaagtcagcatgacacaggaaaatgggagaaatctaaatgtgtgtgcctcaatataaactgtagccacctggtagcctagcacttttcctgacttcatgactccttttaattctgaatttcaacctttctgagcagttgccaatagtaaaaaaaatgacataaatttaagcatactacaaatacctgtttagatacaaatgaggtcacattaacacctcacagcccccctattttagcaattccctgcgtgctctcactcacacaatctcccatggtaccctgctcttcctctctgctgagggcctccctcttgaggacaatgcctagccatggaccctgtctctagtgtcctcctggagaagggtgtttcctttcccagggggtcatagccaagggctctgcaaggcagcagcagccctggctgccccagtacttctggcatgaaagccatgctgggatgttccatgcagaaatgcagataatacccttctgcccaacactgtcaccctctactgcctgggttgaataaaagtgaaagtttgctaaggtcccaaggcaacatctctgaccaggccttttctccttctcccctttcttccttccttttttttttttttttcttttttttttttgacagagtctcactctgtcacccaggctggagtgcagtagcgtgatcttagctcactgcaatctccacctcccaggttcaagcaattctcctgcctcagcctcccgagtagctgggactacaggtgcacgccaccactaccagctaatttttttaaaatatattttcgtagagatggggtttcactgtgttgcccaggctggtctcgaactcctgagctcaggcaatccacccgcctcggcctcccaaagtgctaggattacaggcgtaagccacggtgcccagccacttctttccttttttgagacagggtcttgctctgttgccagtactggagtacagtgatatgatcatagcacactgtagcttcaaactcctgggctctggtgagcctcccttctcagtctcctgagtagctgggactacaggtgtacaccaccatgtctggctattttttttttaagagatggggtcttgccatgttacccaggctggtctcaaactcctggactcaagtgattctcccaccttggcctcccaaaatgctgggatgaaagccattgtgctcagccctcaccctccacttctaatccataagaaagacgtgtcaattttacctacaaaacatccctcgagtcctccccttcactccatctcggcagataccctgttggttgcttattaattaccatcacctcttacctgggcctctaccacagcctcctaatgtcctgcttccactcttgcccttccagttcattctgcacaaagcagcaagagggatcttgtaaaaagactaaatggatcatgtcttcctagacttaaaacccttcagtgctttccctgctacactcagaataaagtcaaagcccttggccctggcctacggggccttccaggacttggccccagccttgctctacaggagactgtccagtgaaggttataaactcaaagtccactgcttcccatgagaagcctgggtcagaattctgggtcttctgtttaccatgtgaactgtggagctttgggccagcttcttagcttccctgcacttcagttcctacacatggaaagttacatatctcactggattattagaaataaagtgagatacaacgtatacagtgctaggaatattgccagtcaatagtaaatgcttcataaatataatcagcctggtctgctttcatttcttcgaacacatcttttccacttcagggccttccatttgttgtcctttctgctcagaatgctctccctcctccccgtttgtacagaaaggccttccctgactaacagatctcaatggggactctccctgtctcactctgttattctctgttgcaactcttcatttccttcgtatcacttgtatcctgtgataaactgccattattttctttctttggctattcactgcttattgtctttcccttccatgagactttaatctttataagtattaccattgaattccagtactagaacatcattttgactcagggatccttcaagagcttccatcactatttaaatttttacagtgaggaagtggatgaatcttactaatctctcatctcatggtctatttccatttggcttttacttaaagggtcctctttctgtggaggtcagaccaactctctggggcagggttggacaaaaaacaccatgattgactcagtctccccaactcccctgaaagtacatataagcttcttttcaaggactccttgccttcttggacagatatttaactaagtaacctctgatggctccttttatctcaatccgatttaccttctctcttgtgtgtgtgtgtgtgtgtgtgtgtgtgtaatgcacacacttactaagatgttggcttagcccagagtcctcagaaagcacagcctgaggcaaaatcttacataatcctaatttattggaatgtgccatccagggaaggaagagggagagaagaaggaaatgaggaagggacggagaacaagcagatagatacaagggtatatttctgagctggctgccactgttactcagcacaactgatgtcagatctccaggacccatcttctgaggcaggctgtgtgaatgacagctcctttggacaataagtcagggtaagaaggagatgaattccaggttgcacatacgtgggagctgagccatctagtgcatcacaggcctcagtggcaacatgggagccctgggggagatgacaggctgacttgagagaatgggagcagtcactgtaacagcctttggcccttggcagcaacaatgtcagcagcattagtgacctggctctgtaaccatgagagcagcacaaaccaggcaagcatacagatctggaggatggcctaaactaagtctcgtactgatgggtaggaaggtgatgactgtccaaatgtagtgtttgaggatggcaagcatgggacatataggctcaccactcctgaagcttgcactcatggcagacatctttgtactttgtactttgtctggctgagcccaagtacagcctcaaaacacttcttcatacagagctgtaatcagccactacatcacaacagtaatgcaaatgatgacagcataagataaaaaaaattgtaattcacacctgaaatgataaagacaaaaacagtataaagctaatgaaaatgatgaatttcagaaagtgaaaaatccaccaaagggaagcccttccagagcatcttccatctaacccagctccatagcccagaaatcagcgtctgtggatcttcttgatattgcaggaaaagagaatgccattcaaatgacagcttttccagaactggaattctatgtacaacctagcatcacagctctcatcattctgtatttgatgacagttttgtgggtttcatatcccaaaatgatacctgcctaattcacagagcaaagtttatttcatttaaagcagttctgatcaggggaaaatgtttcattgtggtgttataaggaattgatctgctaatgttcttcttaagctttgacattaattacagagaagatgcatcatcatttctactgacccttcattccacccccacctaccaatacacccacccaaatgttcagagctttgtatatgtgtcttaataatctgtcatccaatacttggcaagtgaaatgtgctatcatatggtaccaagaatgttcgcagctctggctaaaacttcactggatctgatatttaagccttagtggtgatctaacataggcagagaactgtgctaagaactgatagatgcagaagtgaataaaacactgcccctttcccttagagtagtaagttccaaactaaaggatagaacccaatagtgggtcttgacatcaacttaggaaattgtaacgagaaattttaaaagctacaatagaattgaatatagtagaacatatctcaaataataataaagggtatagtttcatgaaggggtgtgtgtgtgtgtgtgtgtgtgtgtgtgtgcatatacatgtatttctttctgtaggtgatctaacagtttgaaagcctaagttttccaaaggtgaaaaccatcattcaaacacataatgataaaaatttacgtatagagaatccctggagtcatgcagaatcaacattcagtatgcatacaggatggcagagattagtactaagggggcctgatattcaggcaatggtgagaatctagagtttgccttctaaagcccacattcctcatattactctctgctcagaaaccactgtatgtgcccccatcactacagaacgtaatccaagctcatgagtatggcattgaaggacctccaagcttatttcccactactcttcacctcctcccacaccttcttgatgccatactgttgctataatcatttttgccattttgaatgtgttctgtgtttgaatacgttctgtgtttttttacttctggacccttgcacaaactcttccttcatgctggaatgtctttccttccctatctgaccactaaagtaatatacttacagtggtcagcctttgttttgtctctccagcaagctatccgatcctccttctggtaataatattttctttcctttgagaaactccctgaaatttcatgggttctgtggtcaatcataatgccccactgcctatggccacaggagaagctctgtgacaaacatacagtgattggttgaaaaaaacaagcatgtgacctatggcagaacattatactctatctcatgtacagacgggtacaattccttctctgaattctaacagcagccctcaaaatacagtgagcataataattacctggaagacttgctaaaccacagattggttccacccccagagtttctgattggataaatgtaaattatggcctgagattttgcatttcaaataaattcccaggtgcgttagcttcctcctgttgctgtaacaaattaccacaaacttagtggcttaaaacaacataaatttatcttcttacagttctggtggtcagaagcccaaaacaggtcaaggtgttgacagggctgttccttctggaggctccagggtagaatccatttttttggttctctcagcttctagaggttgcctgcattccttggctcatggcccttctcttgcatcactccaacctcttactgctgtcctcagaactcctactactaacgcttacctcctgtctcccccttataacgacccttgtggttatattaggcctactgagataatgtagaataatctctcattctcaacccccttaacttgatcatatctgtgaagtcccttttgccataagaggtaacttaggcctgagtcctttcacctgaggattaggatgtggacaactttgaggggtcattattcagtctaccacaccaagtgatgctgatcctgatagtccagggtccacactttgaaaaccaatgaattactatcactatcaaagccagcctagtattttattctttagtctgtctgcctcccactagattaagaggttgcagaggctggaatagatcttggcctttttaaaaattgctttaattctatgtacattctcctttctgaatactggtaaatacatctttcagttaaactggaggaataggtaaacagtctgaaatgctgatagaaaagaaaactgtgaagataaaaccccaaagtggagaggtattggttaataggattatctggattccttactgccaacagtaaatctttctacctaattatgctcccaaatttcaaatttctctattgctgacaactatcgccattttgatgccccccagttatttctcatttttctcaaaccaaatttgtgtagctggccagcctatcctgagttctacctcatgggctctggatgtcagagatagcttcaccacacactcaagaactcaagccagaaatttcaccagcatcataggaatagccgctgacagttattcccccactgatatgtgcttggcaacgttctgagttctctgtgggcacttactcattaattcttaccattcttgtcttgtccatttaaaaaatatctcccatagtgctttacatgtagcatacatacactttataagtctacattgcttggttcattcagtagaccataagctccttgagggaagggatgggtcttattcatcatcttgttgccaggatgaaactatgtcacttgtacctcatattacatttgcagtaaaatgttagagagatgagaccatatgtgagcagttggaattaagtcagtcaagttgaagtggggtctaacatcaaattgccttgaaaagcaggcagaacttaaaacatgatataataggcatctcagagctagtgcaaaatcctaagcaagagcataaagctaatgttgggagcaggccccccaaaatctggccataaactggccccaaaactggccataaacaaaatctctgcagcactgtaacatgttcataatggccctaacacccaagctggaaggttgtgggtttagggaatgagggcaaggaacacctggcctgcccagggtggaaaatcacttaaaggcattcttaagccatgaacaatagcatgagcaatctgtgccttaaggacatactcctgctgcagttaactagcccaacctattcctttaattcggcccataagagatacttttagttaatttagtatctatagaaacaatgctaatgactggtttgctgttaataaatatgtggataaatctctgtttggggctctcagctctgaaggctgtgagacccctgatttcccacttcacacctctatatttctgtgtgtgtgtctttaattcctctagcactgctgggttagggtctccctgaccaagctggtcttggcaagctaaaatcattttatagagccaaatcagtaagtccccagtttagcttagaaacaatcagacaaggaccaaaggctttctaggaggtatgattctttgaagagacaagggagattgaaattgagtccataaaattctcttccatcttcctgattctaggtgttgaggtatctgtcctttgttcttggtgatttactatatctgattgcaacttagaattcaaacattaggctctgccttcttttccatccggattctaaaatcaatatctttactatgacgcttattcccaggattaatttatgaaattgtatgatgtgctttgaagactgaaggcttcttagagagagagggaatgtcaccttgtactatcaaaccagtatattaaacagttactgctttaaaaatcagatgtttgttggttgagatgctattaaatcttaacctacaaaaccagcacatgatcatttcaatggtacaaaggcaaactaaatatagcagatgacaattgctacaacataagagaaaaaatgtaatgtaatattttaaccatttagttatatgccacatgaaaataaattcttataaagaataagttttagcacttgccccatttgtgtgatagggtacctaccatgtgccaagggctgtgcaatactgtgatgaacaaaagaatccctacgtgatggagccatcaatctagtggacaggatggatatttaataattatgaataattactacataatcacaggacagaataaaatgaaggatttccaagagcaatgtgaacatagaaccaaatatggagcatatctgaggaaacaagaggctgtccagaggagaccatattccagctgagattttaagggcaaatgagagctgacgagcagcacagaaggggaaagaatcttccagcatttgatcggcatgatacataaaaggagagtagcagggcatgggctgggaacctggaggcctgttcaagactgttcagccttgacaaggtaaagggcaagaggtgatatatttgtttgagctgaatctctcagcattttgcatctcaagtctcctagttttaaacaactttctagagaggaggctgctctttatagaactgagtatatggaagacagccttgagaaccttaaattcaatgcactgtgtagaatataaccatgattctaaacgatacttgttaaaaggcttttttttttttttcaaatggccatggctttgttaaaaaaaaaaaaaaaaaaaaaaaaaaaaacaagataatttggtaactgagtagagacaggacaggtttttctactgaagtctttggtttatggatacacctatagtgttggaaggaagcatttgtattttaaggtatctttcctaggtttgttgctaagttcatggacagcatacccccatgaagatgacaacacagttcttctaagacattatttatttatgtatttattttttaggcagagtcttgctgaagtgccataggagtgatcacggttcactgcagcctcagcctccttggatcaagtgattctcctgtcgcagcctctcaagtatctgagaccacaggtgtgtaccaccacacttggctaaattttttttcttttttttttggagagacaggggtcttgctttgttgctcagtctggtcctgaactcctggcctcaagtgatcctcccacctcagcctctgaaagtcttttaagatatcatattacggaaactttaattaagctcttgctacatataagacactttgcttaggattcaatgtatatctttcatttaaccttcacaacaactctaggaggtaggcacaattattattctgcttatcaacgttgtcaactgaagttagaaaggttagtaaatctttgaagttcacacagcaagtcagcagtgaggctgttaatccctccccactgttaaccaggaaaactctacttctgttaaattctgatcattttttgctaaaggggttagcagtgcttttgactcttttatgtttccctttgatttaccatctaatggttattgctacagtgtttaataagcaatgcattatccctgggcagtggaagtaatatcattactcagagacggtaaacagaagtttgcatctgtgcactgcctggaggtggaagcatcaataaaagcctgaggtggaaggaagagatgaatgtgcaggcttgaatcagaggcaagggacgcaatttgatgtggggtaataagaaattctgcctaggctagcaaagaaacacaatcctttaccactcctagcctcaactgcactgttagatttctcctaacactgcttttctttgctccacagggtacaacagtcccagccccgcccatcacacccacaacccttatgtacgcccaagggtgcctggcatgcaagattctaagagcaatgggttgcaagtccctttgacaaagtttgcctggggaccaggaaatttaagtctacatccgaggaccaaagatatttaaattaaaaacttcctaccaaatccaacagcagctaagagagtggcgaatgcgatattacagaaattggtctgcagcctccaaatgccaaagtggcagcttgttatttatgataagataaggagcagctcgttactaaagatatccatgtcaaccccacgcattgagcagaacaaaggatcgttaatgattcctgggcttgtcatgttagaatggggtggcgatgataaaagagcatctatatatgctttccttgtgacatttcttatttttaaactccaatataaaaatatgtgttaattgttatgatttgtgtcacatgctatgctccagggctggacaggaaacagtgtccccattctagtatttttataataagcaataaacaaacaataaacaatgacaacaagaagagaaccactttccaggatcatatgattagttctgacatttgggaaattgcttcattgccagaagtcaattcccgcgattgcgagcatcttccacacataaaattaataatgtgcccagctcccctcctgccttcattttattatatgaaatttggacctcccacagcatgtaaagtcacatttttaaaataaaactttcttcctttataaaatatataaggaaatgtcttatagagttacacagacctttgaaaacatacatttttccattcctttgtttattcaggcaatacccgtttgagtacctactaagcgccaggtacttttctagagtgaatatgacaatgagggaaaacagacaattattaatattccaaatgaacaaaataagtttggtagtagtaagtgttgggaaaaaaataaagtaagtcaacgtgatagagagacaggtccttcctaatggggacgggggtggaggggcggtcagagagggactctctaggaaggtgacatttaagcaacaagttgaattacaagaaggaatcagccataaaaagatctggagaggagcattcctggcagaaggaatggcaaatgcaaaggcccagtgccggggacaagccgggcttgttcaagaacagatgaagttcaatgacccgagggcattgaggagggcccagtggatgcgggatgaggtcagggagtgggggcaggagcagatcaggtggggccttgcaggcctaatgaagacttagtattttatattaatgacaaggacagccaccgaaggttcaaatctcggaaatgatagattctatttgatattttaaaaattacagctgtctgggcgtcatgggggaagaaaatggacaaaattgtgttccactcaaagatagcatttcccttacagatcccaaggccctgtctttgtcagtacgggtagtgattaagaacatagtgctagtcagaaaacctaggtttgaatccttgctctgccatcaatatgccatgtgatcttagggactccatcaaacttactaaagtcttcacgtgaaaactataataataactcttcccagagtcttggtgaaaattaaatgagatataacacataatacagagtagtgttagtgcctagtacttgatacatataataatagctgttgttgttattattattattattattaaaattaggaagaagaaagagaagcataaggtaaagcactcagcaactactctgatcattcaggtgagaatacagacttatgggagacaggatggaggtttccatcagcatagagcatctctgtgctccaggcccttggacaaatgtcacctctttaatgtcctgaagacattaggtagaatctagaccaaaacagaattctggaaaaactggaaataattcagatgctcaccaacaggaacatgaatcttgatatcatggatgcaactcacaaatatgttgattgaggaaagctagacaggagagactacatgctgtgtaattccatttagatgaagttcaagaacaggtgaaactaactgctgttggtagatatcaaagcagtggtaacattataagggaccgtatttggaaaacatttggaaagagcacaagggagcctgccagggtgctgaaaagtgctctataacttgatctagatggcagttacatgatggatatacatatgtaaaaatatcatcaaaccatatacttaaattagcatactttataaacttttactgatgtatgtgttataccttaatttaaaaaaatatgtatttcaggggatcagaaagtcagctacataaataaacaaatggtgactgctctcttcaggaaaacgatgacctcaggactacttaggagccagttaatttccaaagctacttcccgtttctaagttaaacagctctgcacataatgtcagccacagcaatggcaaagaaccgcagggcaggtgatgaaaaagctcggcttagcagcaggacaatggggaagtgtgttaaactgggaccatgaccaacttcccaaaaccctctctggtgattgccagtgcctgcttaatgccttacctttcaattgtgctgaatttgtctgcattaaatgaaagttcgagggggcaggatcacttcttttttgttttagaaatatagctcaagtacctgtgtgctctataaagaataaaaataataacaggaggccgtggaacaactgaagtatggaacatgtatttagaaagtactttctggcatttcaataaaggaaattcagagggcttccagcataagaacaggatccgaatggattcattttcctgatagagtgacccaacccacaatgcaaagtcattaagtcccatcgcgtggcattaaaaaatgcttttaagctaagatcagccgaaaatgtgcccagggcagatttttatggccatatcatcacaacctgaaattcaaattggtgaactagctagaaatacatgctcactagaatggttcagagtttttctgcatctatctcagtgaaaaatgttagcaaaggaaaccttattttcctggaaaaacactatcaaataataaaacaattcaggaccagttttcacaaagtaataacaggccatacataattgattgcctttagtcttcgtctctgggtattacaaatcacagttactagcgcatcgaacaagctttcattccggattcagactgtccgtcttggcactgcctgaaacggcttgagcacctttattgcacactttactgcattgttcttcagttgcttcttcagtgaagttctgctatacccaacaatgttataccctccttctttctgtgtgtttactgactgtccctgatggtaggcaaaaagtaacttctagaagggaactgatttagacttatgatctcacctcaggcttgcaaggcaatacacaccacccagggagataaaacatattcctatgaaatcatatcctaactctctccattaaaactctagaactgcactaaaagcaggaaagatatactaaaattataccaattctttggcttaccaaacatcaggcagctgcatccataaaaaaaaggaataaataattcattccaaaactcttttttgcacatctcaaggctcataacattggtttgtaggaggaggtctgaacgagggcctagaaattctgagttatgccttggctataacaggaacctgatccctctatcttactctccctttgtatgtacggctaatgatatacacctgggctgccagtgacagtagccatgagccacgtgcctattgagcacctgaaatgtgagtagtctgaaatgagatgtgctgtgagtataaaatacacacaggatttcagagatttactaccaaaagaagaatataaaatatgattctttaataatgttcaaatattaattacatgctgtacatgccgaaatgataatattttaaagatattgggttaaataaaatatactatttaaatttatgttacttcttccattgaacttttttaatgtggttattaaacatttttttaagttatgtatgtggctcacatgtatttcatttggatgacaatgatctagatattctgaattgctatgaaagctaagattctctccttgtggaaatgggtaattacaagcctaacagttacgcatgtcttaaaggatggagaacgtgggggaagaggaagcaatcaagtcaccaagtgtattacatatttagttatacttcaattttcctaagcacattacaaaaagaatggaaagaaggaagaaaaacatgcacagtccttcaccctcctgagacagaaatgagactgaaaatggactttgaaatcaaaccatttcagattagaattctgcctctaacctcagtttctccatttgtaaaatggaagataagcatactcaccttttagagaattaaataagatcatgccgatcaagtacttaaagcaacattgggcacggttgggaataaagatcttggcaccggagatgttgaacctggagcggaagggacattgagaccaaaatgtccattgggcaatgggaatctgagcctggagaccaataaaaagatggatagatgcaagtgtcctagcaagcaagccgcacaggtgagaaaacactaaaaccaggaagggagctggtgtcacataagcagctcacacttcatggaaacatcacagctgcagctgagctccagccagtcgttcccatgaaggaataataatggtacagtgttgccaggttttccaattttctaagagaatctagaaatccagctttttaaatgtttagaaattttaaaaaatttagtttaatttaaaaagcactcattattccagagagaacccacgggaaaatagtttaataccagccaggcgcggtggctcacgcctgtaatcccagcactttgggaggccgaggcgggcggatcacgaggtcaggagatcgagaccatcctggctaacacggtgaaaccctgtctctactaagaaatagaaaaaattagccgggcgtggtggcaggcgcctgagtcccagctactcgggaggctgaggcatgagaatggcgtgaacccgggaggcggagcttgcagtgagccgagatcgtgccactgcactccagcctgggggacagagcgagactctgtctcaaaataataataataataataatagtttaataactctgctgctgcctcaaaggtcaacaaggtaacttgttagatttctaccatatgaaagttaacggggatctcagatgaaattcccacaagcccccaaacagttgagctgccaaagatgaagagggagatttacctcttcctcctcccagctcttcatgctgtaggaacacagttgctgcgactacaggtgtcccagcggtctttccctctccccagaccgtgacctggatgttatgcagaatgtttcaaagagagctgcaaaagcacaaggactttttacaggagacacgtgacataaaccaaggtgctactccggctattatccattgcccgctttaggtctctctggaatattgtctgtttccatttcaggcactctcagctactacccattttggttaataaattatcatattgtgtaaatgtatacaatctgtaagcctggaagaactgtctggaaaaaggatttttaaaatatcacactaaaaaaataaatactagtggcctctctgtatctattgtaaggagtaaaaggatttacacctgaaaaattaaaattacagtagctactctttcctcaagtggttcttagcaaatgcattttaaagaggatgactttccagtgaacactttaattttaatttaaccttcccagaaaatgaagtgctttgtgtagattcttttggttttatttaaggcataaaaattagttctgaactgtgataattgtgggcttaggaatgtaatcattccaagcaccacttctcacttgcttataagccctacaggtcttgagttgctgtttattgctaattcgaagttggcaagttatttaactgtgaagctgaacttgaagtcagagtgtgacgagatggtgggaggtagattgttttgttttgctttcaacaggttatccaaagcccggatgcaaaatgcggtgcaagacacggttctagatatgtgctcctctaactcttaatcttaattaaaatgggatgatgaaatgttctaaaggtggaataaaatattacattaatctataactctatcttgtcaaaccaaccacagataggatacaggttcctatcatccacccttatgattttgttcttaattgtggcattttgttgttgctgtgaggactcaacctaaatactattgcttctatttgattgtttaaaggaaaataatgtaacaagctttggtcatgaaaaatcgtaatgtccataatacagtagatgcagcatttctaaacattttagaattacgtgtttgaatccacgaccacatactcacatacatataatcaacattaaccaaagggtcatatggcgatttttttcctttataataaagagatcctctgaaacattttaagataaatgaattcctgcttaagtatgggtgcatttgaagtgagaatgctttgaataaagttatcattttcacacaccactatgcctgaaagttatgagcattcagacagaaatcattgaagaaaacttaataaaaatatgtttggcatatgccgtatttagtgtgatcaatagtgtttagtaattcaagaaatgaattaaaatttcaccctcattttgccactcctaaatttccatttgaaaaacaataagagaaattattaactccctgaatatttctaatgggcttctcagcattattgagtaaaactaactccacattgcaggcctgtgtgctgactcaggtttccaaggtttctctgggaactctttggtctgttgttgctgttctttattctttattgaaaggcatttcctagtgcatttcctaattttaggcacctggctagactttggggatgaaacaatacatgtggcagaatccctgcccttgggtgccttaccctctccttcatacagcatctaatggatccaaaaccagggagaaggtgcacctcacagccacaggctgcaacagagaaaggtaaagtgctggtactacctggtttgtgtttgtctgtctgtctctttcttttcttctttttagtaggtgtcaatattttacataaagatctaaatttctgacttctcttaaaaaaaaaatcagaagatcttagcatactggaccagaaagactacttggcaacatctggctgaagctgtggggtgggagtgttgaggggggtgtggatggtgcacttttcctagtcatctctggatcaaaactggctctagtttgccagtgttcccaccactccctatagttttatactcactcatatccattacctgctttgtcctcgtattacagtatttacattactgacctgcaagaagtaactagcagtcagaaagcctgatactagcccttggtctgctgcttattaaatatatgacctagcatgaattcgtgaattgcataatgccttggagcctcagttttctcttaaaaaagattaaagacaaaacaaaacaaaacacgccttctctggcactgcaattgcaaatctccaaaaagaaatctatggaggggtttccaaacctggaaagcattaggccaaggaataatattattgtaattttgttttcagaagaaatatctagaaaatcagaaataacagcctatatctgattatacctataaagatcacaaagcactctcaactgaattaaatctcatgtgacctctgagataaatatcactttagccattttgatgatgaagaaactcaggctgaaaaggaccaagggatttgccccaacaccaaatgctgacatttttaaaaagtcaactttcaagatagttcccataattttaacacctatgaagacactattaacaactgacatcacatgatgaaacaataaccagtaagatgagccatcactttccaaggatatactctggatagagagtagcagcttctttgagctttcgtttgtttgcttgttattcaagagcaacattttttaaagggtattacatgttgtaatataaaggaaatattttaagtaaatatttgtaataggtactcatttggacttctaataaactagtagggttaaagcttttgaggacgcactttctcattaaatgtttgtcaacattacattattttcttagagattgtcatcagcaagtaacttctatgagaaacaaatgtccttaattttattaaagtctacttttattaatcccctccctacccctaattgagctaatttgaaccatagtgccattcagaaagaaatatgagaattcatctggctcattgtcacatacattttttccacaaagaacctaatagagttaaaagcttgatttaaacatgaattaaaggtttatcatttacctttaggaacaaactctccataggaatagtaagctcttttaatgcatttacattttattaggcttacagacattcaatttattggtgtctttaggtacacatttactgcatacagtcaaatatataacaccttcatagtaactttttttaaaaagagaaggtagacttatttaagttttttcatggttcaccataattcaggtagcgaagtctaaatgaacaagcagagggcagatgagtgactttaagtgcacaggagatctccacatagtaatttagagacaccgtgggaaataaataaggagatacgtgaaagagtaaccagctcttggcaggacatgtatatgactgagtaacatgcaaactactgtttatacattgcaatcagctggcagccaagcaaaaagcttatagatgagtaaggacactgccacagccatgtttttgttctgaacctcctgattaaacaaataaactcagactagagagccacatggagaatacaatgctagggatacaatacaatagaatacaatacacttagcatgcagggtctaaatattaacagcaactgcagaagatatcactgcagatttgagtaaactttctgaaacaataatctacaaaaccagctgtgtttggtgatggctcttcataaaaacaaacagttgcaagaaatctaacaggattccaagctacagttcttagcttatagatttcaaacactggagagaaatgcataacatcccagctttttattctccaaagtgaagattttgaaagcaaataggattactatctagtatggtcatcataacattttttaaaaagacattattattctggaataggaagtatatgatctccttacaatgaacaattccatgtagaaaaagatagaatatctgcaaagcacttttgaggtaggttaaggtcctgggaaacagattcctcatgcatttagcttgaagaaaggtttaaaaggaattctttagggatcaacacctgcagaaggaaagggaaatagaggaggaagcaggtgagctgaaggagaagtcccaatggtagcttgtggggaataatgaagatggggtgccttagcgcattctggcagttgtaaaaaatatcataaacaacagaaatttatttatgatagttctggagactgggaagcccatcaaggtaccatcagatttgatgtctggtgagggcccacttctggttcacagatgatggcttctgtctgtcctcacacagtggagggactagcaagctccctggggcctcttttgtataggcactaatcccatccatgagggtggaaccatcacaacttaatcacctcccaaaggccccactttgagggttaggatttcaacatagaaatgttgggggtacacaaacattgagaccatagcatggaatgtcctgagtgagggtgagaagggaggggcctttttaccctccagtgatcagtcactggaagcaggccacctcatgaaggaggtatgcctttgggagagggttgtctatgggcagcaccacagcaagtagggtgataagcccttagctcctaaaggaggacctgagcagtgcattacagagtccatgcgacacttctgttccaggctagataaaatatttttaagctctggctgtaaggacagtcacctttaagcttttaatcttagacaaccatcataatacaagggctatttgagacacaatggtaagacattaaaaggtcaaagcatataatgctcttactgtccatcagataacatctccaggaaaatcagtcctgctgctctttgataccaaatggcttcttaggtatcagatctgctggcttgttctgaaaaaaggtagagtgaactcatttttctctactccttccctctaaataccctggaagttattcaacgggaagtgataaagaactctaaaacctggaaaaaaaaggagatagaaactgactaggggccttagcacttgagggacaacaacctggtgagttccgtggggtttcctttttatttccaatataccctatgccgggttccagagacggctgcaaccccaaaacagcaacagggagagcctgctccctctggtcaaatgaccagtaaagaagtccagtagagacctagtggggaagccccagccccagcccctactctaccactagggcagcgatgggcagtgaggccctaggccatcccaaccatatatctgacaaagaattactatctacagtatataaataattctcaaagctcaacagaaaaaaaaaacaataaacagttagaaaatgggcagaaaatatgaagagacagctcaccaaagagcatatacaggtagtaagcacacaaaaaaatattcgacatcattagccataagagaaatgcaatttaaaaccacaaaaatattgttacatatctatcagaatggctaaaataaaaaagcagtgataacatcaaatgctggtgaggatgcagagacactagatcactcagacattgctgatgggaatgtaaaatggtacagctattctagaaaatagttcagctgttcattttaaaacaaaaaataaatttgctatattacccagaagtggcactctcgggcacttgtcacagagaaacgaaaactcatattcacacagaaatttaaacatgaatgttcgtagcagctttatttgtaatacccaagaaatgaaaattatccaaatatccttcaatggataatggtcaaacaaactgtgatataacataacacggaatatttcttagcaatacaaaggaatgaactattgatacacacctggatgaatatcaaggaaattatgctaagtaaaaattaaagccaatctcaagaagatacatactatatgattactttaatatagcattcatgaaatatgataatcatagagatcaagaatagagtagtggtggctagttgttcagaatggggtagggaataggtgttgactctacaggggtagcatgagggagtctctgatgatgggacagtgaagtatcttgatagtggttgtggtttcatgaagctacacttatgataaaattgcgtagagctacacatgcacacatatacacacacaaatgagtacctgcataactggtcaatctaaataagctctatggatatgcattgtactaatgccaatttcttggtttttatattgtcctctagttaggcaagatattaacattggggaaaactggaaaaagggtacacaggccctccctctacatttctttgtttgtttctgtgtatctactgttatttcaaattttaaaatttactttaattgacaaataatacttgtatatatttagggggtgcaatgtgatgttttgatatatgcatacaatgtagaatgattaaatcaaggtaattaacatatctatcatctcataatttatttgtggtgagacatttgaaatttatactcagcaattttaaaatatgtgatacatttttatttactatagtcacaatgctgtgcaatagatctcaaaaacttattcctcctgactaactgcaaatttgtaccctggtttttgcttttatttttgagacaaggtcttgctctgtcacacaagctggagtgcagtggcccaagcacagtttactgcagcccaatctcctgggttcaagcagttctcccacctcagcctcccgagtagctgggactacacgcatgtgccaacatgccaggccagtcttttactttttgtagagacaggttctcactatgttgccctagctggtttcaaactcctgggctcaagtgatcctcccacctcggcctcccaaagtgctgtgagccacaggcatgagccacaggcattagccactgcacctggccactttataccctttgatcaacatctccccattccctctccctatcccccagcctctagtgaccaccattccactcactacttctatgacaaaaattaaagtttgtttcttttttttttaattaggcccgttgattgctcagggtaagaaatcgtaataaaattctaggtatttcttcctttgcaatgtgccagcatctgcatctatcactggaaagtggattgcaaacccatctcagatgcccacacctccattaacctctcctactcccggcccaatttcctgctccataccccttctgatagttgcttgcctggaatcccttcaatggcttagcaaactctatggcagttcctgggttgcacttcaacactttcttgaccctggcccacctctgttgtaatccctttctcaaggtctggtgcaattaagaatgctgctgaaagggtttttgttgtagttcgtgcctatcaaacacagactattctgattacttgtggcattttgcagtgatataaaattaaaactaaagcacaggagaagaatcttaggtttttatataaataatttattgtctataaattctcccaagaggaatctatgtcagtctacagaaagtgtctctccattgagacccataccatttgcctgtaaattcagcacactgatagccatttgcaatctgcaaaagaaaagccatctatctaaaggggcacgccacactgttattcctttgtaatattaagaaatttatcctaatttaaaagataactgaattcttattcttttacaaattagactttaaaacacagccactgaattgaccaagcactaccaagcttttatcctacttttatttaaatgtactgaaacattagtgatgaaagctttcatttaaagaattctgatgattctaatattcacttataatgtccatttagctaccacattgtgtttatgccccttaaaagctgaagctatgactgctctagtactgagttctccagtgcttatcattaattaaaaggtaaaacacgattaccagggtatctgcaatcaagctttcaatgtaagaaatatcaatatccagtacttgagaacattttggaaccaattttaataggtaaaaaagtccaaagagaagaaaaaatgttctttattatttcaaattaaaaccagatcagtatatcttactgaaaagttgcaattgcccatgccttccaggcatctgcctagtttttctcttatagcagatgctaaagaagagaaatctggcatgtccatttctgtaatatttacagatataacacatcagcaatacatcagtttggttttttatggaagctaacctcaagaagcaaaacatgctctgtgagtgtacttgtgtacttacttcagatcatccttatgcttgggggtgggcagacagattattaaataatgactgtactgagtgtctactaagcacagtggtgtacttgtgttgagggcaccgagacgaatagaagaatccctaccctaaaggagtgcaaaatctagtatcggagccacatgaatattgtgcaagtgaaagaaggtgagcacagattatgtccatggtgaaacaaaagttctgaatatctgttgagactgataaaaatagatcctgctaatgttaatggcaaaaatggcctgagtgtctttagctccccaatcaactctaccagtatccacccaagccaccccaaataaagtgtttgcccagtgtacatatgcagtttcaaaaaagttgcccggtttctcctcttctgtattggtaggaattgagcaggacacagatggcccactgaaattagaataatttgaggaaggtttaataaagggactatttataaaactttgggtagtatgtaggaaaaccataagggacattcaacactctggaactgttatcatcacacgacataaagggagaaggggaaggagcactgaccagaacttggaaagagaaagtctggtggagaggtcaacctcgagaagagctatctgctttgatagaggaacatagccagctcaaagggaccccacagggagtgatccaaggcaactaataccttgacctcactctccttccattttccagtctcctgcttgggtccccccattggccagaaggcaaaaaaacccactgatgaagcatacaggtcagcaggtggaaaaggatagcatccctgattcctggtattaagaaaatcaatcagccgccaaccgcagagaactgctgtgaaaattaaatgatgtaaagcacattatgcactcaaacatacctcaaacatagtaagtaaatgagaaatgtaagttgttaaatatataatatgggatatttttcattatacaattcaatatagcaattatctatgcctcccaccattttctccccacatgagaggtacagcagagagggagaagaaccaatgtttcctgggtggctagtatgattgcagcagagtgctaagcatttgctatatatcccatcttatttcattctccctagaaagaatgtgataggaattattaagctcttaggaaaggtgagtaaatgaagctcagatatgttgcctataattattgcttataattaggatctcagatctgtcaaattcctaagctaatgacttctccattattttatgtagatgggctacctgtccatattagataattttatttttatcacgttgaggggaattagagaaaaacttgctaaaagctaagcatctaacttagggcttgccacagaagagatagtcagtaactgctatatatgatgatgaggaggagcaggatgataatgattgtgatggtgatggtgatggtactggtgatggtgatggtgatggtgacaatgataattatggcagcggtgacaaatgatggtggtaatagtgatgataagaaccaccctactttaacctaggagcaaagaacttctgcaacagacacgaagaattccttaaataaggtttcagtatatagttgaagtagtggaactgataaatatttgttaatcctggtccctcaatccaagaagaagctttttcagagcaggctgtgtggtgcatggctgggccactatgaatttcggtttccctgtgtgtgaaacgcaataattatatatgtggtgcctagagctgatgtgaagaatgaaaggaatgcatttagaacacttggaacagcctggagcacagcgaacactaggtcaagatagccacttactgtcggggaggttagttccaacatggctgggctctcagcaagtcttcttttgaggaaaggacccagaagtggaaatggcccctctccttactagctgtgtcctcacccactccactcatctacacagtttagaatctgagggtgaaagaaggaagagcaggcaagggaaggcagcagtggaaaacagctcttgggtggtaagtagggagcaggaagagcagttaccaccatgcttaaaacaaggtttttaaaaaaaaaaaattgcctgaagtcacatttgaaaataaagagcttggtaaacatgctgatggcaaagagaacttgtaaaacagtttcacttgaaaaaggccaaggttaatggtataatttcaattttgaaccttcttttaatatggattagtgctctcaaatatgggatttgacattaagatgccaaaagaagactcagaaggtaacctcaagcagtattttttaaggaaatttcttccttttatcatttgaacgcagctgaacaaaaacgttattaaaaattattctgtcataaaaacagcaacatcaatgaccataacaaatgctaaaaagcaaaattatccatgaaattaaaaatatttcacgaatccaaggtgagaaatattttagggatgacacttggcacttgagatttatgtaatgagacattaccaacttttatgtataaaatttcctttctgaaaaaaaagtatgaaaaatcaaaagaaggcaccaaaaaagtcccccactgatttggaaaacatattcttttttttttttttttacaattaactgcatttggagaactgcatcacacttttaaataaaatatacataacacattttctctttatagaaaaacctttacaaacccttaagtttgctgaattactgctgaaaaagtatttttgaaataaaatatacagaatgaataaagcatctttactccattcttcggaaattatctagatacaaatatatacatggctaagttcaaaaacttacatagtagaaagtttaataatttgatctataatattaagctgttgatactttcgattggaaagaaggaggggaaatagtgaaagaaaaattaaccacagaatatattctttgcagtttgagatataaaatgttttatcatttacattaatgtgcataacattttaatattaattgttgcctctttcatcttgctgtcttattttttaaaagcttatcatagaaaagtctctatatgaaattgttcatccaaacagataaaaagttggaattataactgggccaatgaaatgttgttgttttgtattttattgctttgcttcttctttagtaatcatctttgcagtctgtctaaacaattctctgtgcactgacatttgcaataatgtgtttacatcacaaagttagaccctgtcattcgatggaacaagaggctgtattttgtagcccccagacactctgcataacttactccctctttggcctgagagtgtaatcgttttttcatctgccatgtttaattacctttacaggcattaacaacagtttactagaaatcgatggaggagcaataaattcattaggttcagtggaggtaagaagtttcatattctttttctcaggtgaatacctatttgagaactactaacttcatcttccataaacctaaaaaatataatatatgattttcatctgtctaccagttcttaatctcctaccaaagatggagtcacaacacaaaatcaggagtcaatagttacaatgctttctcactctgacacaaaattgtgtaacttgaaggaaacgtgggttcccttatgcatgcaaatgccctatgcgactacagaatgtgttccctacacttcagaagctgttgatgttccactcagatctctgtaggatcccttttaccagtttggtgtcccattcctccctacaggtgttgctgcccatcttctccaaagaattgcccttgagtgaccagagcaacacccagaggttctggggagatatatcactaaattcggcccccacccagggtccatagctaaagactgaatggtgggaagggaaggtacaaaagtctacactcctgtctcaaggcagaactgaccctgtagtatgtttcatgctcccaagactccccatgtgatcaggttaatttcacctgaaaccacaaccttggtagcttcttccacttccttatactaattccctcactcccttcctggtttctcccaagagccctctcttactaatcacctgcacacccatctccagttctagggaattcaaccaaagaccctgtagaagcaaacattacagaacagacaggcatacaaatggttttccagtttttgcaggtaatcaatatctcagccattttaaaaggtactgtccacagtgttttataagcacaagttggggatggaggggaatcacatgcctgttatgtaattgtgtgaaaagaagttcctaagatctacaaagtcacatcatttgcagaagtcactaactgattcctgctccagggaaggctgcagttggcaagggctgcccttcttggcaggtgtcaggcagggctctgcactacaattctccctgcattgggagaacaaaaggagtctggggctaggaagaaaaaaaaaaatgacaagcgaagcattaaactacaaacagctctttgaagcctccctgatagaggtggttgtgtttgtgcaacagttattgggttgagtctaataatgaaaggacagatcaccacttactctgtgatgtcagtaatgaaagctatcaaaactaagcctgagtgggcctgactgtcaccctgtaaatctaacgtggacagcttaatgagggagggacattatcttttctcacactccaattttactcacataagaaatgtggcccacattggcaattaacttgagagattaattaaatccaataacaagttcagttccctccatagtgcattctgatatcatgtgaaggcaccaacatgctatgggcacttagcacatgttaaaaaataatggaactaatttgggctttttgtgtgtgtgtgtgtgcggaaaactggcagctaaccgcctcagtaaattaattccacaaactgatacagctactcgatagttcacacagtcttatttccaaactctgctttattatcctgaaactcccaagaaacattgcccaataattgtgtttcttccctcagcaattttactcaccagtagtatttaacatattttattgggccctctgaagaataaggaggcagccattcagacaaaacataaactctgccccagcttaagaagcaatagactgggtcccattgtgtctctttcaaaacaacggctgacactgacaaggaacaggaagagcagcaggggtgcaggcatgagcttcacttagcgtcagaaggccacgtgatatatgttctggttctctttcttttgggttccctaattcgtccttagttcctgtttttgtgttttcttctctgaaacggtaaagtgctttcctccactaccatatatgaaatttgatcttaagaaataggagtcttcaaatttgaccaattggccaaatggttattaaactgatgccttagtgaaagtcaatgaaattgttttttaactggttgctgtaaaatcatattcctataatacagatcaaattcatatactagagttattatatagatactacataataataatgcctactcctgccccactgctcccaaatcaacctactcaaagaagtgcttcctaacaatctcactaccaaggactccttttattatgatttgagaatggagtacatgtttgaaaatatttcatctatccaagattaacgattaattcatttcctttttggtattattaagaaaaatacatatcctgtctgatggaacttctaataaataaataatgaaattacaacatgaaggtaacctaatctttgacaaaaatgggaaatataatatttgggtagcctttcatagttactgtggttacaaataccctttaggaaataacgaaaagagcttgaaggtttcttttctattttggagagaattctatgacaaggtgatattttagacctaccctaatagtcactagtgcagaagatttacattaacaatctttcatacagccagaagtttcatctacctaagtggcaccttgaaactagaaagagatggtaaataacaacaagcctcaatgttctaagaataatcacatcacctgaagcatggtatctctgcgcatatcttcaattattaccaaaaatgtctatgctataaatatacttgatgacaaagcattcctacacttgattaccaaaaaaaaaaaaagtaaatggtaaacaactgattgaatttattggatctggggtgatcttatatttgtatcaaactgtaaatacatttaactcaactgatccaatattagcccattagtccatattttccacttagggtattattgcagacctactgataatcataatggctaacaatattaagctcttacaaaatgctttacatgcattcattcatttatgtgactcaacaatcccatgtaataagtactattaccattgtcattttacagatgacaaaactaatgtttagaaaggttaagtaacatgcacagccacacagcatctgggtttatctgctgcttggtaaatctggactaaacaaccaacagggatcaggcttgatattctgttccacctgatggccaaggaagatactgtgcaaatgcctgcacatttgtccttagactacaagctttctttcagtcctgtcagcattgacactgccaatattttaagaaatgtatttaaagtcccttctgatatttcttatatcaccagctaaactgcacacaaaataagttaattggttctaaggtttacctaaatatttctcattgtagcagaattgtggaaggagaagtagataatatcaagagttgactgttccatgttttatagaaagtaagagtcagaaaaaatataacctaaataattccattgaactctcagtatatgtaggagtaatggcataatgatatattgttgttataattataggtaaaagataaattcttggaaaataattttaattcacattctctaacatgagaaatttctcttcacttaaggtaaacttcgaatgtttcctttctttccacaaggtggaaatcttgaagtaatgggctactgaaaaaccagagaaattatatgcactgacttacttattcattcttaattttagattataaaagttttcttgtgtagcttagagaattttccaaatcctttataactgtggttgtggaattccacaatgttgaacctgaatagattcctatttatgacaagttacaaatttcattgtagaaacgtaggtgcaaaagacatagattccaaagatttaccactttcagtatcaaataatttacctttcatttttagcttgctctcacataaaaattgatccaaaatgctgttttaggaagaaaccagccctcataaattcttgatgaatccagatcaccaatatgaatatcagttattgaaatcctcagaacatatatgaaggggattaacactaatcatcaacacactaaatggccctaacttaggctgttacgtaccttcattcttctgctttatacagtctataactgtataaagtcttccaactggagttcatggaatcagatattcttaaaagaatacatttcaagatcctcaacttttttcctaaaattgatatgtctgaaaatgtatctgcagtaagggtatcatggggatgacaatttctgtttaaagatctcgccttttcatctgcaaacaattgtcaaagaatacattgctcctgagaaaaaagtcccatgagagcaaagcaaaatgggaatctgtaaaaaatacaatggcgatggtgtcttatttctctcaggagcagactcactgcaaacctcctcaccatatcagccaatctatttcagactgagaactcagaagtgaaatgacaggcatgggaaggaccacaaggaagtttaattgaatgtgaaaacccaagttgaaagaaagtaggcctgacctagctgattgattcagcaaataagtttttcaaaataaactataaagtggacatttttcataaagctaatgagttaaatctgcagttccaaggcttggaggaaatacactactcaaagaatgtactaagcaagagaatcttgtccaaaaattaaaaatcatatttgcagaggtatactgaaatttggaatatttcagttttcccacctctgagtctatcagattcaatatggcacctctaagagaaagaggaataggtataattaatgggcatttgagaagctttggtaagcctttggtgtacttcccaggaaaaagagaaattgaatatcttgagtgactgagcaacaaattctttttcaagacagtttttctctcaataaaattgaagtagaactaattgagttgtcagaggatgaatcataaaaaaaaatttgatgagaaattactatatgatttttggcataaaactggcaagaagttttaaaaaattcaatgacataaaaatacctccaatctcatctgcttatgtatgtgagaaagatttctcaatgcttatatctagaaaactgaaaaattgggattgtgctaaatcctgttttgttttgaaacaaataatatttgacttgatataggaatgaattaaaaaatcaaaaaaagccctgacaatctcattattaggtgaggtttcaataattttaacttttatatttaataattgttaatatataaaaaatataagaaatacatattttttgttttgatcaatcttgtgctaataatagtgataaaagctcaatccagatgtaatttttgaaatgtagaggattataaattcaaaatttttttaaaaaatttaatgttctgagactatatgatgatgcataaaatatttcaagcatattacattgataaaattctgtgagacaaatgaatgaaatatgacttatagagaaaggaatggtgcacaattttcaatgaataaagaatttgtttttatattgttaaattgacaatagtgagactcaactcattatagtatttagattccaaacggatatacttaaaaaatatttaacaatttttaaatgtcaataataagccagaaattatattctttgcaactctttaaacttataacaaattggaagcctatagtttttccagaagtctttcaaggttcagggagcaaaaaaagaaagaagaaaaaaaggagctttctgctttgtttctcctgccttgttattatttctggaattagaagatatgctttcctggccccactttcagatttgctctttgatccactctccccttagaaattggatttctgaatagctaaggtctccagatcactgaattgtggatatgataaactttccaaacaaatatgattctaattatttgctttaccctaagactcattacagcgttctttcaaataacaatcttctccagtgcttttgaaatatggttctataattataaaaattcaccttgcattctatttacaggcttttcattttatttaggtccaaaatacaaatgcattgctttgattctgtagcagatttttgagagtaatccctttttaagtgtctttacaaatatgttatctagtccaacaaggcaaaaaaggaaaatagaaaagaagggagagagaaaaaagaggaggtgatgaaatgccatcatgatatcagagaaggaggtggataatttaaagcagcaaggccctttcaaatagaagatggctaaattttatcactaattcacaataggattagaacatgaattaaatttcatttgaaaacaaagatacctattgctttatatagtccctgcctcaacagcaataccagcctgatttctttcacagttttctttctgagacaagaaataccctaataaaacaaagggaaaaatatatttcccagtgtctaatgatctttataagtcctttgacctttccatggacctcagttttcttatctgtaaaataagaaagttgatttaaaccagttatttgaggaggggcaagagacggggcaaggagggcagatgagaagaatcacaggaagggatgaatttttcgacagaatacccacactctgcatgactttccagattcctactcaagctgcaccactatccctatggatgctgagaactccagctgtgggaatttgtgttctctccttggaagaggacaaatggccggaaacaccatgcataactttaaagatcccttccagcaatgagataccatgattcttcggctatgactagaaaacatattgttactcatgtatttcttctctcctttcctttgtctctggcaagcatcactatttgctccttgctgcctagaacagtatgaggtatatatgcctggggtgtgaaaggagagatggagggagggacatatttacagcagctatgatgctcaagagctatattaatctgtagctctgtattttcatgacttcacaactccctaagcttaaaaatatatatacgtacatccggctgggcgcagtggctcatgcctgcaatcccagcactttgggaggccgagacgggcagatcatgaggtcaggagattgagaccatcctggctaacatggagaaaccccgtctctactaaaaatacaaaaaaattagccaggcgtggtggtgggcacctgtagtcccagctacttgggaggctgaggcatgagaatggcgtgaacccaggaggcggagcttgcagtgagccaagatcgcaccactgcactccagcctgggtgacagagcgagactctgcctcaaaaaaaaaaaaaaaaaaaaaaaaaaaaatatatatatatatatatgtatacacatccttatatatgtatatatatgtatatatatgcatgtatatatgtgtatatctatacatacatccatatacatatatatatgtgtacacacacatccatatatatgacattttaaaagatcctcttttctctcatcttgaagtgtgttaaaaggtatgcgtaaaaaggagctacaaaacaatgaggttactagataaggtacttttcctgaatcaaagaagctcctagacaaaatggggcctgacttggtggtcagctgtcagagtgaaacttaatttaacagtaacaatagacaaagtatgtcagactaagtgcttcatcgacaatctgaacaattttcaataaaatggccttgatgtcagttagggcagacaaccccaggtagagaaagactactcgggaaaaaaaattaagaaaaccttctgcagattcgaagggggatttttttttatccctctgaccagcctctctgtatgtaactttcagtggttcttgccttcaagaggttttcccaccacagtgaggggctgagggagatgtttgtgtccctggatctagtgacttgttttcatggctctgaagcccacagtcactcccatttagaaaatattctatatccttttggattacgcttgatctctttttatctaattaattacatctcaggaaccaagaagtaattacattaagaacttggaggcatgccttcaggaatgtcactatggctttctgtttgtttgttttaaagcaaatcagcactctggaacttggttcagattagcaattttatgcattcagctggatacaatgcaactcctggttattagaataagaaataaggtgaagaacatgaaggaatgtggttcaatctctctctctctttcccttcctttctattccactttagtatagcaattacaggcctctgagtttgggtttagcatcgtgatggtaggcaggtatttacttttttacttgagggtcaagtgggatgaaaagcaaggaaaaaaagccaggacagtccaaggactggcacatgtcaaagcacagaggaacaatacagatcttcagaggaactttttttcttttacttcctttttaaaaaactttgtcagtgtagtaagtggtgaagactatttgctaaagtgttcaacaacataactgctctgagatttctccttcactaggctactctcttaggcctctgtgaacatctgtgccatgtgtacaggccacttcctaacaggcccaaagaggatgtgttttcataaaagttgtaaacacatttaagaaattatctgaagctcataagccacctgatttcctaggcaaggcctctcatcacattaaccatattttacgtaatgagcagatgggcagaataaaaccagagggaggagaagtggaggaaaaggacagtaatgagtgatgaaatggaaatcacgtgattaatggaacatagattttaaaaagtaatgaagagtttatccctagggtagaaaacagggaacaacaaaaataagtaccacgttgtcaaaacagtaaaataagagagtagaacaaagaaacagagcaagacaaagaaatgctggttttaggataggccttattttaaagacacaggggattttggaacttaccattttgcagctatttgtttaaacaaaaataaatttatgttgcctggtgtcctaaaagttacttatgacaacggtcattaatagataagagcctgcagctatccgggtacaccaacaccagcctttgtgtttgttcaacatttctttctgtgggaaatgtaatttgtagcataagagttcacaagaaccctcagctccatggctccatcactaatgaaacaagtcctggattttcatagcaaccatcaagcataaatttggctccccagagcatgtgaactttatgtgtgaattacttatgtgtgtgcacaaactaaaggcaaattcatgtgaagcatacaggcaatttacaaactctatctgttctgaaagtctgcacagtaacaggaacacagacagaaataacaaaatgggtgtatatgtccaggtttctccacaaaagatgacctgtatacttgcaagggcaaaatatcacaaaaacaaccctaatgcaagagtagtaatgagagcaactaaaaataaaatacagaggctgggcctggtggctcacacctgtaatcccagcactttgggaggccgaggtgagcagatcgcctgaggtcaggagttcaagaccagcctggccaaaatggtgaaacaccgtctctaacaaaaacacacaaaaaattagcaaggtatgctggcaggtgcctgtaatcccagctacttgggaagctaaagcaggagaatcacttgaacctaagaagtggaggtgcagcaagctgagattgcgccactgcactccagcctgggcgacaagagtggaacttcgtctcaaaataaacaaataatagaaataaaatagaagataatgactgtgtgtgtgcactttcattattttgaatgttagtgctcaaaggaaagcaaatttagttagaaaacaagctgatagaaaaacagtttcagagattcttaagagaacttcaggacacatttaagaaccatgaaggctggtaacacaagttttgaaaaaattaggccttgtttcaggacaattttgtttttcccatttctaggaatccgatgtatcattcacacaatttgtattcccattagccttgattagggacatatctgtgctcacattagactccctgaatacagggaccaaaattcattcaatgttgccacttgggtgtctaatatgctgcaaaaatctctaggaaagatataaatgaacaaataaatgatatgctgagataacattgtgaagaatttggcaatgaggaggggcattatcttcttccataaagacattgatttattctttaatatcactcagaatcacaagaaataatcagctgatacagaaatggaacagctgtctcacacagaagtggctaaagagaaaaaatttccacaaaatactggaaaagatggtaacaaatcaaatttcaaagttgggcagccctaccaaaaagagaaaaagaagatacgagaggagtcaatagtgacagcactactgaaattcaaaaataggacttgaggtctaagacaaactgataaaaattaaaataatggcaattactcattgaacatttactatgtgccaggtactatatatgcatgatctaatttaatctttataataatccatttaggtaagtacttctatcatccttattatacagatagtcaaacacgatgataaaaagtaagtaactttctcaaagtcacccacctagtaagtgatggaaccagtactttaaaacatgtctgtctgactccttaatcaatgcaacactaagatacatgtgactaatcaaggaaaaagaaagagttttgatttttgtttctttttccaatttagaaaagatgaaggagaattctagaaccttcacttctgagcaaatagcaaaccaacttgctgttgggaatttaagtgtcatgcacattaccatttacattagtttgaaaaagaagtaaatgtccaacttttagtttctctaaacagttattctagttttcctaagtttgaccccaaaagggatttgactgtgaaacaaaactctctgtagttctcagatatggttagacagtcagatgcccacaagtaacagcctgtgcagaacatcaacacagtatatcaccccagcaaggaaagttcaaaggaaagatttctaaggctactgagataaaatggaatagaatctttccagtatatttctctttgctatcaaaccaaattagaaaagactaatttatactaaattataaatcacagcatttctaatttaatcactgtctgtttttttaatttttgttcttgttttagttttgcatttctttcacccatgggatagatacacattctcacttaagcccctgttgaaactatttccattgtcccctagatcctcattctactttaatgtgtctatcttcagtaaaacacaactgataaacctgaaagataataaactggacagactagcactgagattctaaatgagataaaccggcagtcatcctgacagtaatggaataaataaagcatgaataattacattaaaagacaatttctgatttaaactttgcttttcctgtttttacacagtagaaaaaattaggctgtctggccttccttaggagaaatctttcttagaaggaatgtgtgcttatttttaaatctatcataacaactgatatatcagcaacaatgtacccatatttacctcatatttatatgtatgtcttctctattataagcaatatgttatgaaatatattagagattagttcaaagagttgagattggttataaagaattatattagtcgggtttaaaacgtatttggaaagttcccagtataaaatagtttagttgtgttattttcctcttgatgtcttgaatgttgcaaggtactattctatggctggtaggggcatgcaacaggtgggagtaaggaaggaaacagcaagccaataataagttttgaaaataagcccaatcattaagtatatgttgagtctcttcattaccgtgaataggaagtctaatagattgccatatgcagaaacagagaaaatgctgttttagtggcacctaatgaggttccaaaaatgcagtaacttgtagattctttcacattcatactctgtgtaatataacgctatatagcacacttagctctctttataccttgatattttaatgcaaacacagattcttttctctatggctttaaacattacacaggaacaagctcccatgaacctctttcacattcctactcagagctctctgtgaaaagctgtcatttcttgttctattcaagtcagactacctagtctccaggcacaatggtaaaaggaatgtcaaggtaacatcttcatttattcatatgattttctctttttttttaattatactttaagttctgggatacatgtgtagaacgtgcgggtttgttacataggtatacacatgccatagtggtttgctgcacccaccaacctgtcatctacattaggtatttctcctaatgctatccctcccctagccccacaaaccctgacaggccctttgggtataacctagtaatgggacggctgggtcaagtggtatttcttgttctagatctttgaggaattgccacacagtcttccacaatggttgaactattttacactcccaccaacagtgtaagagctttcctacttctccacatcctctccagcacctgttgtttcatgactttttaatgatcgccattctaactggtgtgagatggtatctcattgtagttctgatttgcatttctctaatgaccagtgatgatgagtttttcttcatatttttgttggccacataaatgtcttcttttgagaagtgtttgttcatatccttcacccactttttatggggttgtttgtttttttcttgtaaatttttttaaggtctttgtagattctggatcttagcactttgtctgatggatagattgcaaagattttctcccattctgtaggttgcctgttcactttgatttcttttcaaggaagcactaaatatgaaaaggaaaaactggtataccatccactgcaaaaacataacaaattataaagaccatcaacactatgaaaaaactgcatcacctaatgggaaaaataagtagctagcatcataatgacaggatcaaattcacacataacaatattaaccttaaatgtaaacaggctaaatgccccaattgaaagatgcagactggcaaattggataaacagtcatgacccgtgggtgtgctgtatcggtgcgctatattcaggagacccatcttatgtgcaaagacacacaaaggctcaaaataaagggatggtagaatatttaccaagtaaatgtaaagcaaaaaaagcaggagttgcaatactagtctctgataaaacagacttttaaccaacaaagatcaaaaaagacaaagtagggcattacataatggtaaagggatcaatgcaacaagaagagctaactatcctaaatatatatgcacccaatacaggagaatccagattcatatagcaagttcttagagacctacaaagagacttagactaccacagaataatactgggagactttaacaccccactgtcaatattagatcaacgagagagaaaactaacaagaatattcaggacttgaactcagctctggaccaagcagacctaacagacatctacagaactctccaccccaaatcaacagaatatacattcttctcagcaccacatcgcacttattctaaaattgaccacataagtggaagtaaaacactcctcagcaaatgaaaaagaacagaaatcaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagcggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaacagaaatcataacaaactgtctctcagaccaaagtgcaatcaaattagaactcaggattaagaaactccctaaaaaccgcacaactacatggaaactgaacaatgggctcctgaatgactgctggttaaataatgaaattaaggcagaaataagtaagttttttgaaaccaataagaacaaagacacaatgtaccagaatctctgggacacagctaaagcagtatttagagggaaatgtatagcactaaatgctcacaagagaaagcaggaaagatctaaaatcgacaccctaacctcacaattaagagaactagaaaagcaagagcaaacaaattcaaaagctagcagaagacaagaaataactaagatcagggcaaatttgaaggagatagagacacgaaaaacccttaaaaaaatcaacgaatccagtagctgggtttttgaaaagattaacaaaatagatagactgctagccagactaataaagaagaaaagagagaagaatcaaatagacacaacaaaaaatgataaaggggatatcacaactgatcccacagaaataaaagcaccatcagagaatacataaacacctctacacaaataaactagaaaatatagaagaaatggataaattcctggacacatacaccctcccaagactaaaccaggaagaagtcgaatccctgaagagaccaataacaagttctgtaattgaggcagtaattaatagcctaccaaccaaacaaagcccaggaccagatggatccacagctgaattctaccagaggtaaaagaggagctggtaccattccttctgaaactattccaaacaataaatagaaaaagagggactcctccctgactcattttatgaggccagcatcatcctgataccaaaacctgacagagaaacaaaaaaagaaaatttcaggccaatatccctgatgaacatcaatgagaaaatcttcaataaaatactggcaaactgaatacagcagcacatcaaaaagcttatccaccacgatcaagttggcttaatccctgggatgcaaggatggttcaatatacacaaatcaataaacataatccctcacataaacagaaccaatgacaaaaaccacatgattaactcaatagatgcagaaaaggccttcaataaaattcaacactccttcatgctaaaaacgctcaataaactaggtattgatggaacagatctcaaaataataagagctatttatgacaaacctacagccaatatcccaccaaatgagcaaaagctggaagcattccctttgaaaaccagcacaagacaaggatgccctctcaccactgctattcaacatagtgttggaagttctggccagggcgatcaggcaagagaaagaaataaagcatattcaaataggaagagaggaagtcaaattgtctctgtttgcagatgaaatgagtgcatatctagaaaaccccatcgtctcagcccaaaatctccttaagctgataagcaacttcagcaaagtctcaggatacaaaatcaatgtgcaaaaatcacaagcattcctacacaccaataatagacaaacagagagccaaattatgagtgaactcccattcacaattgctacaaacagaataaaatacccaggaatacaacttacaagggatgtgaaggacctcttcaaggagaactacaaaccactgctcaaggaaataagagaggacacaaaaaaatggaaaagcattccatgctcatggataggaaaaatcaatattgtgaaaatggccatactgcccaaagtaatttatagattcaatgccatccccatcaagctaccattgactttattcagaattagaaaaaactacttcaaacttcaaatgaaaccaaaaaagagctcatatagtcaagataatcctaagcaaaaagaaggcatcacactacctgaggcatcccgctacctgatctcaaacgatactacaagattacagtaaccaaaacagcatgatactggtaccaaaacagatatatagaccaatgaaacagaacagaggcctgagaaataacaccagacatctacaaccatctgatctttgacaaacctgacaaaagcaagcaatggggaaaggagtccctatttaataaatggtgttgggaaaactggctagccaaatgcagaaaactgaaactggatcccttccttactccttatacaaaaattaactcaagatagattaaagacttaaacataagacctaaaaccataaaaaccctagaagaaaacctaggcaataccattcaggacataggcatgggcaaagacttcatgactaaaacaccaaaagcaatggcaacaaaagccaaaattgacaaatgggatctaattaaattattcatactattttcatgttggacagtattataaaagccaatcaaattggagaaataacatagtatattttacaaaatgtaaatttgtgatgcaagcagaagagcttctgctactcatgagagttatattcttgttacccaagaatataacttcgcatcttttcaaaacaacctacacagagtaactcttaaaaatctgctagtgagggggaaaaggagggagaaagcaaagcttcaaaggactttctaaagaaattataatactaagacttttatatgacattcaaccctgttttccccccttctcccccaacaaaataacctagccaaacaatagagaggcaacgtttaaatacaaactttcttccactcaacactagaaaactggtaagattaggtcttcaaagaggctgagctaagaattctcctaagctttaaatttcctgcaaaggctgagttttatttcttaagggaagagcttctgtttggcttttctttttctttttaagaaaaaaattctatataattataggtttattgttacatttgtatgtatgagcaaagtacaggcaaagaaagaaaaacattgtcaagaagctggttatgactaaatatataaagatggaatagtctaacaatgccagttgaataaatactgtaacaaaactgtaatttaaatgaagctaccaaaatatttcaaaagacaacgcattttatgattttaaagtttatcttcaaaatgaaatatgatcatagctattaacaatatgctgtaaaataaaatatgctaaacattgcttctgttagtaaccactagtttctcaggaaacattctttatagagcaactctgattaatgtacaagtgacagcttttttttttctgagcactaaccttacagtataccattgttttcaagacagtgtttataaaagctgtaaagatacgttttagacattaccttgtctatatctatgaactgtcagcaaaaaatatccctttttcaccttctctccactctccatttccagttagacattgtgttttcatccctatatagcttgcctaccttaaacagaaaaatgaccaacatattcttatgtgcaaaatctgaaaacatttctttcagaataatatgacctgttagacatccgaagatcaagacagggataaagatttattaggccaaaccacacaggacttatatgttatgggctgtaggacagagcgtattaaattatttccctgatcacacaactgaatgtaaaaggctaaacgtttcactgattgtggtcaaatatgattgttgctgcagtagagtaaaggccccaaaagtacccttagttaggtcagtgaccaaatgtcactctatatgattttgttcttcacgggcaatgtctccaaagtgctaaatgtgtgaaactccagcttgaaccaaggaatgaattttagtttgctcttaccctttgaatggataagcacattgaacatgaaaatcttctctcttccttatcaacaaggcactaacagaattcagatttacagatcagacacagaaatatggaaaatattcttaatgttagatcaaatacggaattatccaataaataaatattgagtttacaaaccatctaaactttgactctcctacttcccatctaccaaggaagggagaaaagtaagaaatggaagttaagctcaaattactcaggtactgtttgttaatatatctggtgactatcttatgtgagggaaaaactggaataataggaaaaggtttggtgattctacgtagcttttgtgactgtagttctagctcctaagttttactttccaaatagctaagggctgctgttctcaaaagagctaccctttctaaattcaggaaataacaatggaaagaaataattgttaaataaaagtatatgttgatgtttaccctattatatattattttcattttatatgttatatgcacaaaaatttattggtacatatttctaaatgttaaaatcttggttctctgggtgataggatcatacatcatttttatctttacatctatacttttgtgcattttctgctgttctgcaacaagcatgaaatgattttatgctcagggagaagaaaaaagccatctcccaccactacgcccacttcaagaagaagaatgaagagtaaaagaggagaaatatggtaaaggagtcagctttgtactctctgtctgctgttttttgcttcctctcatttctgctttccttagcagaagccaagagtgtttggggggcctaggtctgaggccagctccacctctgaccagtgtacctccaattctctccgagccttggtttcctcttctatagaacgacaataataatggtactcacaagaagtcaagaagaaacaggataatgcatgtaaagctgttaccatggcgcctggctcaaagagaatacccaccaacattgctgcactttttttcgccagccttacctgatcatagaaatcttaagatttataaaatactttaaagcaaacttgtccaacctgcagcccacaggctgcacacagctcaggacagcttagaatgcagcccaacacaaaatcctaaactctcttaaaacattatgagaccttttttttgcaatttttttttaagctcatcagttgccgttagtgtattttatgtgtggcccaagacaattcttccaatgtggcccagggaagccaaaagattggacgccgctgctaaagcttacaatgagctttaacaaacagtaatttaatttttaaactgatagtaaaaagcagagctagaattcaaacctcaccttcccacatcctagctctgataaccaaacaccacttttgagttggattgaaacagttgcctactggagctgcctccctgaggcttacctgcaattggtaaatttcagtaactttgcataccagctgttaaacacagacattattttaaattattatagaattatacaaattaaaatataaaagttacaattaaataaaaatattttaaataaataaatatatgaagctcgtcatgtccttatacttttttcttttttttgagatggagtctggctctgttgcccaggctacagtgcagtggcgcaatcttggctcacggcaacctctgcctcctgtgttcaagtgattctcctacctcagccttccaagtagctgggattacaggcgcctgccaccatacctggcaaatttttgtagttttagtagagacagggttttgccatgttggccaggctggtctcgaactcctgacctcaggtgatccacccacctcagcctcccaaagtgctgggattacaggcttgtgccagcgcacccggcccttatacttttattatctatactctttaagcttatttgcacctattgtatttgtagagtggaaacactacataatagagtgctacatgtatctcttcctaattcacttgcagtaaattcacattggtagcttgaaatcagccaaactggcaaatgccacaaatcaagactcaatatcatttcgttgacttgagagtgatggagaatatgcagattaacttaaagtgtgccatatctgtggctgttatattctgaataacacacacacacaaatggagaacccattcttccagtattataaactatcatacaatatgtatgacagaaagatgattattcatcagttgcaaacatagactggctatggatataagaatttggcaaaaatcaaccaaagcagtgtgtgagaatctactggctatccaggatttacaatcaagagtagtgattattttattcatatttataaattacatgttacatgtcctttatatcagtaaaattaataataaacacacatgcaagcatgcacattagggcatgcatgcacacacatacacatatttttccttgagagccagctgttaaacatttaccagcataccactaaattgaccattattttaaactaagaggaacctagaagctcttaagcagagccctaggctcatcttcaaatcactaaggttgggttataaatggttttagcttcaggtaaggctaccaaattagatcattgtatttaaatatactatgttggcaattcctatcctgcacaatgatgaagtaggctcatagcttcaagttccaccattattacagaaaaatttattctatggaaacgcaacttagggaaagtcaagatagctttctacaattcacaaaaactatggagacatacaaagaagtaagatatggctccttcctgcctccaagacagttgagcagggaggacaaacacataaacctataatataaaaggcacagcactgatagatacaacgtgctatgggatgacaagggagagatcccatgagtttacacttcaggtcctggttaatggcaccagtctcacctgcctcaaaagaagcaagggcaaggaggcaggttccagggagaaggagaaacctataaagtatggcataataggaagaaggattctagaatcaggcagcctgtgctcaaacccagactctttcactaactgtgtgaacacgtccaagttacttggcctctctaagcctctgcttcttaatctaaaaaaggagaatagtaactcctgacccagagcactgtagtgaggatcaaataagacaacatctgtgaaacacttaccccagtgccccataattcaaaagtgctcactcaatgaacattacctactactgtgatggttgttgatagccttgagagttgaaatggctgactttggggactaggagggtgcaggaactagacagagggattccaggcagaaggaagaaaataagcaccccccaccaacaaaaaaaaaaagaaaaaaaaaaacagagattacatacaggggcccacttagtagtcctgaggtagtagaatattcctggaggtctaggtcaggcacagctacagcaaataaagactgaggctagaccaaggctcttccagaatggttcaaatatacactcattcctcatgctcttctgagaaaaacgaaacaaaatcaggcttttaagatgataccctttttcttctgacaggtactgtaaattgtgtctctgatatattttgaagagcctataagggaatgataaatcaggcaatattacatatattcatcagtaccttaattgttgttaaatactaacaacacctaaaattgatctgtaccaagatttactgctctgacaaaaaaccacctggaaaagagcacatgataattaagaacgaccaagggtttgaagcaatctaacgcgtatgaacaagatttaaactcctccccgagggaataactaggtgatgtttattctgtagatgaacaatgtgattataacaatggaagattgatgagatttttttactgtgggaatctgatttagccggctagctcagataataggaggatgcaaaactaagccatccagtaccacttaaaaattctttgtgagggacacatcttcagtgacctgaaaaaaatggactgcaagtcaggcaggcatattaggcagctacaaactgtcatacaaaaaaacagcatttaccaaaaagtttctaaatgcaccacaactgagttcaaccaaattagagagaaaaggtaggaagagaattacattcttatcagaagcaaaggaatttttttttcttttggtggtcttttgggcctaccaactgttatttgagtctaacaggttattcttagtaatccctcttgtccaggaaaagaggaactgcttggtctattttaataaacacacaaactaaaagcaaggcaatattagtcttccagagccttgctatgaaaagtgtaaagagctatcacctaggagcttgttagaacctcaggctcttgggctccaccctagacctgaatcaaaatctacatttttgtttgtttgtttgtttgtttgagacagggactcactctgtggcccaggctggggtgcagtggtactatctcagctaactgcaacctttgcgtcccagactcaggtgatcctcctacctcagcctcccgattagctgggactacaggcatgtaccaccacgcctggctaatttttctatttttagtagagacagggtttcttcatgttgcctaggctggtcttgaactcctggcctcaagccatccacccacctcagcctcccaaattgctgggattacaggcgtgagccaccatgcctggccagaatctgcatttttaacaagaaccccaggtaattcctttaaagtattagaagcaatgctctaaagagacattcattcgttcattcaatacgtttgcgagatctgcagtgtcatttatggtatgtagccactagccaaatgtgactattaacatttcagttagttaaaattaaataaaattaaaattcaaggatttatttgcactaaccacatttaagttctcaattagcacatgtggctaatgtctgccatatacattttaatcatcacagaaacttctattggacacatcactgaacaaagaagacaaagatctttgtactcacaaagtttagattctagtggtgggaaagcagatacaataaacataagtgactcagttaaatggtatgttggacggacagttcaaggctaaggacaaaaattaaaaaacaaagcagccttagagggatcaggaggatggaaagacaggaattttaaatatggcaggtctggtagtttcaatgaaaaagttacattaaaggagaggcaggccgtgagctgcccgggatgggggcaggggggtagtttcaaagggtaaagcctgtgcaaaagccctagggcaggtctgtttccataacagcaagggtcccatgtggctgcaggagagtaaggggagaaggcaagtaaaatggtaggagaacagaggagtatggatcctgggtatggaaagggcttccttatccattgtcaaagatttgagcacttacatgaaacgaaataaggggtccttgcagtgttttgagcagacaggtaacatgcttcaacccgatctcaaaagttattctcgttcagcaaaaaatgactataagtaaaagttattattattttttaattcaaggtcatgttcagatgtagaaagatactatctgcagtggcaaaatgactttgtttacaagttttggtaaccatgagaagcttgttaatgatacacaaacaagttattaaaatttatcactgtaaaattcagatactttttcaaaatcctctatgaatatgcagagtcacaaggtcttacaggttaccacccagaaccagtagccatctttgctataaaacttttcagcaaatcctgaggaatgcaaaatcagagttgcccaattgcccaaaaggtggaactctgcttgagtgtctcaacctgaaaatttgttgattactttatagagagaaagagatgaaaatctgttaaatagtttcaattttttcttttttaccccaactcatgtaaattgaattcatctactctaacatcccagttaaatgtcaaagctttgggaatcaaggtagggatttttatttatttttcaaagttcagttcccagaaacaatgacacattttacccacaagtgagaatgttgttatcttgtaggtaatccagctactgttctatgaactgtaggtcactgtagcctgtctacaaaatgccatcatcagcttcaaggcctgtgttcactaagacagccacatggaagttatactgaacaggcaaccctaaaatgactgagcgccatcgcctgagatttattccctgaggaccaccaccaactgtgatccagccagaattctggcaggaaaataaagtaagttcaccttctgtaagttaaatcaaatgaacaataaatcaaggcatgttgggtcattgggaactaactgctcagatgctcatggccggtgagtgaatcaactggcatcattttaaagcatctgggcatagcatttttgagctatagaacataagaggagattttagcaaccaaattattaccaacgtcagtgattggagtccagaactggagctgctttgatagttcattcgtgtattccttcattcattcaacaaatatgtgttgaggaactcctacaggtaaataatattctgtctgctaaaaatacagaactttacatacagtaaacttgtccacatgaaacttaaagtttcagttttaacctcctcatggctccctcttggagccaggaaccttccagagctaggagacctcaagaggtctttcatggatgggaaggattcagagactgttttagagtgataaggaacataaggtgtactaccagaaggtgaatcttcacagggtaagaggtgtatgtaagcagtaagttttatattctctatcctgaagccagagcacctaagagcttctttcatttccctcatccacccacagaagtcacccctaagaactgaagcattcttcatcccacctcatttctggcacagcaaaaccagaaggagcagggaaaacacattcccagaggccagacatattaagatactggaagtaagcaaaggggctaatagacctaaacaatcagctttggggaaaagaagatcctctctgttgcaaacagagctaaaaggaacagcctagaacagagcctacaagccaaagacagtatattagccaggcttctccagagaagcagaaccaatgggataaatgtagatatacagaaagagatttattgtgagggattggcccatgccattatggaggctgagaagacccactatctgccatctgcaagctggaggcccaggaaagcaggaggtatagttccagcccaagcccaggggcctgtgaaccaggagagtcaatagtgtaagtccctttggatcaaaggcccaagatacaggagctctgatatctgaggacagaagaagatggatatacctgctcaaacagagacagtgaatttgccatttctgcacgttttgttctattcacgtcctcaagagattgggtgatgctcagtcgccttgatgagggtgacttttacttagtctgctgattcacatgctaatctcttccagaaacaccctcgcagacacacccaggaataatgagcatatctcttagcccagtcaagttgacacaaaattaaccatcacttgtgtcctgccacgtatttttgttaacaaagctttactggaacacagccagttatttgtttacatattgtctatggctgcttttgatataaattctactgtccaatatagtagccactggccacataaaatgtgccttatccaaattcagacatggtgtaagggtaaaatacacaccagacctcaaagactgagtaggaaaaaaactgtaaaatacctcatcaataattttttatattgattacagggaaaaaactaatatttttaatatttttggctaagtgaaatatattattagaattaatctcatctgtttctttttactccttgtaatgtggctactacaaaatgtaaaattacatatggggcttacatctgtggttcacagtatatttctattggacagcctggcacagaaggaaagactccagtatgtatacagaccctggagacaagttgaatagaaaaactctgttcttactctaccttccactttatgtctgtttttaatactccaaccccaggtctttcttttaataattatcctaaattaacaaacacacaaatctgaaattcttgcaggtcactattgctgaaaattcaacagaagaaaatctgtgtatatcagaatttcacacaaagatgggtcagtggctgggctgcatagtggatatttgctgcctaccaacattctttctactatagcaagactctaagcaaactccacaaaggagacactctgaagtttcatgatctacatagatgctcaactaaggtaccaagtcatttaatgaagaaataataatctcttcagcaaattgtgctggaacaactgaataaccacacatgccaagaataaagctggaccccttcctcacaccatatataaaaattaacccaaaatggagcaatgatctaaatataagtgctaaactgtaaaactctttgaagaaagcataggggtaaaatcattaccctcacatttggcaatgaattcttatatatgacaccaaaagcacaagcaacaaaagaaaaaatagataagtggtacctcctcaaaattagaaaccttggtacatcaaagacattatcaaaaaaatgaaaagacaatctacagagtgagagaacatatttgtaaatcatatatttgacaagggtctagtatccagaatatacagtataagaaattcttacaactcaacaacaataaaaacaaacaaacaaaaacaacaaaaaaaccaggtaatgggtagaggactttaacagacatttctccagaaaaaacatgcaaatagccaacaagcacctgaaaagatgctcatcattagtcattagggaaatgcaaatgaaaaccacaatgacatgctacttcacacctaataggatggctattattttctttaatggaaaataacaaatgttggtaaagatatagagaaactggaactctccaacaatgctggtgggaatatacagtgacttagccactgtggaaaatagttttgtagtttctcaaaaatttagatatggaattaccatgtaccccagaaatctcactggtaggtatatatccaaaaggattgaaaacaggttctaaaacaggtacctgtgcatacatgttcatagcagcactatacacaatagccaaaaggtggaaacagcccacttgtccatcaacacccatcaatgaatcaaaggataagcaaattgtaatatatccatacaatgcaatattattcagccctaagaaaggaataaacttctgatacatcttataacctgggtgaaccttgaaaacatgccaagtgaaagaaacaagacacaaaagatcatatattgtatcattccatttacataaaatatccagaataggtaaatccacatagatagaatacagattggtggctgacaagggtttggggaaatgaggagaagctgcattgaaatgaggagttttattttagaaggatggaaatgttttggaactggatagagatgatgattgcacggcactgtcagtgagttaaacgccactggattgctcactttaaaatggattttttgttatatgactcttatcttaataaatttttaaatcatatattttttgcatttcacatgtcacaattctgatcttttaaatgtaaaatacattttacattacttaactatttctagtcctcacttctcctccaaaaaaattacattacagttgacactagattttgttaaactacccaaaatttactttgcatatatccctcttgtgcacaagttagtcagaattagtttctgttgtttgcaatcacataactttaattgatatggtaccttagtatgtcagtcagggagcctgaggtctaattctaggtctgcatctaattagctggtaatctcgggagaaattatttaaattagcttggctttagctttctcatatgtaaactgaaaggattagactaaattattcctgagggtttaaaattccataaatgacataacatctccttttaaaatattatccaagaagaagtaattgtcagatagtgatgatgtgacattttttccagtaaaaagtaaatttggaaggtaggccctgcttttactctagttagtccctccacctcactcttctggctcctcagtaatgtttagcatgcatattccaatagataaaatccctcaaaggtgttcagtttcatttctctgatgtgaaagggcaaatcaaatgaaatggttagagacaatgctcaaaatttaaagctgtatctaagtttcccaactcgattaggccattcttacattgctatgaagaactacctgagactgggtaatttataaagaggtttaattggctcacagttctggaggctgtacgagcatggcactggcatctgctcggcttctggggaggcctcagggagctttgactcatggcagaaggcgaaatagtagcaggcacttcacatggggaaagcaggggcagaacagagtgtggtaggttccacacacctttgaacagccagatctccaaaactcactcactattgtggggatagcaccaagggactgatgctaagctattcatgagggatcagccccccctgatctaatcaccccctaccaggccccacctccaacactggggattaccattcaacatgagatttgaggagacaaaacatccaaactatatcactaaccgagtgttcagattgtagtatagaaactatccaagggcacttcaaatgttcctcttatcattgaaggggctgaacaataatttgacccaaaagcttggcattctgcttttactagactaggctggtattataatgacctttccttttgaaaaacaatagtggtttctatctgttgtcttgtaaagatgagttttatattattaagaataataaaagattaaaaaatgttttaagcatttcatccagaagctacaaagcattatgttggggaagtttgaggagtttattaggtcaatctaggctctaatatactcagattattgatttaaaccggtgagcacaataaatcacactggtcatggaggtggcaccagctgaaagtgagaacacagatcaattacccgagagttctgggctttctcactgacttgccattaaaaaattaccttcgtggtttcacctcaaagatcagtctgctttgttttttttttttgtttgtttgtttttttgagatggagtctcgctctttcgcctaggccggagtgcagtggcactatctccgctcactgcaagctccgcctcccgagttcacgccactctactgcctcagcctctcgagtacttgggactacaggcacccgccactgcacccggctaattttttgtatttttagtagagacagggtttcaccgtgttagccaggatggtctcgatctcctgacctcgtgatccatccgtctcggtctcccaaagtgctcggattacaggcgtgagccaccgtgcccggcccagtctgctttttttatgcaaactttgaccgcttagaaaagcgctacaagactggagtggttatgcttggctctggtgtcagagtgcttggattctagctaaaatccacccagggagtgtcgcttaaccttattttctctccgtttcctcaactgtaaagcaagaaaaataatagtgtttcccaaagcctggcacatataccactgggagtataccagatgatattagatggtacatgagtggttttcttcttctgttaacaattatgtgtttaattcccagcatattaaaatatatataattagcacatcaaatgctatggtttgaatgtgtcacccaaagtccatgtgttggaaacttaattcccagtgcaacagaggtgggtccttcaaggggcaattaggtcacgagggctctggcctcatgaatgaattaattatgttatcagagaagtgggttagttatcaccagaatggattcctgataaaacgaatgagttaggcctttttccctcactcatgtgtgcatgtcttttatccttctgccattggatgactcatcaagtaggcctttgccaaatgcagacccttgatcttagatgtcccagcctctaggaccatgagacaaatacatttctattcattataagttacccagtctcacatattctattatagcagcacaaaagggactaaaacaccacactaaaattattgcgtaggacaaatctaagtcaaggaaaagaagtgcgctccaaacagtcctagtcagtcagggaaagttctttacagaaaaagtctagttgacaaatggaaaataattaacagaattagaaatcatgatttttgcaattacttaatgacataattgatttaagtaacaatcatcaattgaagaaacaatcacatgaaaaattaatatggaactttaaaatggaatagtcagtctgttacctgccaaaaccaatgatgaatctcagcttcaataaaacaggttctgaatagtggatgcttcctaataaacgtagtaaagacaccctctgcaaagcattcttgccaaaaacatttacgttaaatcaaatttagagacagcatcccttaagaaaaaataagagtggtgaaggaacacattaaagaagagcatatgaaaccagaatgtgtgacttcctacagaacaaaagatcctgcttctataacaagtctacagtgggaatggaggcaggatttctctaggttaagagacttaaggaacatatgtaatataatgtttgaatttgtttgaatatgaaaataaggaaaaacagtaaatgacattttcaagtcagttggggaagtttcaatgtggagctggattagacaataccaaataattactgtttatattgcttgatataataatggcattgtgcttaagtacaaaaatgcccatatttgttacagctgcattctgaaatacatcagagtaaagtgaagtgatgtctgcaatttgctttaaaatacttcagaagagaaaaagaaaggaggggagggaaaaagacaatatgaagaaaatgtagtaaaaatcttgatgattattgaatctaggtatacaacctgcttgataatttgcaggacccagagcaaaataaaaatgcagggtctcttataactgcttaagaatttcaaaacagtgacagaagaaccaaataaccacattaaaccaaatgtgggccttcataagccatgggctctgaacaactctcaggctgcatgcacatgaagcctgctctatgtgttagataatatggaaattaattgcactattcactctacttggtgcatatttggaaaacttccataataatttaaaggggatcacttaaaaatatatatatataaagtaaagattatatgaggaaatagcaaaaatcaggaaggctacaattggccgcaatttccaagatactgatgtaatcatgaaagacactcaatgtggtgcctgacacacagcaaatgctcaggttagctcctactactgttgctaccaccagcactaccattttgacaaagactacccttgtatctagtaagaaacatgaacgttttatagagattactacaacaacattttacagaaaggttactttagacatcgtgaaatccttactgggagatctacttatatacagaaagtcttacaattcttaccaatatttctgattgtattttgctcccttgtgccctatattctttaaaacttgcgagggatttccatcaatgacagactggataaagaaaatgtggcacatatacaccatagaatactacacagccataaaaaaggatgacttcatgtcctttgcagggacatggatgaagctggaaaccatcattctcagcaaactaacacaagaacagaaaaccaaacaccacatgttctctctcataagtgggagttgaacaatgagaacacatggacacagggaggggaacatcacataccggggcctatttgaggggtaggagtctgcgggggttagcattaggagaaatacctaatgcagatgacgggttgatgggtgtagcacccaccatggcacatgtatacctatgtaacaaacctgcacattctgcacacatatcctggaacttaaagtataaaaaaacaaacaaacaaaaaaacttgtaagggatatcaactgtgggccacaacagcacttagaacagaatattattactaacttgaagattcttctgaaagccagactcctctttgtaattcaagtgacatcacttacagtagcaaagaaagagcatcagaatgaaataagtccttgtgggtctcaatcatggtgaataatactgtggtttttcttgaatgagaaagggcatttgcaaacctcaaaggggtttaacgaaaccttactctcccctttaaatgtccaaattaagcttctttggaataaaaccttctcaaaagaaagcaaatgtaaaagttagattattgtatatgacctaaaacatttgctgaatcacaataaacacataccagcatctactatagcctgttacctaaatcaagtttcacagacccagagaattcctccgccttattttgttttttaaacattggattgaaagtactattgaggatcagcatgatcagtgcaaaccttattttgcacaaagagcaatttaggaaaaatggataaggtgataggccaccaatttatttgtctatccagaatgataatggttttattaaatcccttaaagaaagatgaatttttataagctagactatctaatttgttaaatagcacatcaatctgaatattgtcactgttttttaaaatactctaatgttaatattttggcatgtttgaattgaggcaacacagagttttctaatcgttaatctttaacttgatgaagggatctacacagaatgaagcagactacacacggcccaagggtagtggagatgtgtgtggtatctgttgcttctattaaacatttgcacatgaagcatgggtatatgctagcagaagaacactttcagacatcccatccctattcagttatccttcaaatcatatggcaacaacacaataagagccacttataccttattcccccgatggaaactctttgcctcttcagagagcccataaccagctgagggcccaggcctgactggtaacccctcagggagggagcatgtccataaatcagcaatatagcagagatggggcttcttatccttggcagccattttccctgcctccccttcctcccctaggacatcccctctctgccctggtatgcatcttggacactggatgtctcaactcagtttagaacttactaaaacaaggtttaataacctcatattaaaattttcaagactggctgggcacggtggctcacacctgtaatcccagcactttaggaggctgaggcaggcagatcacgaggtcaagagatcgaccccatcctggccaacatgcggaaaccctgcctctactaaaaatacaaaaattagctaggtgtggtggcacgcctctagtcccagctactcaggaggctgaggcaggacaatcacttgaacctgggaggcagaagttgcggtgagctgagatcacgccactgcactgcagcctggtgacagagcctggctccatctaaaaaaaaaaaaaaatttacaagactaccgagaatccgcacctcctaagaaatggagatcaagtctgtgcgagtcatcattcctcttgggtctcttgatttatctatcaattagcaacactatttgaccttctacctatgtgtgatcatggatattaatcagcccttctttttactgatataattcctactttttcagaaatctgacaaactcacaattgctgatatctaccctttcctccttacgaagatagaaatgcccatctataatttatagacaggtatgattccacaatttaaaaaataaagcaaaaaaaaaaaaaatccgctcaactcaaggcttatacatcactgattccctcaatgcccttacttggaaagcagtaattcttttgagctaataaaatgcatgttatgaaccagaacaataccttaaagatataacaaaagtaattatgataataatgaaaaaagtgagaatttcaaaatctttgtgtagttcttgaaagtatagtgcagtataatgtgagaactgaaggctgtttaccaaaaattcatatatctctccttctaaatatttattatttttgaacagacccgcttgtgtggccaggtgactttagccagtggcatatgtgccaattctgttaagtattttaagaaatggttttaccttctttctctttctctcccttccaccgtctggatgtagatagcactacggacctagggaaaggcagaaacacaagatgggagacatatgaaatatcccaggaagaaaactcttttgcagaagcactgataccagactcttacgtaaatgaaaaaaaacttccatttagtttaagccattattacattttggagtctataatgctaaagcagctagtatcaccctggttaattaatgaagtaaattaaatggttaaaagcatataacctacctgggacatcttgtagggcagtaagatggaagttaaaggacaacaggattgaaacttaaagtgttcaaagatgaaatcataagcagtatggaacctcggaggtaagttggggtataaaagaaacaaaactggccatgagctgattatttttaaaacagaatatgggtatatgagaattgatcacatattctctctagttctgtatatatttgacattttacacaataaaaatttaaacaggcagggtgcagtggctcacacctgtgatcccagcattttgggaagctgaggtgggcggatcactcgaggtcagccgttcgagaccagcctggccaacatggtgaaaccctgtctctactaaaaatacaaaaaattagctaggtgtggtcgtgggtacctgtaatgccagctacttgggaggctgaggcaggagaattgcttgaactcaggaggcagaggttgcagtgagccaagatggtgccactgcactccagcctgggtgacaaagtgagcatctgactcaaaaaaaaaaaaaattaaacacttttttttaaaaagtaaggatacctggagttcccactggcctaggaagggaatatctgagcatcaaaaaggttaagaacagaaacaaattaaaacatacaaaattttttttagaacaacagggagaggttccaagatggccgaataggaacaactcctgtctacagctcccagcttgagtgacgcagaagacaggtgatttctgcatttccaactgaggtaccgggttcatctcactggggcttgttggacagtgggtgcaccccatggagtgtgagccaaagcagggcaggcattgcctcacccaggcagtgcaaggggtcagggaattccgtttcctagccaagggaagctgtgacaaatggtacctggaaaatcataacaaccccaccctaatacagcacttttccaactgtcttagcaaatggcacaccaggagattatatcccgcgcctagctcggagggtcccacgcctagctcggagggtcccacgcccacggagccttgctctctgttagcacagcagtctgagatcgaactgcaaagcagcagtgaggctgggggaggggcatccatcattgctgaggcttgagtaggaaaacaaagaggcccagaaactcaaactgggtggagcccaccgcagctcaaggaggcctgcctgcctgcctctgtagtctccacctctgggggcagggcacagctgaacaaaaggcagcagaaacttctgcagacttaaacgtccctgtctgacagctttgaagagagcagtggttctcccaccatggagtttgacatctgagaatggacagactgcctcttcaagtgggtccctgagacccaagtagcctaactgggagatacctcccagtaggggccgactgacacctcacacagccaagtacccctctgagacaaagctttcagaggaaggatcaggcagcaacatttgccattctgcaatatttgctgttctgcagcctccacaggtgatacccaggcaaacagggtctggagtggacctccagcaaactccaaaagacctgcagctgaggatcctaactgttggaaggaaaactaacaaacagaaaggacatccacaccaaaaccccatctggacgtcaccatcatcaaagaccaaaggtacataaaaccacaaagatggggagaaaccagagtagaaaagctgaaaattctaaaaatcagagcgcctcttctcctcgaaaggaacgcagctgctcgccagcaagggaacaaagctggatggagaatgaatttgacgagttgagagaaggcttcagacgattgttagtaacaaacttctccaagctaaaggaggatgttcgaacccatcacaaagaagctaaaaaccttgaaaaaagattacatgaatggctaactagaataaccagtgtagagaagtccttaaatgacctggtggagctgaaaaccatggctcaagaactacatgacacatgcacaagtttcggtagccaattcgatcaagtggaagaaagggtatcactgattgaagaccaaatgaatgaaatgaagtgagaagagaagtttagagaaaaaagagtaaaaagagatgaacaaagcctccaagtaatacgggactatgtgaaaagaccaaatctacatctgattggtgtacctgaaagtgatgaggagaatggaaccaagttggaaaacactctgcaggatattatccaggagaacttccccaatctagcaatgcaggccaaaattcaaattcaggaaatacagagacgccacaaagatactcctcgagaagagcaaatccaagacacataattgtcagattcaccaaagttgaaatgaaggaaaaaatattaagggcagccagagagaaaggtccggttacccacaaagggaagcacatcagactaacagcggatctctcagcagaaactctagaagccagaagagagtggaggccaatatccagcattcttaaagaaaagaattttcaacccagaatttcataactagccaaactaatcttcacaagtgaaggagaaataaaatcctttacagacaagccaatactgagagatttagccaccaccaggcctgccttacaagagctcctgaaggaagcactaaacatggaaaggaacaaccagtaccagccactgcaaaaacatgccacactataaagaccatcaatactaggaagaaactgcatcaactaagaagccaaataaccagctaacatcaaaatgacaggattaaatacacacataacaatattaaccttaaatgtaaatgggctaaatgctccaattaaaagacacagactggcaaattgggtaaagagtcaagactcatcagtgtgctctattcaggagacccatctaacatgcagagacacacacaggctcaaaataaagggatggaggaagatctaccaagcaaaaggaaaacaaacaaacaaaaaaggcagggcttgcaatcctagtctctgataaaacagactttaaaccaacaaagatcaaagagacaaagaaggccgttacataatggtaaagggatcaattcaacaagaagagctaactatcctaaatatatatgcacccaatataggagcacccagattcataaagcaagaccttagagacttaaaaagagacttagactcccacacaataataatgggaggctttaataccccactgtcaacattagacagatcaacaaggcagaaagttaacaaggatatccaggaatagaactcagctctgaaccaagtggacctaatagacatctacagaactctccaccccaaatcaacaaaatatactttcttctcagcaccacatcgtacttattccaaaactgaccacatagttggaagtaaagcactcctcagcaaatgtaaaagaacagaaattataacaaactgtctctcagaccacagtgcaagcaaactagaaatcataatcaagaaactcactcaaaaccactcaactacatggaaactgaacaacctgctcctaaatgactactgggcacataacgaaatgaaggcagaaataaagatgttctttgaaaccaacgagaacaaagacgcaacatactagaatctctgggacacattcaaagtagtgtgtagagggaaatttatagcactaaatgcccacaagagaaaacaggaaaaacctaaagttgacaccctaacattacaattaaaagaactagagaagcaagggcaaagaaattcaaaagccaacagaaggcaagaaatgactaagatcagagcagaactgaaggagatagagacgcaaaaaacccttcaaaaaatcaatgaatccaggagatggtttttagaaaagatcaacaaaattgatagactgctagcaagactggtaaagaagaaaagagagaagaatcaaatagacacaataaaaaatgataaaagggatatcaccaccgatcccacagaaatacaaactaccatcagagagtactataaacacctctatgcaaataaactagaaactctagaagaaatggataaattcctagacacatacaccctcccaagactaaaccaaaaagaagttgaatctctgaatagaccaataacaggctctgaaattgaggcaataattcatagcctagcaaccaaaaaaagtccaggacccagatggattcacagccgaattctaccagaggtacaaagaggacctggtaccgttgcttctgaaactattccaatcaatagagaaagagggaatcatccctaactcattttatgaggccagcatcatcctgatagcaaagcctggcagagacacaacacaaaaaagagacttttagaccaatacccctgatgaacttcgatgcaaaaatccttcataaaatactggcaaactgaatccagcagcacatcaaaaagcttatccaccacgatcaagttggcttcatccctgggatgcaaggatggttcaacatatgcaaatcaaaaaacgtaatccatcatataaacagaaccaaagacaaaaaccacatgattatctgactagacgcagaaaaagccttcgaaaaaatttgacaggccttcatgctaaaaactctcaataaactaggtattgatgggatgtatctcaaaataataagagctatttatgacaaacccacagccaatatcataccgaatgggcaaaagctagaagcattccctttgaaacctggcacaagacagggatgccctctttcaccaatcctgttggaagttctggccagggcaatcagacaatagaaagaaataaagggtattcaattaggaaaagagtaagtccaattgttgctgttggcagatgacatgattgtatatttagaaaaccccatcgtctcagcccaaaatctccttaagctgataggcaacttcagcaaagtctcaggatacaaaatcaatgtgcaaaaatcacaagcattcctatacagcaataacagacaaacagagagccaaatcatgagtgaactcccattctcaattgcttcaaagagaataaaatgcctaggaatgcaacttacaaaagatgtgaagaacctcttcaaggagaactacaaaccactgctcaacgaaataaaagaggacacaaccaaatggaagaacattctatgctcatggataggaagaatcaatatcatgaaaatggttatactgcccaaggtaatttatagattcaatgccatccccatcaagctaccaatgactttcttcataggattggaaaaaactactttaaagttcatatggaaccaaaaaagagcccacattgctaagtcaatcctaagccaaaagaacaaagctggagccatcacgctacctgacttcaaactataccacaaggctacccaaacagcatgatactggtaccaaaacagagatatagaccaatggaacagaacagagccctcagaaataataccacacatctacaaccatctgatctttgacaaacatgaaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactcaagagcttctgcacagcaaaagaaaccaccatcagagtgaacaggcaacctacagaatgggagaaaatttttgcaatctacccatctgacaaagggcaaatatccagaaatcttccaagaacttaaacaaatttacaagaaaaaaatcaaacaaccccatcaaaaagtgggtgaaggatatgaacagacagttctcaaaagaagacatttatgcagccaacagacacatgaaaaaatgctcatcatcactggccatcagagaaatgcaaatcaaaaccacaatgagataccatctcacatcagttagaatgacaatcattaaaaagtcaggaaacaacaggtgctggagaggatgtggagaaataggaacacttttacactgctggtgggactgtaaactagtgcaaccattgtggaagacagtgtggcaattcctcaaggatctagaactagaaataccatttgacccagccatcctattactgggtatatacccaaaggattataaatcatgctgctacaaagacacatgcatacgtatgtttattgcggcacgattcacaatagcaaagacctggaagcaacccaaatgtccaacaatagactggattaagaaaatgtggcacatatacaccatggaatactatgcagccataaaaaatgatgagttcatgtcctttgtagggacatggatgaagctggaaacaatcattttcagcaaactatcacaaggacagaaaaccaaaaaccgcatgttctcactcataggtaggaattgaacaatgtgatcacttggacacaaggcaggggacatcacacaccagggcctgttgtggggttgggggagtggggagggataccattaggagatatacctaatgctaaatgatgagttaatgggtgcagcacatcaacatggtacatgtatacatatgtaacaaacctgcacattgggcacatgtaccgtagaacttaaagcataattaaaatatatgtatatatatttttaaaatccataacttcataatgacacatgcatgaaaactcattagacgttaatgaatgaatgcctaataacttctagttggtaaccaatgttaccaaatagaagttattaggcattcattcattaattaaaaattaaaatatgataaacaattaatttcctgcctatgtgaactgtatatcagagtaaccaaatggttgataagaaaaagtttttttatagatctccatgaataaatgcaggagaaatgacacaactagaaaactgctattttgcatcccctaatgatataagacctatatccagatataggaaactactatgagtggacataaaaccatcagtgtaagcatgatagggaacttggtaacagaacagtctgacaatacctgaatgaactaactcatgttatcttcactaaaaggacatatatcattatttccttcatgctgtgatgaaataggacatacatagcaccatctatgaagtattcttgcctaaaaaatctctataaaatctagccaagactccagactaaataccaggttatagtggtgattgggttcaggacatgctttcctaaaatatgacaccttggtatttaagaaaacagcagaagcgggaaggtcactctcaccttctgccgttctctcctgaagcaggtcatgaaccaatggaaggatttttttgagcgtcccctggagcaggtcataagaccattttagaggtgccctccttatacatggaggaaaggaacatccttacctctgaagacacagggacacagagaagaagctgaacaaacaggccttgctaagttccctcccccagtttattaccattagatcacactcccaatcatatgtccaatcatacttcacctcttcccactcttcatcaaacctagcataaaaagtacacggtttaaccatttctttgggccttcatttccttatgaaggctcccatgtcacatgaaacttatattaaataaatcggtttgcttttctcttgtaaatctatcttttgttatagcggcttccatcataaaactaggatgggaataaaaggtatttcttttcccatacagagaaataaattaaacactgccacaaaaaagcgaacagccatcttcaaaatatagagcaaatgatccagtttctctcacaaatcaaagttattgagaggaaggggataagaggactaattaaaaaaaaggagacaagcaacataacaattcaatgcaatgtgtgaatctcttttagattctgacttgaacaaaaccatcaacaaaagaacaattagggaaatgcaaatatggactggatattagaaaatattaaggaattattattaatttcattaaatgtgatgatggcatggaatttaaataaaggaggtaaggcccttatcagttagagatatctactgaagaattttcaggtgacaagatatgatatccagcatatgctttaatgcgctcaagcaaaagaaaagaaagaacgaaaaaataaaatggggacagaggaagtaagattggcaagatattgataattattaaagctggatgatgcacgcatgggtgttcattatgctattagttctacatttgtgtatatttgaaattttccaagatacagttttttaaggcacaagataggagtcagacattggttggaccagccctttcacttccagctgggagaaactgggcagatcactacagcctgcacattgccctcctttgtgtcatcaagtgcacagatatttcttctaagaatgctccaatactattccttggattttcttccgagccatagacacctattttgtgagttttgatgcttccctttcaatactcatacacgtgcagacaaacaacagttgtcccaactgctacctatctgaagtgattataagtgactatcaattatgacatatatcccaatttcaaagattaaaatgtgaaaaaaatgtgcgttaaaaaaatctatgaagaaagagacctggagatgaagttataataaaaatgtctatgacaatgagattttctgaatacctacaaggcatctcctgctttggctccataagtaccactatctctgtttgtttgtttgtttgtttgtttgtttgtttgtttttgagacagggtctcaatccctcgtccagactggagtgcagtggcaggcactccccaggctcagatgatccttccacctcagcctcccaaatagctgggactacaggcatgcgccaccacacctggctaatttttgtatttttggtacagacgaggcttcaccatgttgcccaggctgatctcgaactctagcctcaagccatctgctcacctcagcctcccaaagttctgggattacaggcctgagacaccacccctggcttcttgggttattttgactgacatatctcactggctaaaatacttccatttttctagaagctacggcaactaccactgggttggcaaatgacaggccctggaaatgtttctgatagatgtttgttgcatgaataataaatatgcaaattttaagccaaaaaagaaatataacacatgcaaagagatgtggggagtctcgtgcccttctgtataaagttctggaagctaattttggaaactctatcaagaagttgtgtgtgactatttttccaaagtagagtcaaaattcatgaggcagggcaaaagttacactgcatctaatgatgagtaagaatgcacatctgttccctggagctgctctctatacacatattctagtaatttccacacaccatcagaagatagaagatggagaaaaccagtaaagatataatctttgagaaaagacttttgttggagcctaaacataaacttttccttcaagtccatgtcctgagagaggtttgtaaatgtgtgacctaaatgaggctaccactgaattttgtttcccaatatccctcagagaggctataaggcatatacaaattctacttaaaagcaaatcatggtaaacatttattaaattttattacgcaccaagtaccacactcgtgttcttcccaggactgccaaagttggctgaaccctgatgcagtaactctgcagatgtacctataacatctcaactaatcctagcagcaaccctgcaaagaacagtaccaccttacttatattttcaggatagagagtatgacctttagaaagacttgctaactggcccaagttcgacagccggtaaatagcatatccaggactcacacccacggctatgaaaaatcggtgcttgcggcttgtgtttttcacctaaatacacaagtgttacatgaatgaactgtgatggaggatcagcattgttcctgccaaccacacccacctgcagtctagcgcagatcaatacttttacaaagtgcaatgaaaatgaatcactggggaataaaggcattcaaagtaaaagtcaaaagttgttattggagtcaacagacaaatttatgctgttattgcccacgagtttctaaatccttactctcaatttatatgcttattttgttgcatactggcaccaggacaaggaccaccctttgagtagtgctgcactacactttattgttagatccatgcttagaatgaacacatttataataaggttccaagatccctccacctattgagaggctggtaattcttttagatgttaattaatctatttttttttaaatgaagatgacttttagcattttcttctttcctataaagattcatcaagatatcagacataggttccaaagtcaacaaaaataaagaacttgtgaaattttctgctgctgtatgatacaactgctgtggtattttgataaatattaacagaaaatgtgaaactttgaaatatgtttccttaccaagggaacaatgaataataatgaaaccagggaatgaggactagaagcaccaggtgcccccgcctcccatccactgcagggaaggactctcttccaaatccaccctgaaaagtgagtggctgttgggaaactaaaaaatgtacttaagagatctcaaatatatggtgacacatggaattcttcaacctgccatgcctcttgagaagttctcaggtaaataacaagaatgatgcccacaatacattcacatacataaaaaaaatgtcctggaaagaaaaagaggatgggagaagaagttaatgattcttggggctttttaaaaaaattgtgttcggctgggtgtggtggctcacacctgtaatcccaacactttgggaggccgaggcaggtggatcacctgaggtcaggaatttgagaccagcctgaccaccatggagaaaccccatctctaccaaaaatacaaaattagccgggtgtggtggcgcatggctgtaatcccagctactcaagaggctgaggcaggagaatcacttgaacccaggaggcagaggttgcagtgagcctagatcgtgccattgcattccagcaacctgggcaacaagagcaaaactccgtctcaagaaaaaaaaaattgtgtttaaagtttcaagttaattttttttaagtcaccatagctcatatggccttggtatgagttgatgggtcaaacccatagcttctctggctactcaggaaattagtaaaggagggcaaggaaaggcacaatatggaagagagaaattactagacaagaatcagcaatctggagcgaacccaatctaaaggaaacaattagaaactggcacaggtcccaaatcaataagcagaggtgactgtgggcagtgagcataatggctgggtaatgaaaactaaaatgcaggtaagcaagcgctgggaaaggagcagctgatgacagggtcatctgtccagaggcttgaagagacctgtctgaacaggctctcacagcccagctagtccctgatgtcacagcctgtgtgaataaacagcactggtgtggtatccccaaacttcataagaaatgaagtcttcatggctcaccttgtcaaggccagagaacaatcccaacaggaaaaacacttcttacagattatgcagtggattcaaagagcactggaactgtatttcccattagctctaatggaggttgtgctaataaattccccagctctgggctgaacaggtgtaattcagtaatgtagctataattgagtgatgtcaactcaatataatttgtaatgtttttgtaacaaattatctctttttttttccagaaaaaaaggcatctgtgattccatatgataaattactttaaaagggtgacatacagtgctaatgataaagatctttaattgatagaaatgttaatagtagcatcagctaagaattatctttgctgattctttatacacagtaacattttaaacataacaagctttcgtttttgaccaaccaatgtttttgatttgtgactcatggttttcagatatttctgtatttcatcaatataactattctactagagaggttctgtataaaccctgcaatttagccattcccttccctgcacagttcccaagccagatctagacatttctacctctgtgcctaagagaacactggtctcctggtctggatggacagctgtctcctcctcttccatgtacctaagaatgacctgttggcccagtcaaaaccctccttctatgaagctttccagacctatagccaggattactctttcacaccctatacccctgggacactttggggtccctctattacattcttacttttcagacccccttgtacatgctattcctctgctgctctccctggttagggcccactcatccttggggtttcagttcaacgttatacctcaaggagaaccttccctgctttggaacagggcacattacacgtgcatttgcatacctctgcattcctttcctttgttgcactaaccacagttgttgttagtatcttttgtttgtttgtttgtttgtttttcaggaaaaaaaggcatctgtgatgcgtctcttttccactagggctaggctttagacaaggtctgtgttgagttttcctaaatctagtagcaaggacatgatgctccatatctgaagaaagaatgcatggatgaatgaatgaacaaacactatctctgtctgtctctccctacctctatctgtcctctccactaaacttgaactcaaaggtaatacagtgctcattgtagccacaataatgcctaattagggtctcgtccataatagagatgagaaaaactcagttgaaataaatttaatttctcctactgtagtgttaacatcaggttagtcatagagaattcagttcccaaagcttatagtgtttttcaccatatgctatccactgaccctcatcaagctccaaccacgtgctagcccctctgcaagatactgtggaagagaagtgaatgatatttagaaccaagtactctacagtttctgggtgattcccatgtataaccacatttctgcattcatgccagatactgggggaattcaaggttaatcaaacacagatggtgtcctcaaggagctcaggatctgggagaagagataaaagtgaagaaaaaatatcatgaggtggaatccatgagtgacataaaaggagtcccaatacagattctaggtgttctaatgagggacagagagaatgtaggcttaagtgggggtattttttttaagttttatttttaatttttgtggatacatagtgtatatatttatgggttgcatgagatattttgatataggcatgcaatgtgtaataatcacatcagggtacggtctccatcatctcaagcatttatcctttgtgttacaaataattaaactcttttagttattatcctaaaatgcacagataaattgtttttcactctagtcaccctgttgtgttagaaaatactaagtcttatttattctttcttactattttttgtatccattaatctttcagtggggacagtttttaaaatgagtctttacctgttgggtgggatggctcacgcctgtaatcccagctctcagggaggcagaggcgggaggatagcttgagcccaggagtttcagacctgcctgggcaatatagcaagacaccatgctccacaaaaagggaaaaaaatgagtctttacccaggtgaagattgggattagggacccagccaaaaggaagcgaggttgaagagcaagagtgtttattccttggttcaatagatctttgtcacctactgtgtgaggcataaataaacctaagtccattctcaatgcagcttacattctaattgtggagacaggtgaaagcaaacaaacaacaatgccaggttataatgagtgctctgaaaaaacagggcagagtaagaagcgaagctgatgagagtgctaccccagacaaggtggtcaggggaggccttcccatgtcaatgacactgaacaatgacttgaatgaagcgaaagagtgagccatgtaacacgccttgggaagtgcattcccaacagagaacagcaatcctctccacagaggaaggacagatgacccacacctttttcaaactggggtctctgagcatgttcttagggatctgaatgttcttgatgagactttttatttttggttttatttagataatactcacttaaaatagttcaagtgtattctgcatcagctacatagcacctaaaatacgggtaccagcacaaaagttttgtgactcctttatgtttgcatttataattgtggtggtatcaggtattgctgttttagctgtcacaagcaaaagataaaaaaaacaaacttactacttaaataatgtgtttgtgcctcatgatctcagagtaggggtggagtacatatgaattgtcccagtaatagcagctggaagtgttagggaaattgagtcatcacacagcctaggctaacacaaacatgacaagctgtgtagaacctttgacataacagacatcccgtattgatgtttccagagatgattctgtttaaacaaataatatcattcatcttgttaatgcaatattcctcatttgaatttagttttgtcattttgattgcatgtaatttgtaaacgtgttatggtttcatatttgtctaagaaccacacaaagaaattcatacctacttttgtattttcatgtggttcaataatccaataacaaaaacattaagttaacattgggggttcataagacttttttttcccttggaatggcatccatatgttactcaaggttggtcacagtgaaagctggtggtggaaaaggcctttgttttccagaaccatgaccaggtgatagctctggatggtttccaatgaaacacacagtaagtacaggaaagaagggagatgaatatctttggtaggaaaaaaaaaatcacaaatcagatatacctaatgactgtaacttttattattctctgaacaccaaggaacgtaaaggccataaattatgttacatgttggttaattctccttcagaacacccaggccattggaacattaaatgtggaaagtatgtggcgggggagagagggtgaagaagctataatgaaaggttcactgcactcgggtggcagattaaacacagagccagatgaggagtcaagcgtcactaaaaatgcaaaacaaatccagctaaattatttcacctgcaaggaaaagtttttctcacaacacaacactgttctatgccaacaaatgtaaacaagagctaagacgactatctgaaaagctcaggcagttggtgaggaaggctccttgggtcacagaaccctccaaaacttctcactgtagcagctgagagctggcatctgaaatcaaactgggtagagttcaagaatcacctctaacagagattagctctgagacctagcaagttctttaatatcacagaaaaaaaaaagacaaaacaacacctacattacaaagttgttgaaaggattcactgagataatcctcatagaccacttagaacactgcctggcacgtaataagttctccataaacgtgagccatgagttttatgatgctataggtctatgattatataagcatgagtctccacatatggcacaacaaactgctctactcaactctacagccctggatgatgtctccacattttacatattccatgatagtttccaataatttatatacatgtaaagtatatttgagatggtcggtaagataacatcattctcattcattcccctccccaatatagttcctaaggaggaaagatatgaatagtgctatggtttggatttgtgtccacgcctaaatctcatgtcaaattgtaatcttcagtgttggaggaggggcctggtgggatgtgactgaatcatggaggcagacttcctccttgctgttctcgcaataatgagtgagatctggttgtttaaaagtgtgcagcacttccccctttagtctctttctcctgctcccaccatgtaagaggtgcctccttcctcttcaccttctacctgaggcctctccagccatgcttcctctacagcctgtggaatgtgagtcaattaaacctcttttctttataaatttctcagtttcaggtagttctttatagcaatgcaagaacggactaatgcagatgggtctacagaaagagcataacccaacaaccttacatggtaggtaccattattgtccctattttacaaataaacaatgtccagagaagaggatggacttgctcaaggtcatacagctcataaatgatgcagccaggatttgaggtcaagtagtcccagtctagaatctaccttcttaatcaccacaagactctactcctccaaacaagtgtccttcctctgtgtccagtaaagaggaactctgggaactgctggtcacataattgtttattcctccaggttccccaatgtctggccctagaaaatgaggatgtttcactcccaactaagcatttccctaagctactatttgttatgctgttagctaagatagaaagtcaattttaaaatcgtccatttgaacagttatagtaactttcgtaaatggtaaatgaaacaatttgaaaacactgtccaacattttacacagtatcccatcgaccacagctaactaaagtaattcacatgtgaattttattctcaaaaaaagtgtatgctttgcttttgacagataatgaaagccatttaattcaatgtggctttttttctttgctttttcctttttttttttttttttttttttgccagaaagcagtgagataaattgaatacccataaactgaagaaaatctgttaatttggggtgtctggttacacctattcttgtgcttttttaaaagagagtctgccaaagtttattctcttcttaaattacctcatctgagcagtattttcatttgtaaataatggccacatattctctttaaagtaggaggaaatggagaccttaagtgtttcaaggaaacttcaggtccctcaaacctccttcaaagaaaacaactgatgattgtctttgaggcaaggagacactagtcatcaggccatcaagggcagggaacaacctgaacactttgcagctctgcactacaggtcctcaacgtcgttcttgcattagcccattcttgcattgctataaagttcattcaatgccatctggttataacaccgacagaaaataaattgattcccagtggggcccctgtctatgtagggtctgaacattctccccatgcttgcatgagttttctctgggcagtcaagttttctcccacatcccaaagatgagcatggtaggtgaaccggcatgtctacatggtccccatcttagtgagtatgagtgtgtgtgtgtaggtgtgtaggtgagtgggtcctgcaatgggatgatgtcctgtccagggtgagttcccaccttgcaccctgagctgctgggacatgctgcagccatccgagaccctcaactggaatataaataattatcttacctgtttttattactctttcttaaatgtgtatatagttcgcatagatttcaatgtaaaatattcaaagtgttttggtctatttagaagtttgatggtatagttgtgaccagaaatatgccataggaacttaactcttatttatatcaattagtctatggtgaaattggttatatgttgctttgctttatgtcccagtttccaggaacctatcaatgacattaagtaaggacttactgtactttactatagctgaacaggctgccacccaaaaccataatgagctactatgacgacagtcaatcaggagacatatctgtgtttcagagaagaaagccagcagctttctgggaaaaagcacagagggaaactcccctaagctggagctatttcctagcagtaacttgctgctgcagtttagccctgtcatctgtgtgtactcctcattaagtaccacattatgggccatcatatcttctccagctgcaagtaaaggcaatgtcctggaattgccctatggcccaaatgtgtgactaatgactgagactttggcttcttgcttgatgtttggccttcagtattacatgaacctgctctgaaagacacaacactgtcacagatgtatgcggacagattaagctccagatggaaggctgtcaatgtcaatcagtcactgttcttacagcctggctggcttttcatctaagcaaccacagagcatgatcctgcagcactcagttccttagctcaattaagtcttaggattggaggtcaagttaccctggtttcctaagcattctctaccaaatgattgtttttgcctcactcctactgattcatttatagtagcttcttttgatgcattcatccttgagcatgtcttcccatttccaagtgacttgtttcactattctgcagaatgttccagccctttgatgaactatatataattgtcgaatcagctgtcccacaaagagataaaatctgaattaaatacaggacttgttgtcaggagagaacagataaggtgaagaattagaagactagctgggaagaagtgagatgattgaagtttatgaaacattttcccccctcctttgagtctcccaatctgctagtttcagtcggttggttttgtgttcctgttgtgatatatgtttagttcaaggctgtggactttgtgccttggttacaggtaagtgcctctgtgtttctcatctttatctatccagtcacttgtctcctctcaaagtttcactttttaaatatatatatgttatttaatatcaaaagaatatcttcacctttcataaattgctaaccctagactctggatgcctagggtaaatttttaattctattttatttattttaattaaatttaaattaaaatttgttttaattaaatttaaattaaatatctaattctacttttatttatttatttaattctatttttaagtctatggacttgcttgaacacacagctcagcaatgatgcaggcaggattcaagtccaggcaaatcatggctctagagcttgtgttcttaacttccacatgacattgtccctcgggaggaatattgtaactccctacgtttccattccaaactctcaaatataaaatgataattacaaggtacacgttattgcaaaacatgtataaaagcatataaatcaaagattacattttgcctcctcttctttttcccatccctctaccctcatatccacacaatttcattccctgagggagcctatattaataatttggcatgtacatttttgcatacagacatatatttttctaagtttctataatacatactgttctgtcacatgtttgacatcttttcatgtcaattcatagagatgcttgttaatggctgcagagtaatttcaatgtatagacatataatactatatataatactatattgaacctctttagctacttggtcaaatatatctacagaatacgttactagacatttcaaggaatttctatgtcaaaatatttcaaatagttaatagttccaaacttcccaatccaagtataatatttttatttatatccacaacagggtatccccctgattttgcccatagtgcttattatcctaaccaactgattgatatttttagtttaattatttaaaaaatgaggttataatgaggtccctaagagtcccttaacctaatttactaggatctactttatctggagagtaaaataaagcaactacccaatctcaaaatatccttttgcccctcccaaatgactcttctggaatcatttatatgctgacctccatataatttattggatttatacgatcttatatctctagattgagttacaaatggatgaatctcttgaaacctagaccaaaaaataagaatagaataaaaaaagagtttttggtatggaaactgtgactctccaacgtcagtagagacattgagaatggtttcccatgtccccaggcataaactaaaatatccactgcttttggacagtataaatgcagaatatgcccccagatgaatagaaatgagcaaatcttgagtgcagaactgaatttcttggagctgtattggttacctggagccatgaattaagtggatctgattctatctcttaaaggaacagaaaaaaaattattccaggtgattactgctcctcaagcatgtggtcactcaaaggaccttcttctagctccacgggatacatagttgctattcatcagctctgctcactgaagatgctgtgctacgcattccaaatggcgccttggaggactaactgatatcattaacacagactcgtagagatgtcatcattttcttcttcatcatcttcgtcaagattagttttaagtgttgggagtccgaggtgggtggatcacgaggtcaggagatcgagaccatcctggctaatatggtgaaacctggtctctactaaaaatacaaaaaattagccgggtgtggtgggtgcctgtagtcccagctactcgggaggctgaggcaggagaatggtgtaaacccgggaggcagagcttgcaatgagctgagaccgcgccactgcactccagcctgagcgacagagcgagactctgtctcaaaaaaaaaaaagattagttttaagtgaaccatgtactagttctcaaatcaaccacatcgggtaggttccattattatttaattctgcagatgtgaatacaaggccacaagttcgtaagtgatactgccggggctcaaaccacttatgtattatgtcaaaagccatgctcttaaccattgcactatactcccttctacaggcataaaattttaaaaatatataccagaagagcaaaacaatcccaagtatgggaaggatgaaagagaagggtggcagttggcacagtggagcataatgggccagtctgactgtaagactcctgtttcataatgtctgcatgtcactaaaaaggatctagaccaaggttcacaaacacaaatgaatatgggggccaggacgttaacatacatgagtaaagaggaccaagtgcatgacagaaagagtggtgaagaacgtggtaaactgaaacacatgcctcaagggaagaaggcaatactctcatgtgtgtatgtggttcaaatgttgccaaatctatgaatttttttaacagaagaaaaaaaatccaattttaatgcaaaatgtttctatttccaaattatgatttcaatgtcatgtttaaaaacactttgacgatgacttagttccctctgacctccacacataagcattaacatggacagaagtatagcagcagtgtgaggtgcttttccagcagccatcagtccttcatccttgctaacataccttgatctttctcaggtacctgcaggtggtagtgtgtccagggaagataggccttactctcagcataagaggctgaaacgtactggtctcagccagtgaaggtaactgaatacttcattgacattgactggtctgggatgggatgcatgtgtgactcagttctagccaaagagaaatcgaaagatatctgctaagagactttaaggaaagattttctttcctgaaatggaaagagagagagaggcccaccacgagatggccctttttgctcccttccctcctatcctgtgttgaatgctaatccaggacactgtggtgttgaaagctctggcagccattttgtggcatgaggtaacaagtctaaggattaaggccaatacaccgccaatggtggaatgaaagcatgaaaggagcttggatccttgtttagcagccaaatcaacactgagactacttaatttgaggtttcttatataggaaacagtaaatctccttgtgatttatggtactattagttgggtgttctgttacttcatactgaatacattctaatgaaggatctcactttcaaccttacttcagagttctagctttttgtttacagcatccttcatgcaggaaaacttcaagtttacacagagtgtgcaactagatgtgagataaggctctgccacttgagaacgcccacacgctgcttcaaaaatttaaattatgctgttagcttttcaagatggatgaaatccttcataggatcatatagcaaggactaaattgctctcacagttgccaggcaactgtgtatatgctgcctagagacaaaaattcatgacccttgactccccaaaggagagtctttacccacaactgatatgcatgtgcccaagtctaacacttccatccagcaaaggtcatggtgtacatctgggctatccaacatcccaagctcattatactgccaacttatatcattcttgatcacaccataaattatgatttctgcatgcaaatccaaatgacagagcagagagtgtcctggggcataattccctgtcctttggcctgtcttattatatagactgattgggtaccatccaggcaaacaaaaaaaagacacatgaagattcctattagcctgaagaatcactgtcaggtaaacagagttttgtaaacagcttccaatattcaaggaaagtttgagttttcacagtgagtaatgtgatcaactttaataatgtctcaaggggcttctatctcacgagtcattttcaacacacacacacacacacacacacacatacacacacaggctaagatgtgctcatcattctattagaaaggaaatctcaaaatgcaaatatagatggtgtgttcacatttacatttcataatgatctaagtgttttgtttttgcatgtgaatttcataatactttaaatcatagaatcatggaatataaaaatcaaaagtgaccctgagatcaagaaggtccaatccaagagaaattaaatggcacagctgcttaggggtgaacactgaatccaagttgctggactctcagtctactgcgcttccccaaaactaacatgcttgtccctcaggcagtcaacccttaatcattgtgatgataaacatcagggacaacttaatttcaacttgacaataaatcaaactctccatgtagccattagttgctgtactagtcagaaaaaggttaagttgaatgtgaaccactctttcactacctcccacctcaaaaaaaaaaaaaaatgaacggaagcttgaatatacaagcttttattctctcatttaacaagtttggagatcagtagtctagtgctgacatggcagttctacagacccattacagacctagatgccttcaacttactgtatctccattcctagagggtgactgtcttagtctgctttgtgccgctataacaggacctgagactaggtaatttataaacaacagagatttattagcttacaattctggagtctgggaagcccaagatcaagggcccacatcttgtgaaagacttcttgctgtgttacacatgtaataaggcaccacatgatgagaaacagcacgcaaaggagcaagaagtgactaaactcacttggataacaaacccactcttgcaatagtgaacccattaacataataatgacattaatttattcacgggggtagatcccccatgccctaatcacctcttaaacaacccacttctcaacactgttgcattgaggaattaagtttccaaaacataaactctgggggacacattcaaaacacagcattcatcttcttaacatagccaaaaaggccgggcatggtggctcacacctataacctcagcactttgggaggccaaggtgggtggatcatctgaggtcaggagtttgaaaccagtctgaccaacatagtgaaaccccatctctactaaaaatacaaaaaattagccttgcgtagtgacatacacctgtagtcccagctactcaggaagctgaggcaggagaattgcttgaacctaggaggcaaaggttgcagtgagcagagattgtgccatttgactccagcctgggcaagaagagcaaagctctgtctcaaaaaaacaaaaacaaacaaacaagaaaacagcaaaaagtattaatgagccgttatgtctgcaccccagttggcagcaaggaggaagctgtaatgcatcttctctttaagaattctcctagttagtgtacccctgaaagcaaagcctaagacaaggaccaagggcataggtttgggtagattatttggatggtgatctcagaaaatttgaaagaaagagatgagacagtaaacactggaaggaaaaaggaaacagcatgtgttatcaacacctggggtgctatgtgaggagctgtgtggaatgtacccacaactgtccatctgatagaaggctgtggcaacccaccaattggttaagcattgcctgtagtgctgttacttccccggctatgcttgtgcgtgggctgggaagccttcttttggttttgagtaaggcctaaaccagaatagtagatgtacagcacagcagaacttgaggaccctggcagcacatgacagcatctgccacagctgcaatgaaattaggtggggatagggaatgtggcactgtgcacctgctacaagaaaatgtccagaaagttgctcataaagtttcttattatctctatgcatcaggagtccccaagacaatccttagactcaatgattcactaaaagactcccagaacccagaaaaactatgtactcatggtgatggtttgttacagagaaaggacacagattaaaatcagcaaagtaaaaaggtatataggaaagaatccaggagaaaacaggcacaagtttacagtgtcctctaccagtaaaatcacacagctggttcttaattgtcccagcaactatgtatgacaacatgtataaagtattgccaacccaagaagctcacctgagccttggtgtccatgatttttattgggggtcagccacatagacatggacttcccacacgaatgaccttaattacccagtctccagtccccccagaggtcaaattgatacaacatagcccagggcttcaggtgaacagaaacagcattcaccaacaatcacattgtcagtataaactatctggcaagacccacagtttcaggtattcaaaggcacttttctcagttagggtgcttcaaaagctccaaggttatctctttggagatggtcaagggccagtcttttatttggtatctgcagaatttgaacaccccaagccttgagttaaccctttactgaacaacctgtttggtcagaacttagtcaaatggccataaccacctgcaacaaaagtaagaaatgcagtctttgttctgggcagctatattcctactcaatatttgggaattctattattgtataatggtggttctcaaacttcagcacatcagaatcacctggagaattcattaaaatagactgcacaaccccctcctcagagtttctgattaagtaagtgtagggtgaggcctgagaatttgcatttcagtaatttaccaggtgtattactatccgaataaagccagaacaaatttacacaaactttgggcttaaaacaacacaaattcattatcttactattctgtgggtcagaagtctgacacaactcgcaccaagctcaaatcaaggtgtaagcagactcctttctgcagtctctaaggaagaatgtttccttgctcattccggttgttggcagaatgcagttctgaagtcctgtttccttattgcctgtcagctgaagatcattctgaatttctaaaggccttccacatttgttaggaggttgacccctccttccatcatcaagtcagcaatgaggggttgggttcttttcatgctttgaatctcacctgcctcctctatcgccatatctttctgattgcagcctgaaaaggttctctgatttttagagctcatttgactagactgggcccacccaggtattcaggagaatccccccatctcatggtctgtaatcttagtcacatatgcaaagtctgttttgccaggtaagatagtatattcacaggttctggagattagggtgtagatatctttggggggagggcgcatgattctacctaccacaccagtcagttcactctgattctgtggttagggaacacactttgagaaccaccaatatagaaaataagagaaccagaagactcttccacaatgtagccttattttacattgttggaaagtcaatgaaagcttttaacaaactggttgactgcagctttacctcttcagtgggcccctttcctactcaaaaagtaatgagaaaaaggcagcaagggggaccagagaatagagaaacaaaaactgaaatcactccctgactagattaatcagctcttgcatactctggccatttatcagatatattcagtgaaattcttggttgagagaaagagggagaaaacacaagccaatcctgaatcaaaattaatagagaattctactagaattcaacaggtttttcttttttattttttaatggcaagatccctgaaggcctttaaaatacgaatgtctgctttaaatctccaagaaggagggcagagttcttgaaaatgatagccatggtttttttcgtggcacatataatggaattgggctgcctggaaaaatgcttgagtaaaggttgctccacaaggggaaaggtggtaactcaatgcaccttcactttctaggttggtgcttctcaatttggctgcatattgaaatcatcttaggagctttaaaaagcgctgatgtctaggtcacacaccccagtgattctgaagcaattgctctggggcatgtcttgggcattgtgcttttcccccaacatctcgcagatgattctaacgtgtagccatgattaaggactgttatggtaggtgataaccctgttttcctgagtctattagcatatgtagttactaaccagagtcagtaaactaggtattgttctctgtattttaattcctgcccaaccaaattaaggaagtaatttcaaaaattaaaagagaagagataatctagagtggcaggcagtactaaccaactccacattcaagaatagcatcctttcttaaccagcattgcgtgattttaaactcttcgtatccccagaatttagcacagtgccccacacatagtatatgttcaggaagaactgtggtaaatgataaagaattatgaacaaagtcctcttcaaaatgaagattgcaggagaatcaagcttcagtcagatctaagtgcacactactctagtgagataagccaatcagataagcaggatggggaaccaccattttggttttgttgttgttgtcattgttgtttttgagacagagtctcacctaggctggaatgcagtggtgcgatctcggctcactgcaatctccgcctgcaggttcagctgattctcctgcttcagccttctgagtagcacgcctggctggctaatttgtgtatatttttagtagagacggggtttcaccatgttggccaggctggtctcaaactcctgacctcaaatgatccactcaactcggcttcccaaagtgctgagattacaggcatgagccgtcgttcctgaccaggaaccaccattttgattggcatggtaccaggtacacagaatttagccaataaactatttgatgtgtgaaagaatgaataaattttggcattaaaaggcaggcttcggtatgtcagagcaagaggtaattggatgaggaccagaggatggagcccagagcaggaaatgaagctcagagaagaggtagatgttcaacgtactgtgtctcctcctccagttttgagtaggtcactgaaaacacttggcatggcagtgaaaatcactcaaaagacccccgtggaaatggacagacttgtgtggaaatttgcagatcttggctgcttctaattcatttgtctttctaacctattagaatccaattcagtctctttggctctacccaggataatgcaaaactgaattgtacacataagcttcctgccttctgctccttctcttcataaccaatatgttgctaaacaacaatttctaattgccccttcccaggacaccttttgagagcatctctctttgtaccccctgaaatacataatactaattttctttgacatgctatatattttgaggatccatgcatccctaacaagtgcccagtcttacgatggtgcagcccctcatccagtgttctatcatttaattcatgatgctgtttatcttggctgcaagagagtgaattattggcatattcagacagtctcataccacctctcgtcctctccattatcataaaagttaaaattatttatttatgaaccaaataacttgtctgaatattttaacaatgcacgagcacttatggaggtttttatttcaatttgggtagagatacaaagtcaaatatgatttcagtacaagttgtgatggtttttctcaatatcttatatggggttccatttttgccttgtacaattaatacaagaagcataatgaactcagcaatccccttgagaaataacaaataggtataagcaataatttatctgtggaatgcagggccttgatacataacttccatatctactccaaaagaaaaagaaaagaaaaaaaattcctagctaagagccatgaagaaagagtccaaacactctcacacattgttgttggaaaggtagactatacaacatacttggattgcaatctggcaatatgctttgaatgttcacaattttaaaacatatatttcctgacccattatttcaaagactgtatcctgatcctgatgaaataataaaagatgtgcctaaagatatatcatgtgtggatgctcatttacagtgttacttcccataaagagaaatagggagaaacaaataagaaacctttctaatatattttgttatctataaaatggattgctatgcagtcattaaaaataatgttcctaaaaattagtttataggaaaatgtataaaaatgtacatgacataaagttaagtggaacagcaagatataaaacagtctatgcagcctatttccaatatgtttataataagtatttccatatatatttctacgttggcatattattctacacagaaaatgatcagtacatatttttgagtgtataagcagggtgtgtgtgtttacaaagacaaagatgaaataccccaaaatattaatagtggttatggctagatagtgaagttatgggggatatttattctttgccttatgttatcctacattttctaaatagtctcaatgcaaatgttgtttttataacttattactgatttgtgagctaaacagacccattgacattttccctggaatattctagtgacacaatcactctcctgttagatagtcccacccctcatgccccctcatttggtctcttccaagatccaggactttagagccagaaacatttggattcaaatcccagctctttactttctagctctatgaccatgggtaaggtcattctctctgggtgttctggacctttgggatagagttgttgggagagttaaatgaggagtgttgcattcctatccgatagttatttctccctccccttcctttctaataggatctgactttgtgattttattcaggtattgactgcccacaacctatacccagggacaagaggctggggcctactcagacctaaggcttgaagcttaactagactaggacaagcatggtaacttcattccccttgcaagggatcacttcagggtatggtttgaaattctggccaatcaccaagtgggacaattgttggaggccagggtcgttctgaaaaagttttcttcacatttaagaaaacaaaggacacccagaaggatgagtattcattgccgtttctggccttcagacactgaggatttctggatgcactatagccaaacttggaccattagaggacaagcctgcaaagaaaagtaacacctgaaagaggggagaaataaaagacagaaaaaaaccttgatacttgataatgttgttgctgaattctggcatggccctattttttttatttatatttaaaatttttgtttaaatcagttgaactaggatttctattacttttatctgaaaggatcgtaagtgatacaaaaagcaaaagtgccaagctcatgacagagagcagagttcaacaaataaaaaataaaaaaaagtcttttctttctctcaccttccaaatacatatttagtatacacagtatatacttgtttatggcttgtaaatgtagttaatagagaaagtaacaagaaagaaaggggtaaatgcaccttttcctcctcttaaaacatgcacaacaggacccaatttctctaatttttttataaaggcccccaaaaactatggacaaagacaaagttttccaaggaaagacatgtgctgtaatggattatatcttgctaaaaattcgaggccttctaaaaaaaacaaaatcttgaacaacaaagacctcttccaatccctcctccctgtaggtcttgaacaactagccagaggccctgcttttgtaagaggttccctagatagatcaggatggatggagtgtatgctgttagatcaaaagaaatcatttgctacttgtatgcatggactaccttaactgtgagtcttaatcaagtaatggagactgacaggcttcttggcctataggggccctatagtaataaagtgtgcacttttctaaaaatggtattcataagagtcaagtgactggacaattactttgtttgattccacatcccaggctgaacaacctcctcttcccatattcttctgcgtctgatcctgatggagaagaataagccagcctgagctatgcttagatattttaaattttagtgaaaaataaaatatatgttttaaagcctggaatattatttgtgatttgggtctaaggtctaaaaaatatggacaagtgggaattcaaaaatcaccctaccagcactgcaaagaattcgtgagtattcaagctttaggagttgggtttgtgcattttccttttataactattgctagccatcccagaatgttgcactcagtaagaagggctaacagtgtcctgctggccctattcctatgtgtcatcttgcggcatttccagttaatggcatgactgtaatgactagcaatttaaataatagaggctgaagcagaggcagctataaggacacaatgcagaaattgccacagtttatcaacatcactggcacccagctcttcattacctccttgaatagggtcaaagtagttaaaatgatgctgtaaatacatgactaaaacaaagcagcggtttattcttgatttggcattgggtatttataacaaacaagttgcatttcccaggcatgggttattagacacgagaatgtaattgatattaaccaactttcaggctccagtaactttttccactgcatgtcagtttaattttttttaaagcataagcagcacatgccaaatggaaaacaagaggaagaacacaaaaaaccccttaagccttcagtactaagtgaaaaacaactaacccatttatcttatagaatccttcagagttttgctataaactcactcggaagagaatatcacagtcttctctttttgagagggtattcgagtgatttttagaaatgagacatctctaactgtaatcttgttttttgttcagaactaaaagagtatgcaagaatatctaaaaatacaaattgtgcacctactgcattacggcagaggttgaacactggtgacccatgagccaaatctgacccattgctctgtttcatttggaccatacagtaatggttgactttgtgttttaacattttaaaattattttcaacatttgtaaatcgagagatttcacagaaaatgctggaagctctgaccctaccggcaccacactcctacaagataacaaatggctggggctgagttgaggctgctcttatcctttgcctcaattgtatcactcctacagtctccttgtctctgaggcctaatgtcaattacctctcttcttcttaatagtattgttatttttcctaagtaatgatcaaagacaaatattcattttggtgagccttgatcataaatggggaaaataaagatgggttaagaggactgagtgttttagaaaatgaaaaggctgtaattccttatagaagtaaataatttcttacttaaccccctttaccccataacagaatcctcccagctggcatccaagagcattgagtgtgtgaacctttgtgaaaagcatcaagttaaacgttctgtgtaaaggataccagacacatggaaaagccaagctaggttcagtctcagacaaaagctgtcaagctgagaaagggaaaagaaagcactgcacttgtaagaaaaacaacaaatggcaagcacggaattgacggctagaaagaacaaagcaggtttcaatgttctaccaaaaaatgtcttagcccctggctaaactccttttgggaaaaataggcacaacaggaagatgccttcacttcccaaagtcatccagacattctcagtgggagcttctgcatcaaccttgtgtcgcatctggagctgcagaccctcactgcccattggtttaacaatctctctcctcctgcaagaagagggtggtggcaggggggagtactataagggatgtttgttttattaaaaagaataaacatacatgcacatacacacctacccagaaaatactatttcatggcatctacacttatagggaattcactcagaaacagctttttagtaacacaaagaattaaaatcattagcacccaacaagtcagaaatgatggaagattaggaagaccattgcatagaaacaaaattaaaaaaagataaaaccctttatagaaccagaaaaggtgaggagaacacaaacaatccttttcactgagattgagaacccagaaaaaccttttgatataactagggaaagttaagtagagtcaggaaaggaataagtgtgtattaatttcccactgtgtagaaagcactccatatacattttaatacattttgataataaataataaataatactttatatttttgttcatttatccattaaataagtattcgttcactgccttctatgtgtcagacatctctagggatataaacatttaaagacatggttttcctattaccaagttttgagtctaacaaggaactagacaaacactctaatgaaaataataatgattataaatacaaacagcaataatacaatagcttaataacagctgtcctttactgagtgcttccaatgtggtaagaattgtgttgagcactttacattattattcgtttaatccctcataagtgccctatgaccaagttactaatatcttcattttacagagaagggaagtaagctatagactaaatgattacctaaggttataaaggtagcagatgaaagatctgagatttaaacactacctgttctctgcacaccaggccaacagataatctgcgatatcaacccctaccagctacgatggaggcatgccaaaaacaagcgatgcagaggggagacccttaaacccttttgaatttgcaaagcacttccccatagagaaaataagcctccagaattcatcagccccaagaggtggtactggtagaaaatataatagtctttcataatagcttaggtcagggtgtgaaagacagagctataagggctggtaaaagaacgaaagctttccaatccagagacaaaaggaaaagtgagatccatccatgacatgtctcttgaggactcttttaggaccaagatggtgaatgctgaacggaccatgcatgcctcagtctgtcaaattgtatgtttctaaggacaaataggctacaaaactttcaccctatttttatatgggaagtctgttgaaaagaatacaatacataaaagatgaattacttattgagtctttaatatgtctctagcacagaaataaacatcttgtgtatattgtttctaatttccacaataccatgagctagaaatatacagaatagaagaacagtgggatcagagaggttaagtgatttatccaagaccacacaggtgttaagaggtagaggaatggtttgaacttgcaacaatgtgactccaaaatcaatacattttccttacactgaaatacaaagtatcaggccaaatctctctgcaaatattcatcctgtttcttttggttcttcattcatttaattaaaaacaagtttattatgcacatacaaggaacatagtattcatccttgtgcatctgacaagtaagtcaaggagacaggtgtgtaaatacctaaccaaacttacaggcaggatgaatgaggctaaatgtgtttattatttaaataaactccatgaagtcagatacttcagtttgttgatcattgccacatacctgaaacacaatcttgaaccaacaaacatttgtttgatggaaggataaatgaagaaaatcccacttaaggaagtacaaacttaaggtagaattaattctgcctaagataaatcaacgaaagcccccaagtgcagtgtcattgaattggacttggaagaatgtatgaagtatatactagtgagaaatgaagtgacaggagctatggctcagggtaaacacaggaatggaagcatagaagcccacaaaatatttgggtaatagagttcaagcatacttagagcacaggaaaggcgagaaattagagtgagaactaaagtcaaaaaggtaatttggcaccactttgcacaaagccttcaagtcaattattaaaaaaaacaaacaaacaaacaaacaaaaaaaaacagccatgccagtagaatgcagtaatctgacagcttttagcaaagtgggaatgtatcacccctacttcctccccactgatcttagaagaatcctaagtgtttacacctagtttgtaagatcccaagaaactctccagtggtctaattcccaccactcagctaagaactctcagctcaaaagatactggcatctggaaagcctttttcaaagtccctaagtctgagttccttacatcccacacttcacccatctcatagtgtgtttttcttatctctctccaccatcactggcttccatgtgagcaggcactatctttgttgattcctagcatgttgcaaacagcccggcacatagcaactactcaataaatatcctggaaataattattacattagtgaattgaatgattgatgcactgactgactgttgaagaaatagagtcaaggagagccataggaggctgccacaatagcccacggaaaacacctctttataaaggtccagatgtatttctttaagtaggcactttgctaactggggagagcggtggttagttaaagcagacagcaaagcagaaaaaggcagggccagcgggcagttgctggggagaccacaattccatgggactatagccattagcatgcaacactgggtaatctgattttcatgacagacagatttattatgacttctaaatatataaatcccaggttatgctttccagctaacctaacaacttgatatatgtgtctgacatcccgtcttaaaatcagattccagcttctaattaatttttattcacccatcgctctaacaagagaggcaggaagtctcagggggataaacaatagacagggtattagtcgttcctactctgtggcacattttccactgagtctctggagttttctttttctttgctaccaaaaaaggggggccttacccattctctctgtggcttctaggaagaacgagtggaaaacattacacaggcacccgatagtcattatttctattaagcaaccaatgcttcatccatcacttccacctccccattccctgctttcatctacccatgcagaaattggaatgacatcatggtctagtcagtttaaagactgatcattgcttatgtattactatacatcttgctttctccaataatattatcagcaaatagttcttgaagctgaattgcaagtgccacaatgacctgactttaaaccaataatagtgatcataaaggctaaaagtaccacctaccgctttttatataatctgaacaatattaataattcactcacattcagatactttattaacaatgaaaagtgatacagctgtacccaggaaaagttttgtaatccactgatttctttaatgagcattctatgaatctgtgttttttaaatataattttcatatatgaatacaatttaaagaacattttcttctatgtcctttttccaaaacatgaaagtcaatatgggtaccacagaccaggttagaaaaaaaaagatggtcacattcaactttttaagttttttaatatttagttctcactatgtgctagagattgttctcaaaatgttaaatgcattaaatcctcctcaaaactctatcaggtatcataatttatccttgtgacatgtttaaaaagttgtttgcagtcacaaaagctagcaagttgtacaactgagatttcaattgaggctgatggctgaggctttaccaccttggtcttaatatactgcctggagatttaattactaaataactaatagtataagtagccagttgtgtttgccaaacccataaagccaaactacacaatcatcttcactttgaggacactatagtgtttctggctttttgcaagcagatttaaaaaatttggataccagtctgtttacctgccataatatggaatataaactaggaggagaaacacattcagcaaagaactttgtttgatggacttcacgaatcaaaaaaaatgtcatttttctgttcataataaataaatagtaaaaataggataataccaaaaaatatgcaaaatcttctcctccctatttattacaagtatatactttctaaatctctagtgtctatgtaatttatttgatggtatgaaagatgtatttcacatgtacatgcacaggcacacatgcgtgtgcacacacacacatacacatgcaacctatgtataccagaattactctgtgctcaatttatcttcagttaagcactgaaaacaaaatagaaccaaaaaaatggattcataaagtgacaaaaagaagttcattcacttgcccttcaggtacataccatactcatatgaacaaacttatatattctccctacaaaatcacacttaaatatgtgatttaaagtattttttgctaagtatttttatttctttccccaaaattatttgtgaaaatggaacatgtcctatatatcaataaatgtcatttaaaataaataaatttttaaattaaaattatcatcaaactcttaaagtatttcattttttaaaaataaatttacactggaatagaagtcaaacaaacatttaaaagcacacagaaagcattcatattacaactaatctaaatggctgatttggtaagttttagagccttttaataaaaccatatttttactcaagtactatttagttagagctttatcaaaatacttaattacaaaataagatctaagatgttcaggtaaaactatgcacaatataatcaaatccttagcatgaagccattcaagttgtcatttagagatctgttttctgagcctactccagttttaaaatagtttcctcagtaacatcaaatctgcccttcctcccctttgccctcagaattattagagcataatgtaattcttttaccagccttaggaaaacactattggaatgcatgagccaaaatgcagagatgaaacggaactgaaaaaaaaagttttttaaaaatggaaaatcaattactatttttaataagtagaaatagcttttgtgctaagaaaagaaaaattgcccagagacaaaatagatgttcgatattatagtgcactaatgagtacatttacatgtaattttctgaaatttatgtccaagactaactgcaaatagaatttagtatcaataggagtttacaaaacccattcatttttcctctaatcatattgaatatttaaggtgcttgattagactcaattatttttctttcggtgccaaaaaagagccctgacagctttgaaagagatggattagtggggcatttcccaccaatggggaaacattcctggctcccacagcaggaaaaaaaaaaacaatgagaaagttcatgccaattcacatgcatgccactgaatgaaatctgcagagaactcagagaaggtcagcttgtcaaaggatcacggcaaaaagcggaagaggcagatacccaaacttagtaggactttgtggcctcccagctcacaagcctgcttcttcatttcaaggcggcctggagagaagcatctgacaaagatctatctcccactgcccagaaaagattaaaagaatatgggccctagcaaatctcctagtacttggaattgagaaatagaaagggaaatgtagctaatttgcagtagccctgcttccttgttcagatttcccgaagcataataaaatagagaggctgtgtctccagggttccacttccagctgtgccccacaacttggaaaaaacaagaagggacatgttacctactcacaccaacctgcctctcctgctgcccctcctgctgccattctttcaattcattctaagggaggttgtcagccctctctgaaatgctttaaaaagaagctatattcctaactggtcaaggagatttaggtgaattcctggctgaaagcagaatgaggaaaaaactgttccctcaaagtgcccaatctttgatgcattatgttctactgtctgctaaaaccatcatcgtagccttttaattaaattttcaaattctggtttgatggtccatgttaaactcaatttggtcaattcagggcaccatccacccagatattcctccctctgagacttctggtagaatccttccttgcctcttcctaatttccagtctctgcctctgtcatcatgtgacgttctcccctcatctgtctgtatcactgtgtcttttctcctcttctatgaggacaccattcacattgcattaaggttccatcttaactccagtatgacctcatcttaactaattacatctgtaatgacagtatttccaaataaggtcacattctgaggcaatgagagttcaaacttcaaatatctttttgggggcacacaagtaaacctattctgtgcagggcacacaattcgacctactaacactcccatattaaatcaatcaccaagtcgtgagcagacacctaatacctctcaaatctgtcaacttctttctatacccaccactaccctgaatcccatacaattgtctcacctgggtaattgtaacagcttcctttaggaagctcccctcatttttgcattgctccaatagattctccaaaaaaaaaaagtgcttattgaaatgtaactgatatagagaaaagtgcataaatcagaatgaatttttacagggcacacatacccacttaaacactacccaaatcaagaaatataatattatcatcatcctagaagcacatttcatatcccttcccaattaatttcctcctgctccagcccaaaggaaaccattatcctgacctctaacaacattgattagttttacatggtttgggattttatatgaatggtaacattcagcacatgcttttgtatctgtcttctgctgttagaatgatccttgctgttgcaactagaagtaattgattcattttctttactttataaatatttcattatgtgaatatacccttttacttattcattctaatgttgatgaccattcagattgagttccatttggaaaagctattaaaaataatggagctacgaacattctcacatttttagcgtatatctagtagaagtgaaaggtcacagggcctacaattgtttttcactaaatattgccagttttctaaagtaattatattaattttcaatcccacaccactgtatgatagttccagttgcttcatacccttgccaacacttagtattatcaatcttctttcattttagtcattcagatgagtgtccaatggtagctcattgtctctaataactaattatgataagagctttgtaatatgctgtgtagccatgtgactatcctcttttgtaaagggcttgttcaaattcattgcccttttttccaatgggctatttttctcccatccaagtactaatcaggcccatccctacttagctcccaagatcagacaagattggatgcattcagggtggtatggccgtagactacctctttttcttactgatgtgtagatgatatttatatgatctgaatactagtcctttgccagagatattgtaattatcatctcccattctgtggcttgccttttctctcagctagtgatgtctttagttcataaactttccattttgatgtactctaatatatttatcttttcattttttgctattgttttaaaaatagttttattgagatataactcacataccatccaattcaccaatcaagtgtatgtgactcaaagttttttagtatatccacagagttgtgtaacaatcactacaatccaattttagaacattctaatcaccccagaaagaaacgttggcccggcgcgttggctcacgcctataatcccagcactttgggaggccgaggcgggcggatcacgaggtcaggagatcgagaccatcctggctaccacggtgaaaccccgtctctactaaaaatacaaaaaattagccgggcgaagtggcgggcgcctgtagtcccagctactcgggaggctgaggcaggagaatggcgtgaacctgggaggaggagcttgcagtgagccgagatcgcgccactgcactccagcctgggcgacagcgagactccgtctcaaaaacaaaaagaaaaagaaaccttatacctactagctgccactccctattcctcccaacaccttcaccctcactaaactctaaccaaccactcatccactctctgtctttattgatttgccttttctgggtatttcttatcaatggaattatatgatatgtgttttttttattttgtttttgtgactggcttctttcactttgcatgatgttttcaaggttcatccatgttgcagcatatatgagtacttctctacttgtttgtctaataatattccattgtacggatataccacatttatttatccattcatcagttgatggtcatttgggttgtttccactttggggctattagatgaaatgatgcttggatagtgttttttcatgtcctgtttaagaaatatttggctatcccaaaatcatgaagacattctatgatgttatattctagatgctttattgatttagctctcacactcagatcagcaatccaactggaatttatttctgtttatgatgtgaggttcatttttccctgccctgatacccaaatgattcagcactatttaatgaaaagatcgccctttcttcattgctccacagtgtcatctttctcaaaattcaagtgtccctacatgagtggctctatttctgtacactccattctgttccattaatctattgctatttgcttatccttgtgcaataccacattatagtaattattgtagatttataatgaatttatgaagagctgatagatagtatatgtcctccaactttgttctgattccccttcagaattatcttgcctattctttgccttttgcataatggtgttttgattagaattgcatgaaatttagagatcaatttggagagaatagacctcttgaccctattgagtcaccaattcatggatatattgtgtcctttcatatattaggtcatctttaatttctttcagtaatattctgtacctttctctgtagaggtctaatacatcttttgttagatatattcctatgtttttaatatttcaagctattttaagtggtaactttttaaatacatttattgaggtaaaatttacatagcatgaaattcatctatttagatgtacagtttgatgagttttgaatacatttatatagttatacaaccatcacctctacatagttttagaacacttctatcaatccaaactgttacctcatgccctttgcagttaatccccactccccacaccaggcagcaactgatttgctttccatctctgtagttttgccctttctaaaaattgaatcatacactatagattcttttgtgtctggattctttcacttcacataatacttttgaagcatatccaggttatttcaggtatgggctgttcattcctttacaatgttgagtagtattcccttgtataaatatactaattattgcttacccatttaccaattgatagatacctagattgcttctataatagcttgggaccattacaaacaacattgctataaatgtagacatacatttcatttctccacaagttttcatttcaagaccttgaagtggaattgctaagtcttatggtaagtacatgtttaaccttttcaaaaagtgccaaattgttttccaaagtagctgtaccattcacattcctaatagctttatttaaaggttacagtttctccatatcttcaccagcacttcttattgccttttttactttagccatcctagtgggtataaattggtatttcaatgtggtatataataatatttcatactattcctctcctttaaatttgcattttcctggtgatgataagcatttttcatgtgattatttgccattaatgtatatgctttggtttgttttcttattaccgacataagaattctttatatattcttgatattaaatgctttatcagatatgatttgcaaatatctcatcccattctgtggtttgtctttttattttcttaatagtgtccttaaataactcacgttttaaaatgttatgaagttcaatttatcagtgtttttttcttttaggaaatcttgattttggtgttatatctaagaaatatttgactaatataaagtcataaaacctttcctgtatgttttcatctagaagttttatagttttaaagcttatattttggtctgtaatccattccaagttaactttgtatacagtacaggctaatttttggataaagacatgcaattgttccacctcaccttctttggaaaaacaatttgttcatagtttataaccctttttatatgttgctggattcattttaaatggtatctttttaaaatttcattttgtaattctttgttctggtacgtagaaatacaattgatgttttatactgactttgtatctagcatccttgctaaattcatttgttaaatttacataattatatgttctgcaaataaaagaattttattgtttcctttcaaatgctcatatcttttttttctgtctctctacattcaccaggacttccagtacaatgctgaacagcagtggtgagaacagtcacccttttctcagacctaatcttagggcaaggctctcaatgtttcacttaagtatgatatttgctgtagtttttaaaaaatatatagagagtctttattaaggatgtttacttatagtcctagtttgttaaaagttcttatcaggattagatgttgaattttatcatatggcttttctccttttctgttattacatcatttgatttttgaacattaccttaccactcatatctataataaatacaactttgtcatgacatatattgtttttctatattgttcagtctgctattgctttgtttaggatttttgcattcttgagacctccaaaatctcttccccatctctttagctgctgctttctattggacttttaagcttttcaggtctttgtcatttacaaatcaacaaatgcttcaaaaagaaaaagaatgagaatgttgaagtcacttcaatgcacctcctccctccagggttctgacccctcaagtcctggatgccttggtagcccttcaataccttcaaacaaatatcttctctttattttggctggcttttctagttattctcttggtggattattagctaccctatcattaccagaagcagaaattcatcctataactaaataaagtcatcatataaactaaatcatattattcttcctccttgaatttgctaatgtgctgataaaaactccatattctgtactatgtcctataagattctagtgatacagacatagcctttccctccatcatctcctaccactcactcccttgttcactcctctcccaccatatgtatctactttctgttcttctaatcccattgggttaattcccaaatcagtgcttttgcatttgttcttccctctccctggaacaccctgtccctgatcttcacatgcctgcctcacttttgtcaatccatctcagtttcaatgtcacctcttcaaagaggccttctcaagacaatttatctaatcttgtgtctctcctgcctgattccccacaaacaatattctatacatgaaagaaatgataatgaaattaagccaacagaaatagagtttgaactttccaaaagccacaatgttatctctatcccacttccacatccaacataaagagaacaacaaactaagaatatgtaacacctttggggaccacttttgtatattattatacagatcttaagagtatataatctttctctggagtgtgacaaacctaaatcaccgctacatcactttccagatgtataacttccagcaaggttctcagcctcaacttcctaaactataaaatggggataatggtagaatccattcgataatattgttgtaattataaaataaatgttattttgtatgcaaagtgcttaatacagtgctgagtcataaaaagtgttccataaacaagagctattgtgatgactgacaatgatgctcatgatgataatgatgacaaaaacaataaggctctggagcatctggtaaaatgctaagtaattcaatcaaacacacacagatgtacacacacacatacgcacaaaattacatgttgtaattcatttccaccaagtagatacagcctttatcacttgcattggtagatttggtagagacttcatttctttgatttctgtactaggtaagtttggtggcaagaaatataggccagccctagcaagtctattcaaaaataagaaaaatgaaaagaatactacagtatctcacaaaattgaaaggagaatgaaaacccaagctttgtgaagaaggaaatcaaggtagcttcagagaactgagaggccggatcttagagacctccctctagagcactgctatttgaatgactaaaataccattaataactactttttgctttcaattcaaaattcaaaattcttagaagagagaatctgattggcataatcagatacctagccctagatcactcatctctgccctcaagttaaaaagtcaaacattatggtctcagctgctgggagcccacctctgtggatcaggggacactgcccagaaaagagttttgttttagaactggaaggtcatcccaagaaatattactataatagaagggactctgtctaagatgggctctctctaaaagaagtcattttgttctactatttgcccatccagaatagcagtgaccaagttatgcaccattagctgcttgggagggagctaattacaaattaaatataattgaatcagtgagtctgctttcaagtcctctaaatagaataacaacatgctaccttgtacagccaatttagcaaatcgaagctgaatcccttgctttctatgaagataaagagcctttgtgaaatttttaaagtatagatgtaaacttcaaaaaattttgcaaggcaagtcatcaaaatctgggagaaaatatattggaaactgtgctccaacaggagccaatgaaggaaccttatgagggagtataaaatattaatattcaccaatgccaagaaaattttcatattatgcaggtatccaaaatgggactactatctttgatttcacaattcctttctacttctctaacacgaatttttagtgacccaaaatgctgggaagaactacaaaatacagtgaatgcattctacttgaacattatcttatgctgttgtacctaccaaaaagacaccatgaaaactgcaagtatggctgcgctggaaaaaaccgaaataagtagtcatctgtgaagtactgcaagtgtgggaaatggttgagagtcatggacattggggaatatcaacaaaagaggaagaaaaagaagattaggatggaggtagaaatgattcccatggaattactgacatcagtatatattcccttagcctattattacatcagtgtctcctactgggaatatttactgaaccagtggtactcagactttttttgagcagggaaaaaaatttattcaacatttggaaaactggcatagggcatccaaagtggggtgagaaggctcttgtgtcagactaccaggtccattcccagctcaatatatacatactgtggtaagatatccgtaacgtaaaatttactattttaaccatttttaagtgtacagttttgtggcattaagtacattcacaatgttgtggaacaactacctgtatctaggtctaaaacatttcatcacctccaagggaaatcctatacccattaagcatacattccccgattccttcttcctccagtgcctggcagctactcatctgctttcaatctctatggatttgcccattcaggcatttcatataaatggaatcttctaataggtgaccttttttgtaatggcttattgtacttagcatgtttttaatgctcatccatgttgtagcatgtatacttcagtaaaaaaaaattgaatacaattgtaaatatttgtttgaaacacataaaagaaatagttaaagggattgagcctatttacagaagacttgaactctggggcaaggagagatgaaaagggggactaggatagcagttgtcatttcaaagactcattgtgtgtaaagagactaagttttattctattcagccccaaattatccccccataaccaaagagtagaaactataagaagagagatttcaatttgacataagaaaaatctttcaacagtgttatccaaagacagaatagactgtttttataaataatgagttccacttatctgtaggtattcaagtataaatggaatattcccttcgcagaaatctttagagaagcaagcatcagataagattgatctgaatcagtggttcctaaaagccaatcaacaagcgcatgccaatacatgatgaagttttcattcactcgtggtgaaatgccaaaatcaaagaggtttttataaagctaaatatatatttaattattttaattccaagattatgcctttcatccttttagtatcaaaatagccccccaaaatagtgaatgatagttttcttcattcatgcccttttttggggcaaaacttcaaggtgacaaagtaaagtcagccctttgttttaggggggaaattgtaccagtctcaaagtgtgagaatcatttgaataggtgattcttaagacattttcaaaattccaagaacccatgtttatgaccaaggattgttatgaaagttgcttttgttgttcattttatccatatttcaactgtgtatgcaaggagtggagcacctcccaagaggattttccccaaggcttctgcctttgtagggatggtctgaaatgatatagaatttgaacggatttctagtctcacagggatttatattacatgaaaaaagagagagctttgctttagagatgtttatccaaattcaccacggagtcaatgggccaaattccaaatgccatgggcctcccagtgggtgtcaattttactgggcggctgtgtttgggagaaaaagtacatatgcatgtgtggctgtgaatgtgtgtgtgtagagataaagagagaaggatatgaacaaatagatagaggcatcaacaatcacaagagggaaagggatgatatatgtttagaattatatctaaggactgtctaaagataaacaaaaataacgtttttccccttttttgtcacccttgttaaaatcaataggaaaaatttgaaggtaccaagttattttattgtcaggcaccaaaagagtaaaaattgatgacatcactccatacaaaacccccagagctttctgattctgctgtttatgctttctcctgcaacatctccatttggatcctgctggaaacacttttctttctgtcactcacaatctgtcaagacagcattatcttctgtggtttaaaaacagaaactccatttaacttcgtggttgataaagacatctcgttcacatcccttaactaacaataattattctaatttaccacataaagacaagaaaaaatatgcacttaacattttgcagctggttttgtatcaaggaacacatggaagagaaatggtcccactcttgcgataaaaaaataaggtattaagtaaaaaatagacctaacatgaatgtatgcttttggtacatcctccctacatgccaatcagtgaagcaattaggagtttgggctctcaaaacatacttggattccaatcctggatttgcctcttattaatctaagaaggcaagacacgtaaccttcctaagtcttcttcatctgtaaaatgggagcatatatcaatatctacctcataagattaaattagataatcaatctatgtcagctgctgttactattgttgtcctcctcctactcgtcctcatcatcaccactattaacatcaaatcaacgtattagttaaggttctttggggtcaagcaacgcagatcatcctgcctaacgttagcaaaatagaaaagagatctactgcaagtatacagaatagtgcctaaaaatcaaagtaaaactaaatgaagcttagaaccaacaggaggctgggggcagtggttcacacctgtaatcttagcactttgggaggccgaggcagagggatcacttgagcccaggagtttgagacgagcctggacaccatggcaaaacccagtctctacaaaaatttagctgggcgtagtggcacccacctgtagtcccagttactagggaggttgagatgggagaattgtttgagtctgggaggttgaggctacagtgacccatgatcatgccactgtgctccagcctgggcaacagagagaccttgtctaaaaaaaaaaaaaaaaaaaaaaaaaaagaagcaacaggagtcaggctcccaggaattcatggtcagttagttcttcaggctactatcagcaggaagaatcagcaacaaccattttccatccttgggtcaatgtactcaagattcagaatctctgaaaaaaaaagagtggtggggtgggggtaggggggtggggtttgggacttgggcactgccttggtcacatgaccactgcttggcctggggaaggcaaggtgtttgacagctccaataatactgtgtttggtggagaaggctattccccaagggaaaaatctactttataactcaaagaagaggagtacagatactgagcaggtacatataccaagaactatttttcttacaccattacatcccaacgacccactacgtcaagctcaattaagcctgcaccctcttctccatcatccttcctatttggtaattactcttttaatacatgtttttaattttgaagttgttgttaaaactcaatttgagaaaagcaaaaaggccccagagctctaaagtatatatgtcccttaaaaatatatatatatatatactgcttgctgacaataaattattttgttaaaaaacttccgtattagaatttccagaaaatttattgtctttatgttcaagttatttagtagtaatctgtgctattaagaagcacataaagcacccattgaaaaagttatctgaagatgatttagagaaatagtttgttctcttagaaagaaatctcttttatgttttaagttcaataagatgatatttatgctcataaattagggtcaaaggcaacattttgttttggtaatttttttgtggatgatgatgttttagtgagaaaggattgacaataaaagcaagaatgtaagaataataaaaataaataataacgaaatacatgacctacaatttcattaaaattttcttccagcttactagctgaacaaatcccaaacaatgaaaatatacagagtctgattaatttgaagccctaaacaactctgtagctcagtgaaaacatttctcataaagcccagggccctgagggcacacagagctaagacaaatcccagtgtggtccacccttagcagctgtgtgactctaagcaacttactaatctgccaaaatacccaggtctcgcctcatctgtaaatgaagtaaacaacgtggtgggatgttttgaggacttgatataatgcatggaagggtcttgacactttttctggcaaacaatgagcacacaacgataaacgtttataattctatgtatggagagagagagagagagactgagaaagcatacaaaagagcaagaaagcagtagttctcaacagggagtgatttttgctcaccagaggacatttggcaaggtctggagacatctgtgattgtcaaaacctggagggtagagggtgcttctggcatccagtgggtagaggccaggcatgctgcttacagggaagctcttacaatacagatgacaagcccccacaacagaattatccaagccaaaatgccaataatgccaaggttgagaaacagaaagagattgagaaagagaaagcaatgtgatgtaatgcagaacctgtaacagatttggaaggaaaggtacattcaaagccgggataggaaagtagatcagagcagatttgaaattagattgacaggcatctgccacatgtaagctattgaggaagtgctctgagcctgaggattctcatttgaacaacgggcataatatgtaacatcacctacctcaaaaagttgttagcaggcatgatattcacccctgaccaaatcattacagatgcccactgcgtataaccagtaggacttcaccagtgtgtatacccactgtcaaccctaagagttaggtacacgtaataaataaatggttactagtcttgttatatattagaccaacagccaggtttgaagtttgactctgctacactggaaatacttgaaagggtttgttaatatcagcaagaattagtgccctcataaggaagtaaacagcaactagactccaagttcaaatgagttttccctgtaggttaggtgtcctcaacttgggatccttaaaacctctgaaattaaaaagaaaaaattacacatatgcacatatatacatgtatgaatgcaaccaagtgtgtgtgtgtgtgtgtgtgtatttttctctgaagaggggtccaaaaatggtgacgcatcactgggttagaggtatacagttttcaatataaagtaataaccaggatgcagtagagtttctgaagatatcattgtaatgtgaaggagacagtatttggaaatagttatgaactcagatctgggagtttgaattctgcctctgccacttactgtctgtgcaaccttgcataactgacagaacaataacttctttgcatctcacatgcaaaggtggaatgctcataatatccacctaagaagaatcttagagcaataaaattagacaattcccatatggtattcagcacagtactcaacacatagtatagaagtccctggttatccgcaggacagatgcttcaagatccccagtggatgcctgaaaccaaacagtactatgtttctcctacacatgcatacctatgaaaaagtttaatttataaattaggcagagtaagatattgacaatgatagctaatgataaaatagagcaattataacactatgccagcattactactcttgtgctggggccattattaagtaaaacaagggttccttgaacacaagcaccatgataccatgacagttgatctgataactgagataatgattaagtgatgaatggacagggagcatctacagtgcatatgctggacaaagggatgattcacttcctcacaatggagcgagacagcatgagattccatcatgctacttaggacggtgtgcaatttaaaatttatacattgtttatttctggaattttatagttaatatttttggaccacagttgaccatggttaactgaaaccacagaaagcaaaaccgtgaataaggggagaccactgtatgtgaggactaagaattagatactgcaatggaagtatttgcaaagactattatattcagatggtggtgaaggtttgagccttctctaactacgtatggcacacactatcagaaaaatggcagggattcatcaattaatctatccatttactactagttcagccagaggatccactaattctgagacatgccttgtataataatatctatacaatgttgaaaagtggacagaagtagctgtgaatctggtcacaaaacctctttttatacaagaaagcctcattcaaactttctcctctgacacatttcccagggccccctctgggatttccacaaacatgatgttgtgcttgactgtgcattactatggaacaattctaagcctgtctcacctacatataagatacagactccgcaagggccttttcaatctccttcattcctctcagaacctgtgcaaacaggattttatgcacaggtaacccaaataaagcagggttgccttgagacttgcatctgcccaataacatatccacgaagaatgactctgtaggcatttgccagtgcattgcacagcagcacagcctaaaattcttcctcacccatccattgccccaaccttaaagcatctgttttaaaaaaaaaaattcatctttccctatctctcattctaacctatccccacccaggatgccctcagtgccattctgctttttcgctgccaccacatttactgtgctcatgacacctgtcccctctcttcagggtatcactcctgcaaggcagagagcctggcctgaatacctttcttctggaagcagccctctagaattctgggtaacagatttgctatcttgttctatagagaagttcattacaagaaatgcctccattcctggctcaacgctcacttaaccttcttctagaggccacaggcagatgatcttccaagtttctcttaccctagaatagtagtgaagaaaaaaggacctcatctgcactctacctgacttgcagggcaaagtcagtattaatcagaggtgccctttttgctactgacagacaaagtagatgcactcataaccaagagcttttcaccaaaccctcagggctttaaatctttctcaaacaaactgcaatttgcaaagaaacaccctaaatgatgctgtgcaaggaagttacagcaggcacagaaggatggagtaacatttcaccatctgcttgtgataataataatgcctctaccttgcaaagtgtctaattgattgtgtgacacaggcacaaagttcctgccacaatttcaccaacaaaagttattcctaaattgtaccctcacagagggagagtgctaaggtcagtggtcctaaggaccaattttgagcatatgaactttctggtggcagaatgataagagtcctgggacacagttaggcaagattgaaccaactcaccctataatagttgtttcaagcaatgtccagccggggacacagagaacagagaggtaggggatggatctagggcagtgttttccacttgtggaatggaaaatgccttaaggtaatatggatgaacaactgtctgggtttcctgtggaggaagcctgggctgctttactctctagggtgttgagccagaaggctttattctggtacagccacctcattgatagtgaggtagcaatgcctgacaaaagtagatgttcatgctttgtgctagaagagcatagacttagccagatgccatctttttctaaattggcagcactcaggcctcaactgaaggggttgggaaaagtgagctggaaaaaagaggccgggagcggcagctcacacctgtaatcccagcactttgggaggccaaggcaggtgcaacacctgaggtcaggagttcaagaccagcctggccaacatggtgaaaccccgtctctactacaaaaattacagccagctacgccgaaggctgaggcaggagaatcgatcaaacctgggagggggaggctgctgtgaactgagattgcaccaatgcacttcagcctaggcaacagagtgagactcaatctcaaaaaaaaaaaaaaaaaaaaagacgggggcgattccaagatggccgaataggaacagctccagtctgtacctcccagcgtgagcgatgcagaagatggatgatttctgcatttccaactgaggtatcgggttcatctcactggggcatgtcagacagtgggtgcaggacagtgggtgcagtccactgagcgagagccgaagcagggcaaggcatcgcctcacccgggaagcgcaaacatgtaccacatgttctttatccagtctatcattgatggacatttagattgattccatgtctttgctattgtaaatactgctgcaatgaatatacacatgcatgtgtctttataatagaatgatttatattcctttgggtatataaatacccagtaatgggattgctgggttgaatggtagttctgcttttaggtctttaaggaatcgtcacactgtcttccacaatggttgaactaatttacactcccaccaacagtgcataagcattcctttttttccacaccctgaccagcatctgctactttttgactttttaataatagccattttgactggtgtgagactgtatctcattgtggttttgatttgcatttctctaatgatcagtgatgttgagcttttttttcagatttttgttggccacatgtatgtcttcttttgaaaagtgtttgttcatgtcctttgcccactttttaatggggttgtttttctcttgtaaatttgtttaagttccttatatatgctggatattagatctttgttagatgcatagtttgcaaaaattttctcccattctgtaggttgtctattcactctgttggtagtttcctttactgtgcagaagctccttagtttaattagatctcatttgtcaatttttgcttttgttgcaattacttttagcatgtttgtcattaaatctttgcctgttcctatgtccttaatggtattgcctagttgatttccagggtttttatagtttggggttttacatttaagtctttaagctatctcgagttaatttttgtatatgatataaggaaggggttcagttttaatcttctgcatatggctagcagcttaacccagtaccatttattgaatagggaatcctttccccattgcttgtttttgtcaggtttatcgaagatcagatggttgtaggtgtacagccttatttctgggttctctaatctgttccattgggctatgtgtttgtctttgtaccagagccatgctgttttggtcactgtagcctcgtagtacagtttgaaattgggtagcatgatgcctccagttttgttcttttagcttgggattgccttggctcttgggctcttttctgcttccatatgaattttaaaatagtttgtttctagttccgtgaagaatctcaatggtagattaataggaataacactgaatttctataaactgttaagggccatatggccatttgcatgatatttattcttcctatccatgagcatggaatgtttttccatttgtctgtgtcatctctgatttctttgagcagaattttgtagttccccttgtggagatctttcacctccctagtttgctggattcctaggtattttattcttctgtggcaattatgaatgtgactatgttactgatttggctctcggcttgactattgttggtatataggaatgtttgtgatttttgcacatggattttgcatcctgagactttgctgaagttgtttataagcttaagaagcttttaggctgagacgatggggttttctagatataagattatgtcacctgcatttgaatgcactttatttctttatcttgcctgattgccctggccaggacttctaacactatgttgaatggatgtggtgagagagggcatcgttgtcttatgctgattttcagtgggaatgcttccagctttgcccatttagtatgatgttggctgtctgtttgccataggtggctcttattattttgaggtatgttcctccaataaggagtttagtgagagttttttaacataaatgggtattaaattttatcaaaagccttttctacatctattgagataatcatgcagtttttgtctttagttatgtttatgtgatgaataacatttatggatttgcatatgttgaactaactttgcatcccagggataaaggttacttaatcacagggagtaagctttttgatgtgttgctggattcggtttgctagcattaggtcaaagatttttgcatcaatattcatcaaggatattggcctgcagtttttttttgttgtatctctgtcaggttttgatatcaggatgctgctggcctcatagaatgagttagggaggagtccctcctcaattttttggaatagcttcagcaggaatgctaccagctcttctctgtacatctggtaaaatttagctgtgaatccatctggtcctgggctttttttggttggtaggctatttattattgtctaaatttcagagctccctattggtctgttctaggtttcagtttcttcctgattcagtcttgggtgggtgaacgtgtctaggaatttattcatttcttctagattttctagcttatctgcatagaggtgtttataatatactctgatagttatttgtatttcggtggggtcagtgataatatcctccttgtgatttctgattgtgcttatttgaatcttctctcttttcttctttattagtctagctagtggtctattttattattaataattctttcaaaaaacagctctggattccttgatctttttttatccaagtaattgaacaattctacaagtattaaattttacaccaggaatgtatgaaggttcccgaatccttgctgatgcttgttattgttgtctggtttagtgggtgtgaagtggtgtcatattgtggttttgatttctatttccctaatgacagataacgctgagcatcttttcttttttttattatattttaagttctagggtacatgtgcacaatgtgcaggtttgatacataggtatacatgtgccatgttggtttgctgcacccatcaactcatcatgtacattaggtatttctcctaatgctatccctctcccagccccacaccccccgacaggacccagtgtgtgatgttccctgccctgtgtccaaatgatctcattgttcaattcccacctatgagtgagaacatgcggtgtccggttttctgtccttgtaatagtttgctgagaatgacggtttccagcttcatccatgtccctacaaaggacatgaaattatccttttttatggctgcatagtattccatggtgtatatgtgccacattttccttatccagtctatcattgatgggcatttgggttggttcgaagtctttgctattgtgaatagtgctgcaatacacatacatgtgcatatgtctttatagtagcatgatttataatcctttgggtatatacccagtaatgggattgctgggtcaaatggtaattctagttctagataattgaggaattgccacactgtcttccacattggttgaactaatttacactcccaccaatagtgtaaaagcatttctatttctccacatcctttccagcatctgttgttcctgactttttaataattgccattctaactggcataagatcgtatctcatcgtggttttgatttgcatttttctaacgaccagtgatgatgagcattttttcatgtgtctgctgactgcatagatgtcttcttttgagaagtgtctgttcatatcctttgcccactttttgatgggtttgtttggcttttcctgtaaatttgtttgagttctttgtagattctggatattagccctttgtcagatgaatagattgcaaaaaatttcccccattctacaggttgctggtttactctgaaggtagtttcttttgctgtgcagaagcactttagtttaattagatcgcatttgtcagttttggcttttgttgccattgcttttggtgttttagtcatgaaactctttgcccatgcctatgacctgaatactatcgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgattttgtcaggtgtgtcaaagatcagatggttgtagatgtgtggtgttatttctggggctctgttctattccgttggtctatctctctgttttggtgccagtaccgtgatgttttggttactgcagtcttgtagtatagtttgaagtcaggtagcaggatgcctccagctttgttcttttgcttaggattgtcttggcaatgcaggctcttttttggttccatatgaactttagttttttccaattctatgaagaaagtcactggtagcttgatggggatggcattgaatctataaattactttgggcaggatgggcattttaatggtattgattcttcctatccatgagcatggaatattcttccatttgtttgtgtcctcttttattttgttgagcagtggttggtagttctccttgaagaggtaattcacatcccttgtaagttggattcctaggtattttattctcttcatagcaattgtgaatgggagttcacttatgatttagctctctgtttgtctgataatggtgtgtaggaatgcttgtgatttttgcgcattgattttctatcctgagactttgctgaagttgcttatcagcttaaggagattttgagctgagacaatggggttttctaaacatacaatcatgtcatctgcaaacagggacaactggacttcctcatttcctaatcaaataccctttatttctttatcttgccttattgccctggccagaacttccaacactatattgaataggagtggtgagagagggcatccttgtcttgtgccagttttcaaagggaatgcttccagtttttatccattcagtatgatattggctgcgggtttgtcataaatagttcttattattttgagatacgttccattaatacctagtttattcagagtttttagcatgaagggctgttgaattttgtcaaagaccttttctgcatctactgagataatcatgtggtttttgtctttggttctgtttatgtgatggattacgtttattgatttgcgtatgttgaaccagccttacatcctagggtgaagccgacttgatcatggtggataggctttttgatgtgttgatggatttggtttgccagtattttattgaggatttctgcatcgatgttcattagggatattggtctaaaattctctttttttgttgtgtctcttccaggctttggtatcaggatgatgttggcctcataaaatgagttagggaggattccctctttttctattgaatggaatagttgcagaaggaatggtaccagctcctctttgtatctctggtagaatttggctgtgaatctttctagtcctggacttttttggttggtaggctattcattattgccttaatttcagagcctgttattggtgtatttggagattcaactttttcctggtttagtcttgggagggtgtatgtgtccaggaatttatccatttcttctagattttctagtttatttgcatagaggtgtttatagtactctctgatggtagtttgtatttctgtgggatcagtggtgatatcccctttatcattttttattgcatctatttgattctcctctcttttcttctttattagtcttgctagtggtctatcaattttgttgatcttttcaaaaaaccagctcctggattcattgattttttgaagggctttttgtgtctctatctctttcagttctgctctgatcttcgttatttcttgccttctgccagcttttgaatgtgtttgctcttgcttctctagttcttttaattgtgatgttagagtgtcaattttatatctttcctgctttgtgttgtgggcatttagtgctataaatttcactctacacactgctttaaatgtgtcccagagattctgctacattgtgtctttgttctcattggtttcaaagaacatctttatttctgccttcatttcattatttacccagtagtcattcaggagctggttgttcagtttccatgtggttgtgcggctttcagtgagtttcttaatcctgagttctaatttgattgcactgtggtctgagagacagtttgctgtgattccttttcttttacctttgctgaggagtgctttacttccaactttgtggtcaattttagaatacatgcaatgtggtgctgagaagaatgtatattctgttgatttggagtggagagttctgtagatgtctattaggtctgcttgttgcagagctgagttcaggtcctggatatccttgttaaccttccatctcattgatctgtctaatattgacagtggggtgttaaagtctcccagtcttattgtgtgggagtctatgtctctttgtaggtctctgaggacttgctttatgaatctgggtgctcctgtattgggtgcatatatatttaggagagttagctcttcttgttgaattgattcctttgccattatgtaatggctttctttgtctcttttgatctttgttggtttaaagtctgttttatcagagactaggatttcaacccctgcttttttttcttttttttttttctttccatttgtttggtagatcttcctccatccctttattttaagcctatgtgtgtctttgcacatgagatgggtctcctgaatacagcacactgatgagtcttggctctttatccaattttcccgtctgtgtcttttaattggggcatttagtccatttacatttaaggttagtattgataattgtggatttgatcctgtcatcatgatgttagctggttattttgcagacttgtttatgtggttgttttatagtgtcactggtctgtatacttcaccatgtttttgtagtggctggtagccatccattcttcccgtatttagtgcttccttcaggagatcttgtaaggcaggtctgctggtagtgaattctctcagcatttgcttgtctgaaaaggatcttatttctccttcgtttatgaagcttagtttggctggatatgaaattctggattagaatttcttttctttaaaactgttgaacattggcccccagtctcttctggcttgtagggtttctgctaagaggtctgctgttactctgatgaacttccctttgtaggtgagctgacctttctctctagctgcctttaacattttttctgtcatttcaaccatggagaatctgacgattatgtgttttggggatgatcttcttgtgaagtatcttactggggttctctgtatttcctaaatttcaatgttggcctgtctagctaagttggggacattctcatgaatgatatcctgaaatatgttttccaaattggttccattctccccatctctttcagagataccaaagaatcacagatttggtctcttcacataatcccatatttctcagaggttttgttcattctttctcattcttttttctctattatctgactgtcttgtttcagaaagccagtcttcaaactctgaaattgtttcctctgcttggtctattctactattaatacttgtgattgcattatgaaattactatagtgtatttttcagctctatgaggtcaattacattcttttctatattgactattttttctgtcacctactgaattgttttatcatgatttttagcttccttgtattgagtttcaatgtactcctgtagctcaatgattttcattcctatccgtattttgaactctgtttctgttatttcagccatctcaacctggttcagaacccttactggagaagtgatgtgattgtctggagaaaagaaggcactctggttttttgagttttcaggattcttgtgctgattctctctcatctttgtgggcttatctacctttaatctttgaggttgctgacctttggatgctttttttttcttttaacctctttgatgaccttgagggtttcattgtggtacaagatggatttgccccactggcttcgtttctggaaaattttagggggccaacactcagcttccaactcatggactgtgtgctgtaactctggggtacttgtattgttttaattttaaaacaggaaatggcattgctttattttcactaagtctattattactttctatttatggtcagtaatgctgctcttacattcatggtgagagtctgcaaattctgtttgatatgtgaatataagtaaataaaagtgagtgacttttttaaattaaaataataataataaaaaaaaagtggtctgcatatttggcccaaagcaaaaaagtctgggatcaactctccctgaaccccagctcttcccatcccaaccacctatttttcctcaaaagcctggatttgggtgtgaaggtttttagattctcctttcttctttacccttatactcacttgggatccttcacaaccagcctatcaacataatttgggaaaagttatttgtgcagaaaaggtctggttctttcctactggagaattgcagaataaacaaaacaaatgaatcaattcaaagacgctttcagcctccagcaactgttgcatttttacaatggtaaaaggcagccaaacctctcatttgcccagaagttctttctttttccaatggttttaaatggctctaaagagaatgatccaacttagcagataaaaggccaagcctcctgtatagagaggtcttaatgttttcttttcagctttggaaccccctgattattagcattgtatccttggacaagtcactgagagcctgaatttctacacttgacaaacaaggacctacttcacaagggagataatgagcatcaggcacttagttgagggtcaggcacatataagggctttaaagagctattacaattattattattttgtttgtttgttttaatatatgtatacattgtgaaatgattgccacaatcaaattaattatcatgtccattactgcccagttatgatttgtgtgtgtggtgagaacacttaagatctattctcttagcaatttcaagtgtacaatgcattattattattaactgtagttaccatgctataaaatagatctccagaacttcctccgctctaattaaaactgtatgttttaccagcatctccctattcccccacctcctcccagcccttggcaacaaccatcattctactctctgcttctatgagcttggcttttttaattaattaattttttaatagacaaataaaaattgtatatatttatcaggtacaacatattttaaaatatgtatgcattgttaaatggctacattgagtgaattaacatatgcattcatcacatctttttgtttgtttgtttgtttgttttttgagatggagtctcgctctgtcgcccaggctggagtgaagtggcgcatgtcagctcactgcaacctccacctcctgggtccaagtgattcttctgcctcagccttctgaatagctgggactaccggcatgagccaccacgcctggctaatttttgtatttttagtagagatagggtttcatcatatcggacaggctggtctcaaactcctgaccttgtgatctgcccacctcggcctcccaaagtgctgggattacaggcatgaaccaccatgcctggcccatcacatcattttttatagtgagaacacttaaaatttattctgtagtgcttttcaagaaaataatacatggttattaaccatagtcattatgttgtacaatagatctctttaattcattcctcccataactgaaattttgtatcctttgaccaacaattctccaactgcccaccctccgcgccaactcctggtaaccaccattttattctctgcctctatgagtttgactgtttaaaatttcgcatgtaagtgagatcatgcagtatttgtctttctgtgcctggcttatttcacttagtataatgtcctccagtttcaccagtttgtctccaataacaggattcccttcttttattaaggctgaataattttccagggtgtatgtatatcacattttctttatccatcatatattgatggacacttaggttgattctgaatcttagctattatgaataatgctacaataaacatgggagtgcagatatccttagaagacttattttatttcctttggataactacacactagtgggattctggaatcatatggtggttctaattttttgaggaagttcatactgttttctataatggctgtactaatgtacattctcaccaacagtgtacatgggttgctttttctctacagctcagcaacacttattatcttttgtctttctgataatagcctgataaagaaaaacttcagccaaattaaatttaaaggagtttaattgagcaatgaacagtttgtgaatcgggcagccttctgagccagagcaggctcagagactccagtgcagctgcgtggtagaagaagatttatggacagaaaaaggaaagtgatgtacagaaaatggaagtaaaatacagaaacagctggattggttgcagctgggcgcttgccttatttgaacagagttcaaacagttggctacatttgattggccaaaagtcagtgattggcacaagggtaggctatggtttgtttatacctccgcttgttatagttcacgatgtacggaaaaacctttaggctgaacttaaaatatgtaaggaggcagcttaggctaaacttgatctaacaaaccattctaacaagtgtgaggtgacattttattgtgacttgaatttatagtcccctgataattagggatattaagcatttttttcatatacttggccattcatatctcttcttttgagaaatctcttattattatcatcttcattatcactctaattattaataatgttcactaacccatacagctacagtgatttttgttacaacaggagctttctgctttcaaaaaaaagtgctgctaccttaagtaatcatttatcctaactctaggctgcaacttactattattattattcattcaacattcactcaacacttacttcctagagccactgtttgggcactggggaaatagcactgaacaacacagagcaaagtctttgccctgtggctcacattctggtgaagcagagaaacagtacacataataaatgaatgttaattacagtatgtttggcagtgatgaatgctagagaaaaaatagcctatgacctggcaaaggcattacccattaaggtaaaggacctatctcctagagcacttgagttttgtatcacataattcatcaaggcctttagatattacagtctgatctttgggccagtggtctccctgtgtcacaaggcaagcgggcctcaagaaagtaaaaaaggaaaatatttcctctatttgctattgccaaaacttcctccaagagggaaaggataggacaaaaagtattttgtgtgggtgtggcagccatagctaggctatcaaatactatgcacatatgatatgccactctcagtccctataatggcagatatgattaaggtttcctctttcctgctgagcccagaaccagcttcacaaactttttcagcacagttctctgggcaagcaactttagtgattaaagttagcctaaaagactaaatctatgtgccatcatagagtgcaaagttaggtttaaatgtaaatatatctagcaaaggtatcatactgacttaaaatcacactaagtcctaaatgactggtcttcttccaagtgaacattttattggaggtagggaatggctaagaagaaatgctgttaagtgtatagaggggaggggcagaaggcatgtatgaagaaaaggacaggttttataatcccacccacatttgtatctgaacatgtgtgtatggcaaacacacctgatagcaataacttaagcataccctaagaataaccctgtatggcagatgcacttgaatgtggttaggtgtcccaagctaagaatccaagaatggccaacccagagagttgttcctaatctataaggaacatctgagcccctggcctgtccaatggaacatggctgtatagggaatcaaggccctttgtttggggttaagtgaaggttgccaggtagagactgtcacagggagagtgctaagtaaatatgccatataaactgcatgttttttgcaagttgcctggttctcctgtccagcccactgccactggactctctcccctgtatgtaagcccccagtaaaagcccatgtcacgtttcctgtctctgggtctcttcttcagcctcttgaacctggtgccatccccactgaagttgataggtgttcagcacaacagtgtcattaggaatttctacaatgtcataagcaatgtcataaggcatttctacacactctcacttgaaggaaccacctccattagtgtaccttagtctttcacacaaacacatacctgagcccacaaataaagtgctcaaaaatagtggctctcttcttctagttgttcaggccaaacaccttggagtccaccaccaaatccttttaggacaaccttcaaaagattaacagccacttcttgccatccaaccataccatccatgataatccaaccatttcttgccagctctaccctgacctccaaaatcaagccaccaccaagtcttggcaagaagggctacaataattccccaacagtctcagcttctgcctgtgatcctggactgtctatctctacttaggagcctgctaaaacctaagtcaggtaacatccctcctctggccaaaaacctctagtaccttcctatctcacccagagtaaagtcccacaaggtccctcacgctcttgttcccaactgtctctcaggccgcttttctcttgccctgctttgtactcttccttccagcccacaggcctccatgctttcctcaaacaggcctgctatgtttccatcccaagaccttttcccttgctgctgcctttgcctgggagacttttactccaaggtgccatatggcttcttccttactccagtcacatcttcaatgtggccatgagaggccctgctagatcacttgatctaaggcagcacacaagccagcccccacctccaccctctccctctaattctccttaccttgtttgataattcctcatggcatttatcactttctaacccaatatccttccttcctttcctccctccattccttttttccttcttttcgtcactatctgtcttccaatagaaaataagctccatttgcataggggcatggtctgttctactcattcttctgcctagaataggatctggcccagagcaggctgaccaactctttactaaaaactcatccgtcactgagaactagcaccacaccacagaaggaagaaggctctgcatctacaaaatacagctgctttgtttgagtgctttgagctctgtctcctgtaactgggtgacaaaggtctaaacacataatgatagtgctggtgtgatagaaagtgaaagttctttactcttgaaaaaaagctagattttatcaagtgctggatttgctcagtggcatttaggttttaccgctataaaacaatattcctatttcttaagttcttgctaggaaaacaagtaactttgatttttcagtctgaaactctccagcgccccttaactatggcccccgaaacaaacattttatactgaatttttgataacacacaatttattaaaatgcagctattacattagtgcagaataagctatatacattctaagatttagcatgctgtcaaaaggtttcctcattggaactgatagctacccctaaagcagagatggtcttgagcatatcatttacccactttaagcctcggtgcctttaatctgtaaaatgaatggctacaccaggctctctctagcatttattccaaatgatacattcaggcaggcaggcatgggatccagtggaaaagacttgggatttggagcttgagatctggctctgtcacttacaagccacactgaatctcattttttttcatctataaaacattaatcactggaaataactaccttgtctataccaccttttggtatcttaggacatacatttggaggatcaccaagacagggctgtgaggacatctatttggtttcccaggatgagcagagtacctgacacatcacaggcactcacgtgcatttgctgcgtggaggaaagaatatatggacaaataaaaaaacacttccacacctccccagctgttgtaaggacttactaaagcaatgcatgttgaaagagctttttaaattctaaagtaatacaaatgataataattactgtgatagatctatttcacatttgcccagttcagccttggttgtcatactaatttaataccaacatgactggaactggaaagaaactaatattgattgaggtcttactatatcctaagcagatacatatgtacgtatgtgcacgtatataatttgagtcttctacctttttaaccaggtgggtgtcttaatgtagttataagttctagccagcagaagtcagaaactgagtcaaaactgaactcacaaatcagtcaacagttacttagcactcagtacttgccagcctctatgcgtggtgctttgcaggcatgggcacattcagtttttcaacagcctttgaggtaaccacagatacccctttttatagatcaggaaacacagactcagagcagttaagtaacttgcttcaagttaacagctaggaggtggcggggccaaaatttcactgtctgacttcaaagtccatgcccttaagcagtatatattatgcagtacattcatgtaagcttatcactgaaggtatgcggaataattcgggtgcttttatttttgttcaataaaaagctgctttagcactctatcaccactgccttaatttttttttttttttctaaaatgaaaatctgtgcctgggaatatgggtataactaaaaatgggacaggagaccacccccagaaagacaggcggccccagtttcaagttcttatttctcacattggcccttctggtgtgtcccagctgtattgtcataacctatagggaagttccgcagtcaggaaggccaatgacaatatatttcccctgacaacaccctggtccctttctgagttattcaatgacaattgaaatgtcttttcaatattttcttttccttttcagggcaaacatgtccacttgagtcattatgatcatcagctgttctgatttgcaagcagttcctaattgagtaggactagtgaatgctgtgagatatgaaatatcttgctgctaaattgcacacaggctgaaggcaataagaatttgtttagctatgcatagcgctttatattcagggaccagtggttatggagacactaaaaccagtcatcattaggacaatcctatcttggctaccagagaatgaagatccccacacagagctacctgaacagactaacggtcaagaggctgatgaggcattaatgagaccatgaatcaaaatttaccaaacaaacagtgcctccaaggcttctagttgtttctgtttgactttatcttggaactaactatggaacaagatggctgtgtttagatgtcttcattcatggcctatctttgaacactgtgtgtgtttatttgtttgtttgtttgtttgagacagagtctttctctcttatctgggctggagtgcagtggtatgatcatggcttactgctgccttgacttcccaagctcaagagatcctcccatctcagcaccccaagtaactgggactacaggcgtgcaccaccaagactgactaatgtttttatttttaatttttgtagagatggggtctcactgtgttgcccaggctgctctcaaactcctgggctcaagtgatcttgccacctgggcatcccaaagtgctggaattataggtatgagccaccatgtctggcatctttgaacaattcttccaagcaactattttgacttcatttctttctaggaaaaataaataaacaagatcatagagttatattatacaatataaaatccaaatactgacaaaagtcaaccatattagtcactttccactaaataaagttgtgtctatggttctttctctgggaaaatttaccatgtagtaactatcatttacttagtatgtgctaagcaccatgctgagagctttgttcctaactcttagttaggttaccttagaaagccccccacacctgggttatttcctagttctatgttctaggtacctctctgtcattaagcttaccacaaactcatttgtttatttgacatctctcttgaattgaactgtaagagtcactagagccaggaccatgtctatctttgcccccattgtaaccccagcctctaacataacacatgatatacagcggatgctcgataaacatttgaggaataaatgaaggaagcaagtcgaagaaacatccctgggttgctatcgctgtaagcagtagaagttgcatttgaattcagactccaaagcctgtgttcctcacctgcagcacacggtctctgtctgagctgaatagtctgttgcatcaaaacacatcaaacaggaaataaacaagagcaactattattaccacggtcccatacagccactagagagcaaaaggggtttctctatgactattgaggtatattaaggactcattacagaataaacactactgggcacaaaagcatatgagaaaagttttaggagtacaatgaaatcatgcccaatctttcctcagggtccctttccattctctatttatattgtttccagtttattattattataactgaacatttaggacccaagggatgttggccagtggagctacagaattctcagtcctctgaggaacctagcaactagtgttttcttacctggctcttaggagcaaaaggagaaaacaaatgtgcatccctgagctgttgtctagcatataaaaaagatgctattattaataacattttgtcttattaacatttgtcctactgtgatttattggcagccagaagcccaagctttaggattagtcagacctgaattgagccacttagttcttgtagggcctccaccaagttatgtaacctcaacctctttcttcatgcataaaataggattagtaatactatctacttcacataagtgcttggcatagaatctggcacagaggggaaaaaaaaacaatcattggtgcttattttcatcagcttcctcctaattattatttagtcagctgtgagtaaaaagaacctagcgttggccatggaacctggaaatatgacctttgaccctgtcctgttaatgcaattgtagtgagtgaatttttttttacgtgttcccatccccgagcagtccctccctctctcaaggacccggtggacttcctggtcttggcaaagtatgcaacacacatttacctttatcctgccagggaagtgaaggtttgagaccattaagctgggggcttcccacctacagtagctccccaatgcttccagtacaaagtttaaactccttagcttgccactcaatacccaacatcatttgatccaagcaactttgagcttgacatcagggccaaaagatgctttttccacttaagaacagaaattcagtccagtagactagtggaggatatgctaatattttacttccctttccatccggaacagataatatggtaaatcatctgttcatttagtcagaaataactgttgttctaggtgttggggctataactgtgaaaaagaagacttgattttatggaatccacagcctagtgaaagaaagagacaataattaaatggtgccattgtgtataatcagtggataattataattggaaataagtgaaaagcaagataaccatccttggactggaagagaaaatgccaaaagcccagaggagggctaagagttcaccatgtgaaggaggtatcactgtgtctagagagagcctggcatagaatggatctgaaagcctgataagaggcaggagcgccaagagtaaaggccaagcacaaggaggctggagcaataggtagagcccaactgtccagtgggaggaaggggaggaaatgatgggagataggcaaggaggggtgacagcaggaaggaaggaaaatgaacaaatgccagatatattcagcagataaaatagaaataagctgctgataaaatggatgacagggaagggaagtcctgagggtgtggcaggtagccagaatgactctgagatttgtggagtgtggaaataaaaggatggaagtgccatttattaattttattcttaaagataccttgagacagttgagaggatatgatgagacaactgcatgtatacagttgtgcataaggttcagagaaacactccggctggccattgcagcttgtaggaaagtatagggcctgggaagaagagtattgaaaaaagaaaaaggtgacacgctgttcatatgagagatgcaagaatgaagcaatagtggcattccacaagccaggactgagaccgtctcccaaacagccagatgactctgaacctcaaaccaacttgcagtcaccttagaattttattagctgcaccagatggcttacataatatcattaactcctccaccctcactacctaaaaatgctagaagataaaagggacggctgaggaaaatcctggaattttcttacagaaacaacatttacaacaggtaactagcccatcagtttctctagtatttctcagacatttccagttaagtctctagaatgacaaaagcaaatgatcctcgggtcttggtggtgccatcttaagtttccctctgtaaatgtaaatgatttttaaagcctcgtctagtactttaaaaattcatgcaaattttgcatgttactgcataatatcattatgctgcttttaatacgtacacacacttttaattctcccaaatactgaagcaaaaatgatgtgccacaaatgtgcctccattattagcctgtgactttgggaatgcccttgtccacagctttgcatgcagggttgaactcattaactaagttgagaaccatgaaattaatcagaaatggactagggaagtttttccttagagcagaagactagagtcatgacctctaaaaatcactcttcgttcctacaaattctaaaataagtggtaataataacattaatattaaaatcacactaagtggattttaaattcattctctcacactagaggtagttactatggtacatagtatgagagaggtatcaatttaaagataaagatgaggatacaaacacagaaagttaaagtatctttcaaagcaccataatttgaagccagacagttctagtccaagccaaactactattgtcctctctgctacatattagcagcaaactcatcttactactcttgctgatggcttatatttggtgataatcaagaacaatactgaaaagcatgcttcaaaaatagaaaaaaagcttcatcttccccaaacataattttatttaactgaaaaatatcagtgtgcaaattgaacatttttggtacataaagtcaagtgttactaattaagtaaatgagtgatgaatcataatatcaacccagtcattaaacaaaattataatgaaattacatttaccaactagtttacagtacaaaaaatataatgagccaactttaaagaaagcttccaataattttattaaggccttccaataattttatttagttaaggattctgttgtattatcttaaaagattaatacaaatagaaaatggaagagtaaactgtgcaatgacttctgtccctctcaacctttctctagagtcacatcttttaagcaacatgagacatgatttaattcacccaagagaggtcaccttgcttgccgggcaggtgccttctgtttaaattcagtttactcaatcaaatgtaccacggaatagaaaatggggcatattcctgtcctgaaattcttcctatgttaactaaaatcaccttacttttgtagcaaatgagccatgagatacggtgccagaaattgatttggaagagtaagtacacagtctgaaaacagtgtctgtatgttttgtaataaaaaggctctggatggccctagatgccaaagagaggctataaaaggacaaaggaatgcaaacaggggcagaactatacaaaaagattaaatgcatcaccactaaaagcgatacttactcttctataaacatatacatttactgattgctaatttttatctgacgagtggttttgaggtggcctcagtgcaatgtcatctcccctgagcttgtgtcttggacctagctagagtagatcattactccccaatacagctcccattattttcttcctagcactttaaaaaggctctaattattttctctttagttttccacttgctaattgcctatgttccctttgtcattaccagtgcctagctcagtgtctggcccatagtgagaagatactataatatatttaccgaacgaatgaacaaagctgcgagtggcaaacaggatggggcactcttttgagttcatttatacaaatcagattctatttcattttattaaatacttttatttactcattgtcttctgaaattactctgggttctcattaataaggagaaactgattctatcttcaggaaggaggggaaaaaacactttcagtcacttgttccaaaggtctttcaaaataatgttgtagtataatttggtttgaaagcaaggtccaacattttattacctccaaatttattcagaaaagctgaaggcccgtgataaggctcattaagtcgctgaaaggcctatcttcacgtgcctttcacacaaaaggtctcaacttaatgccaggtaattactgttcattttcccctggttatctctatttcctgaagattcccagagtagttggcctcagtggacactacccgcagtctgagatgtgagcagagcaagaaggacccatgttcactggaggatctttttggagctgtaacgaaagacaatcctaacactggggtctagaatttaaacttagatcatctacaagttaccctctatccagaattaaagccaagagggaaaagtttctggcatacaaactggtttgtatttccatttcaaagacatcatttttcatagcacctggacctcattccacacctgtagggttacagatgtgggccctggctccagattacctgggctcaaccctcaacttcatcactttccactttgtaactttgagcatgtaacttagattgtcagtgtgtcagttcccttatttgtgaaatagggctcattgtacctactggagtgttgttgtaagaattgaatgtaaagtagaaggaactttatctcacacatggtaagttctccataaagttatttatttattaatattaattagcattatcatgatcgtctctgatatcccatttgcaagcaggacttatccctgttatttataactttgatcctagtcccactggacccatcatggcattgagggagatcaaatttcactatttgtgaaacaagccaacagaaggtgaatgatgatcagggaagacattttactgggcaccatcatttcagttttgcacggaagagtggtatagccccttagaggtcactgaagtcaccatccccaagcatacacctgtttttatatttaatcaattgatggctgcaatttactaatctgcactgcagtgatcctacaatagccttccctcacagtgggctctcctcacttcagccaggtcattcataagagcttagcttcatagatactgtgatagtaattttttttttttcgagatggagtctagctctgtcgcccaggctggagtgcactggtgtgatctcagctcactgcaacctccacctcccagggtcaagcgattccctgcttcagcctcctgagcagctgggattacagccaccatgcccagctaattttttttgtatttttagtagagacggggtttcaacatgttggccaggcttgtcttgaactcctaacctcaagtgatctgcccacattagtctcccaaagtgctgggattacaggcacaagccaccgtgcccagcctgttatagttaattttactgtcaacttgactgagctaagagattcccaggtagctggtaaaacattgcttctgggtgtgtctgtgaaacaccctgtgagggtgtttttggaagagattagtatttgaacctcagtagattgagtaaagataactgtcctcacaaatgcatgtggccatcatccaatccactgagggcgcaaataaaacaaaaggcagaggaagggtgaatttgctctctcttatggagcagggacatcagccttctcccgcccttgggctgggacttacaccttcagttctctggttttcaggctttcagactttaactagaactcacatcatcaggtctcctggttttcagcccttcagactcaggctgagactataccgccagcttttctgaatctccagcttgcagacggcagatcatgggacttctccacctccataatcaaatgagttaattcctcataataaatctctttttattgattctttttctctggataaccttgattaacacaacctctgagttacaagagataattaaatatagcagctgagagcatgagctcaaaacttgaatgacctgggttcaattcttcactgtcactagtgaaccagggcatgttactttatacactaaggctaagttcaccatctagatatagggttaatagagtggtaacaaatccaaaggactaaggactatgataaggattatataagatcactatgggtgactctgtaaaactcttagcatgttgtcacttatataacaaacattcaataaacattagctactatatttagacatgtcttgggcatgtatgttccagaaatctttttatattagatggtcactacagaaaggcaatctatatgccaagcttttcaatgaagcaaacattatatttgaatactgagtcttaacctcaaaaggttacagaacaattttcattcaagaacaaatcagaaatcacaggttggagtgtacatcatcccttggcagtctcagcaagctaaccctacctaaagtgtcagaagacttttctcgtttacagaaatgcctttagaaatccccaaccaaccactggtaggtccccaagcttcagtcttcaaaggtggcacttttgcaggctaaaaaatccaaaaaccagaatgtctcttctcctccaaaggatcacaactcctccccagcaagggaacaaaactggaccaagaatgagtttgacgaattgacagaagtaggcttcagaaggtgggtaatgacaaactcctctgagctaaaggagcatgttctaatccaatgcaaggaagctaagaaacttgaaaaaaggttagaggaattgctaactagaataaccagtttagagaaaaacataaatgacctgatggagctgaaaaacacagcatgagaacttcgtaaagcatacacaagtatcatagtcaaatcaatcaagcagaagaaagggtatcagagattgaagatcaacttaatgaaataaagtgtgaagacaagattagagaaaaaagaatgaaaagggaggaacaaagcctccaaggaatatggaactatgtgaaaagaccaaacctacaactgattggtgtacctgaaagtgacaggagaatggaaccaagttgaaaaacactcttcaggatattatccaggagaacttcctcaacctagcaaggcaggtcaacattcaaattcaggaaatacagagaacgccacaaatatattcctcgagaagagcaaacccaagacacataatcgtcagattcaccaaagttgaaatgaaagaaaaatgttaagggcagtcagagagaaaggtcgggttatccacaaagggaagcccatcagaccaacagcagatctttctgcagaaaccctacaagccagaagagaatgggggccaacatttaacattcttaaagaattttctacccagaatttcatatccagccaaactatgtttcataagcacaggagaaataaaatcctttatggacaagcaaatgctgagaaatgttgtcaccaccaggcctaccttacaagagctcctgaaggaagcactaaatatggaaaggaaaaactgttaccaggagctactgcaaaaacataccaaattgtaaagaccattgacactatgaagaatccgcatcaactaacgggcaaaataaccagcttgcatcataaagacaggatcaaattcacacacaacaatattaaacttaactgtaaacaggctaaatgccacaattaaaagacacagactggcaaattggaaaaacagttaagactcagaggtgtgagacccatctcacatgcaaagagacacataggctcaaaataaacgtatggaggaatatttaccaagcaaatggaaagcaaaaaaaagcaggggttgcaatcctagtctctgataaaacagactttaaaccaacaaagattaaaaaagacaaagaagggcattacataatggtaaagggatcgatgcaacaagaaaagctaactatgacactgaccaagacaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataataccacacatctacaaccatcagatctttgacaaccctgacaaaaacaagcaatggggaaaggattctctatttaataaatggtgttggaaaaactggctagccatatgcagcaaactgaaactggaccccttccttacaccttatacaaaaattaactcaagatggattacagacttaaatgttagacctaaaaccatagaaaccctagaagaaaacctaggcaataccattcaggacataaacatgggcaaagacttcatgactaaaacactaaaagcaatggcaacaaaagccaaaattgacaattgggatccaattaaactaaagagcttctgcacagcaaaagaaactacgatcagagtgaacaggcaacctacagaatgggagaaagtttttgcaatctatccatctgacaatgggctaatatccagaatctacaaagaacttaaacaaatttacaagaagaaaacaaccccatcaaaaagtgggcgaaggatatgaacagtcacttctcaaaagaagacatttatgtggacaacaaacatatgaaaaaaaacctcatcatcactcgtcattagaaaaatgcaaaccaaaaccacaatgagataccatctcacaccagttagaatggctatcattaaaaagtcaggaaacaacaaatgctggagaggatgtggagaaataggaatgcttttacactgttcgtgggagtgtaaattagttcaaccattgtggaagacagtgtggcgattcctcaaggatctagaaccagaaataccatctgacccagcaatcccattactgggtatatacccaaaggattataaatcattctactataaagacatatgcacatgtatgttcaattgcagctgttcacaatagcaagacttggaaccaacccaaacgcccattaatgatagactggataaagaaaatgtggcacatatacaccatggaatacgatgcagccataaaaaaggatgagtttatgtcctttgcagggacatggatgaagctaaaaaccatcattctcagcaaactaacacaggaacagaaaaccaaacactgcaaattttcactcataagtgggaattgaacaatgagaacacatggacacagggaggggaacatcacacactggggcctttcagtggctggggcgctagggtaaggatagcattaggagaaatacctaatgtagatgacaggttgatgggtgcagcaaaccaccatggcacatgtatacctatgtaacaaacctgcacattctgcacatgtatcccagagcttaaagtataataaaaaaaaaggagaagaacaaaaaaaggtggcattttttcaaaaattgtattaagtgataagatgttaacataaaaattattaagatgaccaaaatacattagaagaagcagaaatcaaaggtaggcatgcagtagggtctctttaacctacttcttcttgttctatcccccacattatgcttgctctgttaatggcaacatttactcccttagtgtagtaataaatgttcagcaactgggtggtgggggtgttctaattgtagtgtttgccaattttcatggtgtaaatacatactctcaccatggctggcttcaagataccaacatgatatcactgaaaagggagttgggaagagaagcttataatcagctcttacaaatacgtacaacatggatactcttgagcccaggaaaagaaaaggtatgtgaataacatagtatcaaaagcatctagtctcttcttgagccatcagcccattcttgtcaggttcactattgggagcatggagaaatatatgaactgaaagcaaaagttatgaaggcaggggatagaaaatagtatcattaccactgaagagaaagaattgtattttttcctgtacgataggcaacatggcacacagacataacaagtctgggttgaggacggctattagagcaaaacgtgttttagaatcagaattttatattttaaaaccaattggcatgattcttgcatatgtatcatgagtgtatgattgcctatgcatgagttcagtattaagaaatagccaaaactctctgtggtgtaggacttccatcacaccaaccaggcagagaggctttctttgaatgcccgaactctgctcattctccatcatcctccattaacggagggcagttaatgcacatatctgcctgtgtggtggtaaatgcttaacaacggctggtggtgggatgggggtgttctaattgtagtgtttgtcagttttcatggtgtaaatattaatacatattctcatggtggctggtttcaggctaccaacatgatatcactgattagggagttgggaagagaagcttataatcagctcttaaaaataagtacaagctagctccaaaaatgtctatactatgtttccaagagatgaaaacctcatggacaaatactctttcgcgatatatatggttgctgtaaagtaatttttatatggttcattgtgagagtttaagtattacttcttttaagtactagaaatggaaatataatctctaatcccttttctaactgaatgaaatgttaacttcgatcatccatctgtgcagttactcttctagtaaatgtgattttttaaactttctctcctcttttcagggctacatctgctagtgttttccatttgccagctcccaacatgtccccaattacttcttttttattttatagcctccatgctgatgtttcatcagttacaactgctgggttccactgagcattaacagtctgcagtgcctctaggaggttacataattcactaagtataccaaatcattttttctccaaagaatattatttaatgtaaatacagtgtgaggttaatgtagtacaaaagaaaggtttttcccttagaatcatcaaaaaactgaaaaaaatgattcacggaagaatggtttacacgcaggaacaagaaatcacttgtatttaaggattatttcaactggcacttttttactaaacacaaagcaaaaaattaatacatttgagtacatgaacaagtttgtgttttacctattgaatcaaaatatttttaccacaagagaaggaagctaaaactaccttatgttaggcatatgcatacttgaaaacttatgatagaatagatatttgaaatcattttagtcaatagcaaagcaaaaggaaggatcaagaaaaagttctttgttttgtttttaactcaatttttcttataaatacctaattgttctccataaaaagttcataaataacctgatggatgatctgaaaatttccaggcaggtagcaggaactctctagaagtaaatgtcccagaaactttgcaaatcaaatcactcaattcttaatagatggcttaaaactgggtattacattgcaaagttttatgaaaatcatctggcaaacaactgtcttttcttcaagatgtaaacaatgaaacaattaggtttaaactgtctaaaactatgtgctcaagtgtccccttttacatcagagtctaagtgggacaatgatggagcagttagaattttctcaggtagtcagatggggaaacaggaaaaggatgggaggaggagtaatcattcaaggaaatttttttaaatgacagtatcaatattgaatatttctggagtatcaatcattatagtatgcccttgacatatagaatcttctccagtccatatacactgtgaagtaggtattacctatccaattttatagataggtaacaggatggtgagttgctgctcagggtattaagtaagtgaccaagatccagtgcttagctaagtcttgtcttcaacagtgtggagctggggctgggttgggacctctgtggtccaaagccccagccacttgacttcatactgcagcttctggttggtatctatggcatctatgagtctgacagctatattttcactcattttcagtcaaatatttatcaggcatctacttgagccagacaccatcctaggcagcagggcccaataggaaacaagacagaaaacaaaagtaaaaaaaaaacttgtcttcatgcctttggggtcttctttgtagttgagagagaaagacaattgtattagtccattttcatactgctataaataaatgcctgacactgggtaatttataaagaaaagaggtttaattgactcacagttccacatggttggggaggcctcaggaaaattacagtcatggcggaaggggaagaggcacatcttacatggtggcaggctagagagagcaggtaagggcagggaaaactgccttataaaaccatcagatcttgtgagaactcactccctatcaggaaaatggcatgggggaaccactcccatgatccaatcccctcccaactggtatctccctcaacacatggggattataaggattacaattcaagatcagatttaggtgggaacacagagccgaaccatatcaacaataaaacaaaataaactagtaaagtatttagcatgttagctggtgataggtgctgtagagaaaacaaagcccggaaggagcgtggggagagtaccagggtgggtggtggaggaggttccaacttgaatggtgtgggcctcatggaaatcttgtaaaaaccccaagaagatgagagagcaagccctactgtacaagttcctggaagtaaagcacatagggctgagggaaatgaagggcagagcaaccctaaaaggctagaagaaaagtagagagcctggagtggaatgaccaagaaaaaagcaggaggaagggaggtcagagaaccacaagcgcggtggcagatgatgcagggccttgtaagccaccatcatagttgccatctcttctccaaggcaagtgagcaggttgtgaaccaaggagggatctctccccaacttacgctgtaacagaatcatttgacttcggtactgagaatcaaccaaaagatgtgaagaaagaccccttatgagcctgccacaataatccaagtgacaggtgacagtagcttgggcccaagccatagtggtggaggtgatgaggcatggttggatgctggatgtaagactagacactgccatggctatgcagtttgttctgccactcagttgtttggcatgacacaaactcacaggaggaattttatataaaagatcgatacaggtgagataagatctccaattcttaaacagcagagaaaatcaaatgttaattggcaaataaaatgccaagaagatgtgcttgaaataattaaaataggcaaaggattgatcacctaaaaatagaagcagaaaacaaaccccccctgacagttttcatctctcacagttaaatattaagctttcctcttaagagtaacttggccaggtgtgatggctcacacctgtaatcccagcactttgggaggccgaggtgggtagatcacctgaggtcaggagttcgagaccagcctgaccaatatggtgaaaccccatctctactaaagatacaaaaaatatttttttttgtattacagggtgtggcctgtaatcccagatactcaggaggctgagacaggagaatcacttgaaaccaggaggcggagactgcagtgagtcgagatcatgccactgcactccagtctgggcaacagagcaagactctgtctgaaaaaaaaagaagaagaagaactttgtatttcctactttgctctacacatctacacatagaaggtattttaaatatttatggtttgttgattttaaaagaggctttgttaaaacgaaagtattaaacgggtaaaaaatagaaccaagtctgtgtgacaatacactagatttcaaattctcttttgcaagtatttattgaacactttctacagacaaggtacaatgccagatattagggatctgaagagaaaaatcagtaaacaaagttatttagtgcaaggacaacataaacaataatgaaaaaagaaagagataaactccagctgaaaacataaagaccacataggacctgtttgttaaatataagattcacagaatacagtgcaaggccagggaataaatgaaaaacctacaactttgatgacttattgtaggaccaggcatattacttaacatccccgatcctctatttcttcaattacaaatgaaatataaaagtatctcttaaaacatgtcagcagggtcaaattatataacttagaagataatagggattcaatatagcttagcattcttccctaattttttttaatctaacctgcaattacaatataggcgacaacattttcagagctgaaatgcgcttccgtcagctacacagtcttcatgatgatgtcccatccacaggggttatatgtgggcccgtcctagtttggtgttctctttgtgtgccaaagaaatgattatcccccaaaagcagcagccatcatttgagacctctctagttcgttgatttcaaactctgttactactgggatttaaactaaagctttaagattgaaaagaataataaatacagcaggctctcaaaagggaaacacttatcttgtgaaaaaacaaggttgtttttttttttcttaattctcaatgttcattctggaagattcaaggttatctactacctgtttttcttcctctccaatgctcaactcgaaagttgttcaaaaggttcactggcatacataagcctggaccctatacatgcttcctacgtgaaatatgttcttacttaggaaaaatgccaagctccagtaactgtgacctacataaattctaaggtgcaacgtaaggagggcaagcaaggcattactgaattgtatatgtcacgccatacaagctgatgtgcagctccctcaaagtctcaaaggcctcaataattgtaaataaacaatgtccttgagtccaaaaagactatgacatcccacaatcaaagtattaacttggaaagcattgcctactttgtattttctagaaatgtttcatgtgttcatcaacagcatgccagtcccaatgtaagacacaaacacagagacattcagtccatatgacataaggttgaaatcatcctaattgtcgacatgagaaaatgagaaagcaatttgtggcatctaaatacatgcataatttttatcccgtctggtttttgctctggttctgtgcaacctgaaataaggagagtgtgcaactgcttggtgacagattgcacagggatggaggactgtaaatggatgaatagttggaacatggttgaactcaggaatgaatgaaccagactctcctgatgaaatggctccactctggagatggagcccaggagagatgctgaattcactttttcacaccccagggatcaatttggttaataacctctctgctgccttaaaatcacttgggaacacctgaacaaaatacaaattcaaagcaagatcttcgaagcttagagaaactgaattgaatcaggaggtgaaaatcttgaacattgactatttcagctactatacacctatgtccatccaatttcatcaagatgctgaaaaagtacttagggtaataagtatgaaaaatgttacacttcttggaaaaccagtgcttaaatgttcagtaaatgataccttgtttctgaatttccctagcagcactgaattcttaatcattcacttatccatttaatcattcaaaagaaatttatatcttcactttttctcctgattgcatggtaatacctgcttactgtaaaatattcaaatgagatagtatcacatcaaggagaaagtataagtctctagaaattccagaaaatgtgtatttgttaaccactacattctaggctgtgtgctagaggtgccacagagttggcaaagtaaatctgaaaacattcctgtcctcaaaaagaccagagtctagtaagagagatgataacaataaaagtactaaaatatagtacaagaagtaatgcaagtcataaaaaaggtctgaataaatgctataggaggtccaagaaaaagaaacgtctgctacctaagaatgtccagggaaaacttcctttgcaaaaagaacctgtttctgccatttccttgaccatacaactccacgtgttgtgttacttatgagtcctctgctcagtgccgaaaagatttccctatactaagatctcagtgcttcgtttaacttgtacaaaattcccaaatccacattcttacaatttccccaaagattcagcaattctgaattccggtacacctcctaacagggtaaacataaagaaatcatttgatcattagttacttaccattatcattgttcacagaaattggggaaatggaaaactataagactggaaaaagataaatgttcccccaggccctctcaaaaaaataaaaattttggacaaaataaagaagctctaggttaggaagaaggataagaggcacacgaacacaggagcatgccacacacatttaacactcaatacacaagagctaaagagaaggctgtgtagggtcaaagtgagtttgaaatacataaaagctgaggctatataaaaatctgcatttacgataactcttctaggcagggaggttgttgagtacagacgaaaagaaccaggagaccagtggtgacagaggattctgtctttgagaagctgggagaactggaataagacacttaaccctttgggtttcatgattctcattattaaaataaaataatgatcctaggcctgtatgaaattcaaatgagataatatatttgaaagcattttacaaaacagttcataatgtattttataaaacacatagggttaaagtagttggccaaagttctaatgaaagattagttgactcaggacataaatctgaattttccaaatgaccaatcccaaattgttacctctactatcccttagaagtaaaaaaggatttaaacaactcaacaggtaaaaataatacttcctccacaataaataccatatcatattcccctttgttcctccagcatctacacagtgctttgcacagagtgagtactcagtactctagaagcaaaactcatctttctcctactctaccttcctatctcttagcaactactaattttctgctgcatttttagtggacatcagcatcagtaagttgccatcccaaggaacaaagtcaaattggcaaaaaggtggatgggctagcatccatctttggttgttatcaaaatattctccttcctcagcacactcaagtgaaggccataagtggactgtctgggccgaaagtctccccatacttccaccactcttgtatcattaaacattcttcgcagccttggtcaggagaggactgcgtggatgggcactggacatgcaaagtggcccaggtacatagcagtcttgtcaagcttggagagtagtggcccactcttggccccaggccactgccatttgcctgtcatttgtaagagcacagaccagaacatgagcccagtctgctgtgcacctcacagcaacatcctgacaattctgaaactcaaaaaaggtttcgttgtttattgggtataagccaggcaggactgaaaaggaattctttaaaggttagtggtgcaatactggataagagctttacacatcccagtcttccttccttggtgtcagaacgggattaacaggaagactggccaacagatgcccagggtaccaatctaagagggtactaaaatagccccagaaaactaacacaatgaagaaaacagcatttatcagaactttcttcaagaagggaactgggtttcattgtaagaaatacttcgataaaacaattgaggtagaatagggatgatatgctttgaaaaaactaaaaacaaggccaatataatgctttcatgtagggtggttccaacaatcaaagggctttcattttgctaagctgagtatggaggccaggacactgtaatctgttgtcatcttcctccacaagcagcactactcaaatctgttacttcacttgattgctgaaggaatactgaattagtctgcatgggccacccacatgtcttagttgagccctacatgagatcaccagttctcagaaaaggtctggctgttctgtttcagttccccagtttccatttcttgtctcccttaccttattcatccatagacaattcaattacaaatatttactgaacacctgctgtatttcaagccctgggaaggaagagatgagcacaacataatcttggtgccagataaacacatgtcctagacagacaactaagttaatataaggcaaatggatgggagctctatgagagaaacatacaaatgcaaacatggggatgccgataaggagtgagggaatgccttatggaaaatgtgacatttacatagggcctcttaggattaggaggagctgacaagtgcaaaagaaggatagagaaacccaagggtgttgaatgaagggcacagtgacttgagcaaactgtaaagagtccacagtgaccacagcacaggcaacatggttaagagtgcagaagatgaggctactgataaatgtcagagccaaaatttgaaaagtctttgaagccattccagaacgttaagatcttactctggaagcacaagggagctatcgatggttttaagccagaagtaaaagaaaaaaaaatgtggtagatttgtgttcagtgaaagaactctggcagaaattgaaaactaatggatagaaatggggtgtagggagtagaagcagaaattgcagtggcccaggatgagaacagaatatagaaaacaggcatttcacaggcaaaaatcaatggtagttggcgactatagtgcatagtgatgaagaggaaagagttcctgtctcctaattcattcatattcatcctttacatctcagatcaaatgccactttctaaaggaagacgtctcaaaccccaagaataaattaggtccttctggacatgctcacaaagcacattggacttttcctccacagcattgacctcagtttataatgctatatttctgtaataaataaaattaatctctgtatctgctaccagattgtgaacctcttgagggtacaaccatgtctgttttgtggttcctgtattcctagtatctagcttttagtaggaactcaaaaactatattttggaagcaataagggaaggcacttaaggatcacataaagacttctatactgcaatgccaggtagctggtgatcccattaactaagacagaacatagaaaaagaggaaaaggggaaaatagggagaagaaaatgaattccagaataaacaaggtaaattggaaaaatcttcaagaattccagatggagatttcaaatagcttgaaactcagcagtcaatccagagattatagatttaggaatcatctatgtagtggaagagaggagagtcactgctttactcgggttaagtatatgactccagaagaaaagaggctcaaagatggagccctgaagaaagccagaggtagaatccaagcaaactaaataatacagcaaaaatactgggaaagaaagtctgagagccaggagaacaaccatgagagggttgtattttaagaggtcaaggagccaggcacagtggctcatgcctgtaataatgccagcactttgggaggccgagataggtggattaactgaggtcaggagttcaagaccagcctagctaacacggtgaaaccccatctctactaaaagtacaaaaatttagccaggcgtggtggcaggcacctgtaatcccagctactcaggaggctgaggcaggagaattgctttgaactcgggaggcggaggttgcagtgagctgagatcgcgccactgcactccagcctgggcgacagagtgagactctgtctcacacacacacatacacacacacacacacacacacacacacacaaagaggtcaagggaggtagagctcaagaaagagaaagtgcttagtggggcccaatattaccaagggtagggggttggctcataagcctcagaaagtggtgggcactgggattcaggcagtgtctatttctaaagcaagagatcccaaactcccaaagaaaagctgaaaacagtgatgaaaacagcaggtgtgcacagaaggaaactaaaaaacatgcaagaaaataattattcattcaataagtatttgttgagcttctactatggtccaagcattctatattggaagtatagcagtaaacaggatataatggtctgtgggcccacaggatttaagagcagataggatcaagatcaaagaaaaagagtctgacttcaaaaagctatgagacatctcttcaaaggaaggagaaatgatctggggctaaagattatatgggcagagtcctagaagtatcaagaagacagaaaattttagggttgtcatgagttgggttgccctgaaggcaaaacctgagacaaggacttaggtgcaggagtttatgtgagagatgactccaggaagcagagatgaggaaatagggtgtaaaaagggaagagcaaaagccaactaagggtacattatcaagtttaccacttgccaaaccagcaagaggctggtttggccagaacctccagagaagtacacagcttgcctccagaactgttcacctgaatcgcaaaggccggagcacttattcacatgttcaaatgcccagtggctgagagtagcctctgagggcatttattcccacagacgtccaggctcctcttcagcccaggccatgcagactcccagcataagagatgcccttggggaagaaagcagaaaagcagaaaagtaggggctagaggtgggaagctgacttggacaaaactggtcaccacagttgttgctgaaatcagagataatttcacagagggactgtgaaaatggccacaggggcatctgccacaaaggtagtgttggtgagaactaggtggaaatggctaatcattcagcccaggctagttaaggagaaaaaaaaagaatgctaagagaaagtggcttgggaagttttctaaggtctaagctttctttcaatgatttttggcctctgcataaaaatatgaacttagggacttactaatagctcaaagttaagatcatagagaaggcgttgtactcctctaggtcaagggcatattaaccactgatatttattgagcacttactatgtgccaggcactttatagtcatcatcaaataaatcatccctgcaactgtatatactcattagtattgttgttcccattttataaaggaaggaactgaggcttagagagtttttaaagcttttaagatctatgaggtaacaacctatttcattttaagtgtatgtcaataacccacacttgcatccttgtgttcgaacacacacacacacacatacacacacacacacatacacacagtaaaatcagatatgaggaatttctggttttactagagaatttagtttatttatcttccctgtctatttcttcattacatggataatgaagcacttctagactctttaatgaatacatttatttaaattttaaaaaatttataccaattgatcaatgtgttttcatcaaatacgtggactagaaatacagaaaataaagatgtttagatatagaaaactgagcaaaaaccagctacaaaataccaccaaaagcacagagctagttgaagtcaaaaaaagcatcataaagggaaaaactaaaagcatctaaatacagaacaaaaggcaaatctgattgaaaacttgtctgcatctttaatttggaggctcatgatcatgctggaggtaggaggcaaaatttaatttaaggagaattttggccaaccatcgctattttctttaacacaagaacaaggagggagagggaatgaggtagacaacatccacggaggaccaggtgaaggaaaagcagagagtgatcatatcccatatccccagacacttggattagcctcagggaggctggttaggcaatgccaccaccaccaccgtcaccacgcccccacccccctcacccgacccacccgccactcccagaataaagctggtttgtaattagtttaggctgtagaggcttgtatcattaaaataatgaccactgggcatttgccacaaccaagataatgtttcataatcaaattaacttggctcaaaaacttgatttggaacctgtttatggttagtcatcaaacagctttcggggtgcttgaagcataagatatgcaaaaaactaggtaagtagtgcatgaacacagaatcagaggaaaatgtggctatgttttagtcacagagtacttacaatgggggttggaggtaggaggacagtgactatacaagaaaaggatttgaaattgaccctcaaagaactgaatatctttttaaataaaatgacaatattaaaaccacatgcttaaaatacgtacggctaagtgcttcagcagagactgggataccagatcctgagttcctcaaaggcaggagtgtccaagtcattcacttttgcttcaccggagcctaacacattgcctggagcagtgttggtactcaggaaaaccttctgtcgaatgaaggactatcatgctgttataataattaggagaggacaacatagaaacatggaaaacctttttaatctactggaaagtgaaaatgatatgtcaatggattgcaaccatgtgcaaaaacaggtgtgtttgaggacaactagaagataaggtggcaaaaatgaaaacactggtgtcaggtgttaggattctgcatgtattgttgttgtttctaaaactgcatttaatgttgtcagaatataatctttgtaatttcagaatctagagatgcttccatgttggagggagggaaggaactggatactcaatgaactgatagcttacaggcaaaggttcaaactccattgcttagcactgcagactctttgtggcacagtccccaagaactccagttttatatcatatccctgctccttccttcttccccatcacactgaatagtttgccttttctaaaacgtatcataggtttcactctttttttttttttttttttttttggtacacactcttctcactatttgtaatgcccttgtttccgtcccttcttcatatggctaaatcctacccattcttcaaaacacaactcaaatatttcccctctgagaagctgacctgattccccacaccctatcccagtctcaatttttggccacgtctctaagtttctatagcaacttatgcgcttacctctttcagagccctgtctcactatgctgcaatcactggtgtacttgcctttctcctctactagcctggatgctacctacagataatgtaaagatacctggggctacaaaggccagtggatgacccactgtcttttttaccaaactgtgacagtgtggtcacttagtcaagactcttttggttgcaagtaacagacatccattgaaactgctttgagcacaaaagggaaatttatttataaggacatagagatacttctcagagcccaaggttagaaagtgcagacactgaggtctggatcctggagctagaaagcctacagaatcaaggcagctactctcttagtcaatcagtcttactctctccccatacccacctctctccctgcagcctcacacagtcttttaatctgcatatctccagaggcctgttgtattcctctctctttctttctccctctctcttgctccgaaagacagttatacagtggctacaagtatgagctcatactacctgtgttcatgcctggctctgccattaaccaactatatgaccttggataaattacttaaccgctctgtgactcagtttcctcttctacaaaatgggaataagaagaggtcccacctcataggagtattacaaggattattgaattaatctaagacatggcttcccactgctcccaagtttacacatctacctagtctatctacaaatatgtcttagtccaagaccacacttctgagaaagacaacctggctggtccagcttgagtcagctgtggatctttgatctactgagccacagcctgggagccaagttaaaaacctgatcaccagggcccatccttgaagataaagtgacagttcttagagaaaggggccatgggctgagcagacaccagaaacaaaaacctgctacagccactaactaaccatgcagccatgcttgtgggcctgcctaggattacagctgggccttttcacctcatggccctgagcaaggctcgtatttaaaacacacagctgcctgtcagactgcaatgacacctaagggagctccacacactggcacttaataaaggcttaatggtgatgatggtggcgctgacaaaaatgacggtggcacaacaggccatgctattgcttcccagcagttctctgctgggccccgtggcttgaagttgaaatcagcacatccttctaactcggctaatgtggcttggctctggggccaaccctcatcagatcccatccaactgctagttaggtagatttataccccactaaatccattgtcacacaagggcttcctcctcactgccagagtgtaaagaacatagacacagcatccaataaccaaaggaggaaaggcctccaaagaaaattaaccatttgacttcaaaatgttatgctgctgctctagaatttccaaccaaatgaaatcagctgaaggtcctgcatctttaaataataaaaaaataaagaagaaccacagctgtgggcccttactagcccataaataaagccccgtatgcaactctatatcaaactttttttttttttttttgagacagagtctcactctgtcaccaaggctggagtgcagtggtgcgatctcggctcactgcaacctccgcctcctgggttcacgccattctcctgcctcagcctcctgagtagctgggactataggcatgtgccaccatgcctggctaattttttgtatttttagtagagacgggatttcactgtgttagccaggatggtctccatctcctgacctcgtgatctgcccgcctcggcctcctaaagatcaaacttattttttattgcagtataatctctttaacaaaaaacaagaattgtagaccagtacatctttgctatgaactgaatgtctgtgtcccctcaaaattcatatgcagaaatcctaacccccaatgtgatggaattaggaagtgggaccttgtttttagagatgggacatcaattccaggaccagtatcaagatctcacatcattctctttcacaaaaatagtctgcctttgaatttttagctctcggtgataagtaaactacacttattgtagttttttgcttgcctcaaatcctttgtagaagtaggctggaaaataaataaataaatagaatttcctctatgaatttgaatagcagagtatgcatgtaatagacgcttcaataaattttgctgtagcatgaagaccaatctcattttcaaatggtgaatcttggctcatgtatatgtggtactataatcttacaagtagggtttgcggtacacatcactttaaggaatgctggtactttaagtgaatttgaatagcaagagcggtctaaaatcagtcaccatcactgagcacagtcatttgaaagcctgaaattcacttttagaaaattcatcagaaaaaaagattcaaaaactggcaacgttcactcacagatcaaagacaacctaagtatttaactcatcatcatctatgaggataacgacttttaacagctgtccatgcaagagaaagcaaaaaaaaaaaaaaaataagaaacaatgagaggcattaaagcataaaggtcaagagcactttgggggcagccagccctaggtcaagaagtcctgactgtgtcatttaccagctctgtagctttgggcaagttgcctaaacactctgaacttattcagtcttccataaaacatttaaataatagtgatacctatcttattggatttctatacttaataaacaatgaatatgatgatgacgatgatgtctgcttttactatgaggaaaatgcattcagtaacaaatataaggaaaaaaatatagaataagtaaggagactctttagctatccttatccactaagaatacctaagagtttgtagtaactggcaagggtgtatatataaccagcactgaacatatcatcctttttgctattagagagtatgcaaaagaggaaatataaagaacggctttgctttgatcataatcaaagggcgtgggtaatctccttgagggcaggaactatctgggtcctattaacctagcacagacagtatcaagtagcaagcatacagtcaaagcaccaaatgaatgcaagaatgcctggatacaccctgaatatgactacaatcaaagcccgaagctcttggtaggtttcactggcctctttccttatatctagaagaacgtcctaccttcctggtcatagccaccactgaaataatgaaaacaaaataacaaaataatattttaaacatacatagcataccagttcattaaaaatagactagggagtattttacattgagacactagggagcatcattactttgaaatgtcactttctgctttaattagtatgctctaatgataagtatatgccattcttatctaatgaaagtcttgaatacatacggaatctggttcacagtcctcgctgggaggtacacggatgtacaaagaagaaacagaatgcatgtgttgatgtcaactagtttgcttacctttattaacataattgccaaagtttcaagttttacaatttgaggatacatatgttcaacacacccagaacacttggcacagtcatctgatcacctttcacatttctcaagacagcctaagctgttttagggagatgtgaagtttccggtgatttctttcaagccgactctcgggggtatcactcagaacaggaccacctgcttggtggcatctttttaataaagacagcaataggtctgcttgctcacagggaaatttataaggctgtctttgcttccttccacctattgtggtgctttatccaagtagaatgtactcagtcttcggagcttcaaagacactgataatggacttcttttcaaagagaagtcttagtcatccgctcctttcattcaacagtcagaataagaaaggcccagagggatacagacaaatacctctgagctgcctgttgtggcaatatcagataaagaaattctgtagcccagagagatatttgatccgttcatttgaaagtcaatactaaacatccttcccagccactccacccaagcaatgagaatgtgtctcagaaacaggacacagaaactatctcttacgatgtagcttccacttcttttttctagcctgagtgggttgggttgaggaaggagagaaagaaagaaatcaagaaccaatgttctctgctttgtgtttccctgattcagtgaaaaacggaggtcatttatagcttcttcaattggctgacccagaggaggctccagctttctcaggattgtaatggcaatgacatttctcaaaatcagttaccaagttcgtaccagttcccagcaatagaatacttggttactcagggcttctttctttgggaaatctgcatcaccgggatgactgcagttcacccaggccctacaatgggttctcatttactactcaagtttcatgcagatcatctcattcacacaagcctacaggaccaatctgcctcccagagccatggctctgcaccttcacaattgcaaagcaatttctcagggggagtcaaagcttcacttgctttttacagaaatggctcatggagatattatcttaaaatgctttctcttaaaaaaaattttttttttatctgagaattgcatgctgtgctgaaataggatggtggtgggttctgattatatcttttttccaattttggtttcactcttaagtatagaaaatatcaggttgctctctcctctgattcccttttctcccagggactaaaactttagtctgctgagtcaaaagtaagctttggtattaaattccatcttttatcttttttctcccaatatctaagaacaatgtgattatgcatcattttgtactacagaagtgctgctgagaactgcatgcaaaataaatcaagtcaatgatgtatttgaatgtgactctaatcactgaggtgggaaaaagataccagggttctactttagactgctaacctgctgtgatcaccttacctcctcttttaaatgagtgggctggaagtgctccagctcatgtctaaaatttagtgtgcttcgctacctcatggcataacaataggatggaaaaccatgcaaccattaaaagtgatcattacaaaaatgacatagaaaaagaaaaaataattgttataatatttaataaaaaattattccacaaattatctgtacattaacatttttcattaggacctcttaagccatgccattatcaaaaggggcaattcaaacatatcaagagtatctgttaatatttaaaattaggctgttagcctgtaatgaacatattttaggggaaaagctagaagtctgacacatagaaagaaagaaagggaaaatattaacctacaaaatcctttaaaaaggtagacttaaagctttttttcactatcttagtgaagatcgttaatatgtaccttacagtgtattttaaaattgtgtttctttaccagggaatttttttttatctttagtaaatttcagatttgtttcttacctgcatggaatgttacccttcccttaccacaatatgacaaaattaataatagccttacaaattgtgaagatacaagtttgagggaaaagataccaactgctttttaaattacaataatacatgatatcaccatttcattttatttaaaagaaatgttttacaacagaaatcatccaaccaattaacagggaaaaataagatggtgacataatccttaggaaggattactgggaaagaaaaaaacagtcatgagtacaacttggtataagtttctaatgtttatgtatagtgtatgtttatatgtatgtataatacattataatatacatagcatataatatttagagtgcatgcatattatgtgttttgtgttacgtgattgtttttgagagatagttgcttacactattggaaaaccactggtcatttggcatttctaaacagttatggtgctgcagaggaaagcttttgaccagcctttgactagccttggtcttgtcgttatttagcattcagatgtgtcaagaaaattaatacctaaaaaaaattttctggctgggcacagtggctcacgcctgtaatcccaacgctctgggaggccgaggcgggtggatcacctgaggtcaggagttcaagaccagcctcaccaataaggtgaaaccccatctctactaaaaatacaaaaattagccgggcatggtggcaggcgcctgtagtcccaactactcgggagactgagacaggagaattgcttgaacccaggaggcagaggttgcagtgtgctgagattgtgccactacactccagattgggtgacagagcaagactctgtctaaaacaaacaaacaaacaaacaaaactgcagatctgtttttggagttttaaagtgaaaaattgcattcttttgtctctagtagtgtaatattgacagtccaggcaattattgtcatgctaacataataaatgaattacctttactattctattgccaatgtgcttttttatagctttatttagatacatttacaaaccataaaattcacccatttaaactgtacgattcattcatttttagtatattcagagttgtgcaaccaagaacacaatcaattttataacatttcctcatcccaaaaagaaagcccatgtgcattagcagtcactccaatttccccgctacccctgcagccctattaatccactaatctactatgcatatggatttgtctctgttggaaatgtcacataaatggaatcatacagtatgtgtccttttgcgactagcttctttcacttaacataatgttttcaaggttcattcacattgtagcatgtttcagcacttcattactaattatggccaagtaacattccattataggaatatgccatttttgtttatccattcattgtagatagatatttgaactgtttccactttttggcaattatgaataatgctactatgaacattcatgtacaagtttttgtgtggatatgtttttaattctcttgggtacatacctaggaaggtatagaattgctgggttatatggtaactctatatttaacattttgaagaactgtcaaactttttccccaagtggttgcaccatcctacaatcccaccaaaacatatgagggttttaatttctccttatcctcaccaacgcttgttattgtcttttctattttagccattctagtgtgcatgaagtggtatctcactgtggttttggtttgatctaatttgacttccctagtaatgagtgatactaagcatctcttcgtgtgctattaaccatttgtatatcttctttgggaaaatgcctattcagatactttgcacatttttaaattgtgttatttgttgttttacagttgagttgcagaagttcttaatatagtctagatactagtccatcaacagatgcaaaattttctcccatctttgggtatatctttttacttttgtgatggtgtcatttgacacacaaaagttttaagttttaacaaagtctaaattatctattttttaaattttgtcacctgtgcttttggtattgtatctaagaaacctaactcaagatgacaaagattaattcatatggttttgccaagggattttatactgttaccttttaaatttaggtctatgatccatattgagctaattgttgtgtatggtgtgaggtacaagtcctaattcattctttgcatgtagacatccccagttgtcctaacaacatttattgaaaagactaatatttctcctattgaattgtcttggttctttagttaaaaatcaattgaccataaatgcgagggtttatgtctattctattgatctaccttttttgttagtaccacacagccttaattgctatagctttgtagtaagttttgaaactagtaagtgtgagtcttcaaacttctttcttctttttcaagattgttttggctattctggatatttgcagttccacatgcaatttaggatcagcttgtcactttctggggaaaaaaataaaaaaacagctgggatttttaaagggattccattaaatacatagatcattttggccagtattgcaatcttaaaaatgttaagttttctgatccaataacatggcatatctttccatttatttattctttaatatctttcaactactttctagttttcacatcttatacttctgttaagtttattcttagatattttattttttggctgctattataaataagattattttcttaatctcttttccagactgttcattgctagtatatagaaataagatttatttttgtatattgatcttgtatcttgccacattgctgaactcgtttagtagttccaatagttttttagtgaatttgccagtgcacttttaacttaaacttttaaattattttgtccccatcatacttataaacatcagtgtatgctactactgtaccacaattatccacaatattgagcaattaaatcctgtctgccctaagctctcattcagtcccttcaattaacccttcaggctgatgatcactctccacaggaaaggagaaagcacgacataaaacaaattacttctttcttaatcctttctatttctagtggttagtaaaaccatacagagtagtaaaatgaaacatatgctgagctactgaaactcttctgcctagcattaccttgctaaaatgaaatcaagcaaaatggaaccaaaagtggattttgacatttcatattttgctgaatactgttagggctctggcaatcactgtctcttacatacaaattaacagcctaccatctgtcaagtgttgggataatcacagggtttagtgcacaatatggttattagaatatgacctgacaaaaaggaaaagaacacaacctaatttggactataaaatctatgatctcacttgcaaacgacagtttgacaagctattattctgcattttggcttctacagtaaaagcagttttatgcatacgtaattctgttatacaggcaacagcccatagaagattgctttaaactacagaatctgcttggtcatacaatattttttaactaattcttagacaaatatttgcaccatgaataagtaggaatgtaatgatctgagccttcacatttccaagtgaagcaccaatcattaggcaaaaaatgtctttgtgatattgctgccagcagttccatagaattcctcagggtatatgcaaagaaactactgtaggaacttattaaaactattcacatggacatacatcaaagtcaaaaagttgacagttttgaaaagtgtaatatatgaaacactttggtgtggaatttacttcatccccaacagtgacatctgctaatgagcatcattaatattgcccacttttatttatccaaatgcctcatgggtgatatctttatgtacattcctctgtagcaccttttgtttccacccagtggaaataaatcccatactgacagctgcctctaataaagatgcttccaacaaaactcttctggttacagagagaacacagagtaccaagttctttttgttgttgttttctacctctcaaaacagtgcagaaatgagtattgttcctgaaggttatttaagggtacacccagtgtgtctaaaatacatgcctaagacagaaatgtattaattaagtctcaaggcaaaacgttctgttgaggcgacaaaacaaaacagatttttaatattagcagttatattacctagggagcttaggcgagataataactatataatacattaggcaactcacactgcaaattatgttgctttgttttagactacacgtttttccattattttcatacttgtttcctttgacggtagaaaaaaatgatgtatttttctgtcatgttggctcactataaggtgagtcagagtgccaaggttcttctgcaaggaatcttgggatccaattttaatatgctgcaatatgaattttaagaacagtgtgtgatgaattgtcaggctgcatgatatccccaaatttcccagtattgagaccttcatggctattccccgaagataacaaaaaaaattcgatcaagatttatagaagacttataaatgtatgaaaatataaaaaaataatagttacatccatgggtttaaaatgattcccctacagtggcaaccctgtatgaaaatacaatatgagatcagggagcagaaaaataaatgaagtaaagatttagggagaatcatggcaacttattcatttacaggaaagccagttcctttttcacccttggaaaaaactacaaacaaattccaagttctttctagctacaattgacattatcatttggccagtatattcatgataaatgttctaatgtgaaggcgatccatcataaatgtaatttcaaaaatgaacttcttattttaacttcagaaagaattattctaggattcaaaagtccagttaaatacatatagaaagaaggatagaagggagaaaagtttaaaaaaaaaaacaaaaaactatgcccagacaaaagactggaagaaagttatttatgtgatgagactatcgatgatttattttcttttaatttttattaatgttcgaaacaaacacacatcatcttttaatgaaaaagaaattctatatgaattattttctctctatggtatatttagagggataacttatatatagtaaaatacacaaatcttaagtatatggctccatggcatttcatatgtataaacccaagaatcttccacctaaaacaaagtatgcagttatttccagaaaattacctcctgatcctttctagcaatagtctcctagctccctatttttctggcttctagtatcattgattccttttgtcagctattgaattttacacaaatggaagcatacagtatgcattcttttgtttgtggcttcttttggcaacataatgctttcaagatgcatccatattgtatatatttgttgtttgttcctttttgttggtgagtaccacctcattgtatgactatgtcacaatttgtttacaatgatgtctaaggatagacatttggattttctcaagtgcttggctattataaataaaacttccatgaacattcttgtatatgtctttttcatgagcatatgcaataatttctcttgaattaatacaagggaaaatatacgacatacagtttttaactttaaggcaaggtctaatatttccttttatggttattttattttaacagtatatttaaaaattcataacttattggtttcaatctaaggaaaatgtaatgaacaaaattcagagcataaatttgtaaaatctcatactcctagatgaagagttcaaaagaagagaaagaagttatatgccccagtggggactgcttcttctggatcttcatgccacaatggaaagattctcaaaggcataaagttttccatagaaacactctcaatctgttagttttaacaattaaaacttacgtttaactgaaagtatagtagagaaagaaaactaattgatgaaactaaaagtaaacctctcaaataattaagaggcaaatatttcagggctgaaaggtcatcaccagtcacagaaaacattcagagaagtgagaaaccattgaaattggaccagtggatggcagagtaatagatggtatttccatgacatctaccccatgccaggggaaaagaagagaagggtttactttgggtacaatgacaaggacaaccttctgatatgttgctaaggatcatgcctagggtgactataaataatttattatccaaaatgagacacttctgagactgaagcagggtaataaaattaaataaaagtaataaataaaaattaataagtttaataaataaaaattgttttatttatattattaaaaataatttaattttttaaatatccacctgttgactgaaaaattggttttattttactggttgacagttgaaatacagtcctattctaaaatgatttcccaaagtaaaattatttttatttttaaaaaatgcttaactgggccaggtgccatgactcacacctgtaatcccatcattttgggaggcacagatgggaggatggcttgagcccaggagtttgagaccagcctcagcaacatagtgagatccagtctctacaaaaaatacaaaaatattagccatatgtggtggtgcgcacctgtagcctcagctactcgggaggctgatgggggaggattgcttgagcccaggagttagaggctgcaatgggccatgattgtgccactgcactgcagcctgagaccctatctcaaaaaaatgtatatataaaaaaatgctaaactggacaagatgcagagaaaactggtaaaaactagggctatcctgagcaaactcagatgcatgggtacactagtcaagtgtcacctccaaccctctccagttaatttaccaaggtacctataaatggagcctaaggcactgcccctgtccttttcttcattcaacaagtaattgttgaaaatcttccatatgtttggcactgtcccaggcagagagatataatgataaatgagtccaactttccttggactcatggaaccttcaaactgtcagagaagacagccaaagaacaagttactaaaagtgtgctaaatgtgaaggaagatacagagcccactgagaggcttttacatggtagtgatcaatggggtttgtattgtcccctagagagatttttttttggaaatgtgaggagcggtggggagctctctatgttccttcttttttaagagatggagtctccctatattgcccaggctggtctggtctccacctcctcttgagctcaagtgatcctcccacctcagcctcccaaagtgctaggattacaggtgtgagccaccatgcccagccatttaactcatattttctgaggggcaacaaggccaccaaatgttcttatgtaggacaggcccacatgatgaaaaatgatcctgtatccctcataactttcaaatgttccaccagacattcacttaggtaaagaaaaaaaatattattgtctattttacataatagcttaaagtatcttttgcacattttaattttcactgaatttttcagaaatgcaactagcatttaaactgaaggaataatgtattttgttttgttcaacactttaccagttgttcactatttcagaaaatcccaccaccgacagcaatggggcttttggtacccagtctaccaatataacacaactgtattagtttgcattcttatctgtcaaatgcaaatacgtaagagagaaataggcctagcaccaaatattattaaattggccatgggacatgaaagtcaaggataccaccaaattgcattcatggaaagcattttttttatatttcattttactgccacagtacatacctttaaaaaaaatctgtagcacaatgatgagaaatctacactgtgaaaattactgattaaaattatttacttactttggatttgcttcttgtttctcagtcttacagtgaaactgtccctagaggtctcccacacaacttctttatggcttcttatattactgcttctttttccaatccattccctattccctgtggcctaccgaagtgctttttaagaactagagaccaaatgtatgcatcaacataagacatgatttcaagatgagaggtattcttcctgtgattcttcaacaccactcagtcccttttcataatatagggaatgactctgcagctacccttttaagtaagtcccactcatttccaggaatggcatacttgcctatgttctctacctcaaaactgcattatttatcttagcatgttagctctacttcaactaaggttatttccctctttttctcatcatgtatattactattaatatgtatccaaaggttagcttttattctagtatccctcaaacctctcatctttcatttcttgtactcatttcacagaatggcttgtgatattcttttcttttcttttttttttttttttgagatggagtctcactctgccacccaggctggagtgcagtgacgtgatcttggctcattgcaacctctccctcctgggttcaagtgattctcctgctttagccatagctgggattacaggcacatgcggccaagcttggctgatttttgtattttcagtagagacgggttttcaccatgttggccaggctggtctcgagctcctgagctcaactgtgaggagaaaataaaacccgcccacctaggcctcccaaagtactgggattataggcataaaccaccactctcggcctgatattcttttcttaaatccaatttcactcatatcaagtagatataagcatttgattaattcattatgtcttcaagtagagttgtgcccaagcctttacattggaatacttagcttattgtaagccacttcccttttctttcttctttatattgtagttaaccatcataccatttttttaagtatatgggtgggtaggtaatttctataaagttcaaaagagggcagttaatctgataggattaaacagttgactggaatctaatttggggcagagactctttaggctgaaacttaacgaatgggtaagagttagctaagtgaagggaaagtagatcagggagatagaaaaagaggccaaacccttgaaggcagaagaatcctcagagataacagagcagagagcttcagctagagaactggttgccaaaaagtggtaagtgaacccctggaagcacacagctgaacttttgctgataaaaaggctaactttttaattttaatagattcaagtgttttgaaatacatattagaagaacagtagtttccatttaaggtggcaaaacaatttccttgtacaattaacttaaatattagcaaaaataagctttttttaatagtaagtgttggtacaaataggacatgaatatggtaaatacatggcttctgaatgactgaagttggggtgctctgacctattagcatggaggttggagaaagaggtagagctagagatgagatgagaaagcaagggcttggtcaggcaaagtcctacaaaccactgtaattattcaggtctttgtcttaaaagcaatgaaaagccacgaaaggacttcaaacagaggaatgagaagatcatagctgtgttttataagatcagtatggcatctaatgagaaatggattggaggtaggaaagatggctgtgggtagacgagttagccaacttttccaaatgtttaattcaaagacaatggtggggctgggtgcggtggctcacacctgtaatcccagcactttgggaggctgagatgggaggatcacaagatcaggagatcgagaccatcctggctaacacggtgaaatcccatctctactaaaaatacaaaaaatcagccgggcgtggtgacacgcacctgtagtctcaactactcaggaggctgaggcaggtgaattgcttgaacctgggaggcggaggctgcagtgagccaagatcacgctactgtactccagcctgggtgccagagcaagactccatctcaaaaaaaaaaaaaaaaaaagacaatagtggtccaagttcaagtgatagcagcagagatgaagaaaggaagaggaaattgagagataacatctcctgaaatccaagttgccataaattgaaaaatagttggcttaatgatagcttggctgataacatgaagaaatagatgctaagtgagcatatcaattgtaagatattgcttcagaaacattaaaatatggaaaatccatgcttctttaaatagaggaaatacaatttttaaagggtagaaaagagtgtgtagacactaaacaaatgactgatgatagtgaacccccagttggaaaaagtcaaaattgccagatttctttggcctcaaactgctaaacatctaatgtcttgggctttattcactttttgtctttgagtgacatgacagatcattttggtgatatagatggagctcaaattgacaaggttactggagaaagtaaaatcaaaaatcctttctcaggtaaagatatacctgagtaaggaatgctgaccttctaatatcagaggcctaaaacttgtaagtggaagtttgcttacagaagacaatgttcacagcattctgaaagtcatggccaggttgttgctgttattatgaaaatggtgatttatagccaatgtccatagcctaggcctcgaggtatgtttacaatttacagtaagaggggcccagccttaaattattgttagcaagtcttgatattattttgtaaaaaatgaaatatgtaaacacatacatatcaccttttaattttatttcttaggggacaagggaaaaaacacagtttgcaactatgtatatctcctcacatcaaagtttaactcctcaagatgaatacattctgtgcctctgctcccaacttgaagaaatttcaactgctctattctttccacaactgcccattgtcttaaaaaaccccaaatcgctggcattttaaaaattaaatacagtatattttctagaaagaaaaaataattaccaggctcgcacgtggcagattcctctagccatgcaagcctggatattcatgaaagccatttctcacttggctcagggaaacctcccagaatgataggaccatttacactaaatgaaccgaacatattactggagtaacaattgacattaagtatattacagctgccaggggcagtatcaggaagaatccctggatgacagaaaacatgataatgtagaaggaagaacctgcagaatcagaaaggggggaaaaacccctcataaaacaattttaaaaatatataaagaggaaatcatatttaaaggaaaaacagagaaattttgttattttttttccttctgcctgcagtagccttctggtattagacctgcaatgcatttgctaccccctaaaatattctcaacactaacaagatcagaggaaatgatttattccaccccctctcctgctacttctgaacggcagcgcgtgtccttggggacatgggatttctgcattgctttcggccatctgatattgcagctctgcagccttccctggaatgagccagaaaaatcaaaataattacattaatgctgggaatcaaagtttattgactctcccttgaggtggaaaaccaaaatgctggttacaaaagttgccagcttatttaatgataccactgcctcctccctgttcttgtcaaaacagcttttgaaagcattttcaaataaagccctcagatgcgctccaattcaatagcttatctattcccttttaaataaaagctagttcacatcatctcaccccctcaaagggaggacccgacaggccctcttcccctgccaaggcactgccaaaggcaatactcccaggcaatatccctgccatcatttccgctctcttcaggaaggttctgcctcattgaatattcttccaagccagtaagagaatctcatgcctccccaaggcagcaatctacatttattataacattcatggctgctaatgaaacttggagcagctggtttctttcactttccaacaattctttggatattcaaagtcccctcataagagaggggaacttatgagcacacccatttcatggatgagcccgcagacacagagattcaatgtggtgctgacctttgtaactttcacaggactttgctacagccctaaaaaaacagatgctaaataataattgattgaattaaactgaaggaggtagattaatttttttaattaaactgaatcaaatagaacagaaataaacaaactctagccctctccatgcctagtcaacacctactattctttcttgtttcttttttttcctttttattataaaagttttcaaataaaatgagagaccagtataatgaagctccaagtacctatccacccaggttgaacaatgatcaagattttcccacatttgcttcattcatcttctcctttttttcttcttcgttgaaatattttaaagcaagactaagacagcatgctacttcattcctacttttgtcagtgattatgctgtgcagaaaagagttaccatagaaggcctgaggttgctatttttagaatttaaaaaagtttgcaggtaggtaggtaatatctacagacttcactttatgatgataaaagagacataagagaaatagacctgcttgcaaagttgactcttggctggcatctgggaacatggatttgggaaggttgccatcattcccagaactgataagagtggctcactgtgcccgaactgtttgttcaaataatgaaatgctaaatgcctgctttccttctgggagtctaaaatgttggtatgtgctagccagagagtatctacgtgaccagcccccaataacagccttgggtgctgatgccctaacaagcttctctgttggacaacatttcacatgtgttgtcacaactcattgctgaaggaattaggcatgtcctatgtgactccactcaaagaggtctctcagaaccttgcatcaagtttcctctgaagttcaccccatacgctttttccctttgctgattttgctttttatcctgctgtaataaatcatggctgcaagtacaactatatgttgagtcctgtgagtattcctagcaaatcattgaacctggtaatggtcttggaacccctaactcatatacctaccattttttaagtctacttaaacctcactttttcacagaaacattggtgaccttggggagatgccaaactaagggaggccccggttatccattctcacagcaccctgaacttcctcttcataacatttatcgaaacggtccctaaataatgttgaaatcatttgtttgtggtctatctctccaccaagaacccaaagtccctgagacaggaattttgtctgtttggtttgccatgtatacctagcatggtacacatggtatacatttaaaattttaaatagattcaagaaaataccatacccctcctccaagtttaagaggtaaagtttatataatttcccttgcattacactcattcattcaccaaataccactcacttatggtataatctatactgtgtcccagttcagtttaatatccacttcattaacatctttctgtaattagcaacatcatgccaatgcttcaccttttaggtgagacaaagcatgactctgcaagggggctttcctcttgacactggtgactaattcatctatttgcatcacattataggaccctctttccaccttacaatcctctagagattctcctgcaaatacagactcttgagatgattcttacatgcctactaaagtttggaaaaccactgttttgggtcactcaaaaaatgaaaaggcagctataattaaagaaaacctcatggatatgattcttcacctgaatttttaaaaagataaataaaccacagactaaacataaattttgctaagcatattcaactactgaaaataccatacgacaacagagagaataaacatatattcctttaaagaaaagaagtgagttgtccatatgttgtaagggatacatctatatatatatacagattgtcttgcacatttaatgtgtgcgcagaaatgggtcaagtagattatttttttcatggtggatgaaagtaagatgtgatgagacacacttgaatggggattggcaagatttttaaagattataagctttgcgttttcatataatctaccatcctgcaaattcacttctgagtatatattaatacccaagagaaacttgagcacatatgtcaaactccatcagtgaaaggccaccaggaacaccctggtagtcaaagttaagtggttcaccttactgtagcaaaggagaaagtaccccagaggaaccttgggagcatcttagtaaaggggaattatcagtggcttcctctagggtttggggaattgaaacaaactgaagtttgcccagaagcagcagtcactctgagaaagacagtgatagtcagaagaaaggggtgtttagtcatttgtagggtcacagaatggctttgtttatgccttgttctgagtattgtttatgttctagttgccagtagagccatgttttactttctcacatatgtaccaggaaatgtgtataagaacattcatagcagcaccattcatagaagaaaatttaaaaatttaactaaatggctattgataggagtacatataaaacttaaaaaggacagggaatgatgaacatgaggttagtagttggttacctcttacgaagaggtagagatgggataaaagggggcacaaatttgtaagttattggtaatatttacttgttgggtttatgcctgttatattatgaaataaatattataaaataaaacagaatttaccatggatgacagtgagtcatgaaccaaacttataattaatctacctctgtgacctgaggtccacattattttaaaacaaacaaaaaataacaataatcattcatatttacgtttccttctcagccatacattttcttttctacttagcattttccactgtgacacagtaggtgccagttgtgtttatacagaagctacaataaacaagactttttattaaatgcaaatgtcaccacgcagtagaatcaactattgactttgtgcaacctctcatcaacagaaccatcaatacgtctagcaaggcacaggatttattgtctatgcacacctttcagagggcttcctgaaacacaactagcttccataattggtaaccaaataaaaccgcaggccaccagaagcagaatataactctctctaggaagctgtaaattaaagggagatttgtctaactaaatgtacagtgctgcactcacatgggcatttcatctcttgctctttaatggaggcagtccttgtacccctacttcacattacgaatatggtttcatctctgacagaaaggccagagcacctggcagagtcctcacatgctccctccttttaccttttccattgcattaattaattagaactgtctttatattcagtgacatttgattttgaggacatttttacaaaataacaacaccaggtccaagttcactacagcaataggatctacaagaacccaaagaatgaatgctttttagcaaatgagaacacaaagtcacatgatctttatttttaaaaagctcataaactatgtcaggcaggggaatcacattgccagacaccataaaacaacatataattaaactctagcagtccattagaagacctagtgacaagcccttctccactgctgcaacaaaggtgggatgatttacatgtagactgggaaaagtcccatgatattagaccaaaatccagcactgctgctaatttttttagactgaaatgtgattgcccaatattaaattgttaccattagtggggaaaaaatagcttattctaacaaatacttaatttctctctagctttggtgcagtcctgacttgtagtttattctaataaataatttaaaaataattttggtcacctcccatatgatccaaagtaatgctatttgagatcaataggactaacattttctatctggtatccatggagttttttatccaatgagagagaacattcaggaacttagcctgtctcatggctgaaaataggtagaatatgttaggtgtgcgtttgatacaatctgtaaataaaaggcaaattataaaagttcccctccctgcagagacgaagtcccacaatagggtgcacaagctgcatttcaacccccacccacacctcagatatgcatcttcattcagtgcacagaagactcaactgtaggggcggcctggatacacatgccatgtttcttccttgcccacttggtgtcttcacatccccttccccttaaaataatcccattagttgaaaagttcctggatacaaggagcagccatcaaagtccatggatggatttcaaggggatgaattcatttaacattattaaatgtttactttgctaattctcaatacttgtacacaatataagacatgatttcttctgtctataatatgaagtctgtgattagagtaatatttcaatttttggtttgtttgttttgacttggaattagcagtaggataccaacttaagtcaaatttactagttctcattttccctaattcagcatttgttttcatctatagaattccttttcttaagtcaggctctttggggtcatcagccccctgaaatcatgtgcaaaatgggatgcctatgtgcacatgcctctttctgtgaggatcggtacctgagaactttgatgccaagttaaaaagactgtgccttgagtttttgacactagggaatgaaggaaagtatgagataaagaatatacaacatctgccacaactactgcatattttctttctatatcacattcaacagtttattacaatcaccaggcttttcattcccataaagcaatgttcagacttcaaatgtgctaataatttagctggagaatttgagaaaactacacattcctctccaacacccccacccccacctccttagccccaagaatcagatttcatcactctggaagagaactcagatatctgcactttttacaagtgcctcatgtgattctgaggcaatggtgagagacccaagctttgaaaaacgtgccatgatctaccatcaagtaggaatcatgtacataagttcttccattagaggaaaaaataaatgtatttgtttctttgtaaagataggacgttggaaattttcacttagattactctgtaagcgacaaggaaattagaaagctcgttttttacaataatcactgttacttgacagttcctgcagcatgttaagatggctgttattgatgacacttattaccttttcccatgcaataaaacacaggaacatacagtggaagagataagtatattttaaaacaacagaaggaagaaaaataatggtagtcatgtcctctcattatttgtgtagactgactaccatggggaacagtgaaatgccttttttaaagttacactgtggctttaaattgggttaactcagtgaggatagccatgaaacaagtggctatagagatgtaaagaatgggctatttctctacatttctcttttgccttttattttccctatggtctttaatgcatttctctttggaatggatgaagttataaagttgccttacataaaagctttgcttgaaagattggtaatcacgcactttgctactgaattgtccagtctattcaatctaaaaaaggctcttctcttttgttcagctcagattatctcctttgcagagtgtaatagaaatatctgggtataaaattgagaaattgttcataaatattatggaaggctttttgagctgtttactattagaggcctgatttagcaaacagtaagcctgcttttgctgggttgggattttttattttttaactttttccttttaactgaatcatccacagttaaaaaaaaaaaaaaaagatacagatttcacagcactttcacccatgattagagcagaagaaaacaaattgctttttttttttttagatggaggtttgctttgtcgcccaggctggagtgcagtggcgcaatctcggctcactgcaacctccacctccagatccaagtgattctcttgcctcagcctcccaggtagctgggactacaggtgcatgccaccacgcccggctcattttttgtatttttagtagagacgggggtttcaccatgttagccaggatggtctcgatctcctgatttcgtgatccgcccaccttggcctcccaaagtgctgggattacaggcatgagccactgcacccagccacaaattgctatttttaagagacagttttaatatcttgtactacatttggagaagaaaaaaacatcagcactgctatcgcctataggcaactttcttatcttgccatttctttatttaaagtctttgcactgaaccagccaatgaaatgcattattctactggccagcgttctctagcagaaacaagagacagcatgcattactgagaagtcagacacatttgcactaaatcaaaaaataaaaataaaaagactctctagctagaggttaataacacaactcaatcaaaaccagtgacattttttatcaaacagtcgtgaaattgccatttggaactctaacttgctacaaatagaattaaaagtgccattctaattctgtctccttgtacaatacgaccctgatatggaaaacaaggtgtctacactgaacacatccagtttacaagagaaaaaacgggatgattttttgattctctcaaatattaggtaagtgtttaacacatgactcctgagtgggagtgccagttaaagagttgtagtacctgtcaacgctggtttaacatttcaacaaagcaaatcatcaattaaaactcatcagcaacagtcatcctgttaattgaccaaatgattatccttcttttagttaagactctacctgacacacttgaagaaatttttttctctgttgtaaaccctctggagtctgtggcacacctcaccttggcaaaccactttggttttcagattcactggaaagcccctctttgttctaagaggggctcctgaatgaaagccaagttctagtctgactttctgattgcttcttctcaggtttttttcttgcttcctaccaggagaaggaaaaaggtagtcataggccatctgttaaacttgtgtttaaagggaagtaccaaggtatggccagctggatattttactcaacatggtggatcatactcaaggtagtgtataaatggtttagcagtgaattccaccccatacttcttggggtaacatctatgctatcaagcccttaaaaccaaatccaactagctctaaaccataaacatatattatgattcaagcatttgcaggaaaaaaattgtgcttcagtataaaactttgcttcatctagaatataaaggatcccatttcccaattaccatattatcagattctgattctatgaggactaattttcaactctgtaaattatagataaatgataacaatgcaaaataattcttgcctataggcaagcaaattgtgttctgttctctggaggttcaattaatccccctaccccaccctcagaaaccagttttgccctccatttgtaacattcttttcagtattcctgatatataaatgtgtctgggctttttggattctctttagactagttataatatttggctggttctctcattataagttgacctaatctttaacatgttttcattttatatcagtatgagagtcatgatttcacctttatttgagaattattctttaatacatgtatagatcttggactaaggctatcaatttcgagacttcacttgtaggactgtgctgtactcctgtctctcacactctctgcacatgccatttcccagcctggaatgttcttccctcctccccactccagcttctggacctagttaattcctaatcttcactcagatttgggcacaattatagcctccataaacaagcattgcctaactacccctcctctctgccaagaagtttagatctccctgttatagttcttgcacttaacaccattgacatttatctgtctggattttctgactaatgtctcttttcctcactagaataatgctcgctgatggtagggaccatatccggttttacataccattgcacccagttaggtgtctggcacacagaaggctgaaacaatatttgttgtgatggggttcttgacacactaccccaaaatatggcatgtcggcatttgacaaaacagtggaagcaggaaagtctctctgaccttctcccacacttttcccctgaagcaggccataaaagaaatctctagccttcctctaaagtgggtcataggccttattcaagaggcacccttcctatgcctggaggaaaggaatgtcattatctctgaaggcacagagataaagagaaaaatctgaataaagaaggcttgctaagttccccccagtttattatctttagatcacaccccctatgtccaatcatacttctacacaactgtctgctcttcatcaaatttagcataaaaatatacaagtttccctgtttctttgagtcttcctttctccatgtcacataaaacttatactaaataaatttatgtccctttctcttattaatctttcttttgttataggggcctcagccattaacctggcaatggaaaagaaaaatattttcttctcccttgcagttgcgtacatcagcaacacagtagatccatggatcagtgaacaaattgggctatgaatattcctattataaatcagaaaaacagatctagaccaaagctgaccaaaggagaaggaaaaggagagactgcattttgatgtaagtgttactgatttgaaaaaccatggagatcgatcacctactacaaggtccaatggtattccagattctagaaaagacctagataaaaatataaagtctctgaaagtcctctcatcttctccaaagagtcctaaaatccaaaagaacctaggatttctgggtattttgaacctgaacaaaggcaaagcacaaaaagcatggtatagaagaaggcttctcaaagtgtggttcccagaccagcagtacctcttggaaactctcaggcctcatctcagacctactgatgaaatcagaaactctggaagagggaccagccatctaggtatcaacaatcgcttcaggtgaaactgatgcttgttagagactcattggcatagaacaaagatgggcctcaacaaagatggaatcaccagactccactgtaaatagctgtgaaacactgagcaagttatttaagttctctaagcctgagtttacttatgaggaaaaatggggataataacaacaaaaactatcccacagaaatgtggtaagaattttttttttttgtttcaacttttattttagattcagggggtatataggcaagtttgttacctgagtatattgtatgatgctgaggtttggagtacaaatgatcctgtcatccaggtactgagaatagtactcaacagttagcttttcaacccttgcttccctccctcactcactcctccagtagtccccagtatcaattgttgccatctttatgtctatgagtacccaacatttagctcccacttacaagtaagaacatttggttttctgttcctgcattaatgcacttaggataatggcctccagttgcatccatgttgccacaaaggacatgcttttgttctttttttatgactgtattgtattccatggtatatatgtaccacattttctatatccaatccaccattcataggcacctaggttgattccatgtctttgctattgtgaatagtgctgcatgaacatatacatgcatgtgtctttttgataaaatgatttgttttcttttgcatatatcctcagtaatgtgattgctaggttgaatagtagtcctgttttaagttctttgagaaatctccaaactgctttccacagtggctgacctaatttacattctcgacaacagtttataagcatcctttttccccacagcctcaccaacatgtgttgtttttagactttttaataatagccattctgacagtgtgagatggtatctcactgtggttttgatttgcatttctctgatgattagtgatgatgagcattttctcatatgtttgttggccacttgtatgtcttcttttgggaagtgtctgttcatatcttttgcccatcttttaatagagttacttgttttttgcctgttcaaaaaattttgagtaatgtctataaattgcctagaaaattgactgacaggctgggcacagtggctcatacctgtaatcccagcactttgggaggctgaggtggacagatcacccaaggtcagcagttcaagaccagcctggccaacatggtgaatctctgtctctactaaaaatacaaaaattagccaggtgtggtggcgcatgcctgtaataccagctactcgggagactgaggcaggagaatatcttgaacccaggagtcagaggttgcagtgagctgagatcgagccattgcactccagcctgggtgacaagagtgagactctgaaaaaaaaagagaaagaaagaagaagagagagaaaattggttgacaaagaatggatactaatgaaataatagctgctattgaatttatcattcatgtcagtagcagcagcagcagcaccatcatcaccattaccatcaccttgtctagattcttaaggcctggaacccagggttggaagaaactgttgtccttttgcctcatacatcagcaaagcgtgcatagggctcttaggaattgggcaggaggaatccaaatttgtgcaccattactgtcttctagctgatgccaccgttttttgtcagtcatttatactaaaatatactaacttagataggtacagaatttaagaggttacacaagcacttagcacacatgctatctgatcttcacaaacaacctgagagtagttatttaattcagagaagttagtggacttgcccaaagtcacattgccagtcctcacagtcatctgaagagccagacttgaatccaggtattttgattccaaacctagtgctttcttctctactcctcgtctatacttctgttttcattataccaccttgccaaggaaacaaacactcaccagacacactgtagagtaaaatagacctgacatcctttagagttcttcttggatcctggaatgtggttcttattgtctctacttacaaacctcacatttacagaagcaggctgtatttttttaacaccttccttattagcaataattggtcccttctgctgtatgtttgtttgatttttaatacacacagttcaagattaactcaaatctgttcaacaccaatctttctaaaaaccaactttccaaatatccacttgtaacacagaaaactgcagatcgtctttcctgcttccaaaatacagtcactttcataaatgttgtccattcattctagcactgagtgttcataaagcacctactcattgctaggcactatgtgaggcaatgggcacacaggtgtggtgtcttaagtaagacaggtgtggtgctttccatcctggaagtgtgagggagtctggcaataaaaaaatcaacaaataaaagaaaatagccacaggttagagtaagtgccattgcaaagcctcaacaggtaaaatgatgaagtagtcactcacattttcttcaggggctggagaagcccagggaatgactccagacagggtggtccaaggtccacttctcactcttcagataaaaacacaaacaagcatatcttgacacagaaaatctaatgtgaaaatccggtaagtggaaatatgagttgacagaatgggtgatttagaaacggattatctactttaacatgagaattcgatacaggatttttcttgagcactttcctaatacaaatacattttatatttatatccctattaaatatatactatatttaatataaatataaaagttggatgccatttataaaaattcaattaataacaaaatgaaacagctactgccaaaaacttgcatatacagacgttaaaagaaatacggggctgggtgctgtggctcatgcctgtaatcccaacacttagggaggctgaggcgggcagatcaattgaggtcaggagttcgagaccagcctggccaacatggcaaaactccatctctactaaaaatacaaaaattagtcgggcatgtgcctgtagtcccagatacttggaaggctgaggcaggagaatcacttgaacctgggaggcagaggttgcagtgagctgagactgcaccactgcactccagcctgggcagcagagtgaaactgtgtctcaaaaaaaaaaaaaaaaaagaaagaaaagaaaagagaaaagagaataaaagaaaaggaaaagaaaggacaggacaggaaaggaaaggaaaagaaaagaaaaaagaaaagaaggtaccaagaggtggaaaggaacagggagaaagaaaacagttattcaatgtttttggaggcccaagcacagggttttggcataatttatttagtccataaaacaactctgtatttagggatcatccacattttacaacaaaggaaacccaatttcagtgaggtgagattatttgtccaagatctctcagctggtaagtgacaaaaccacaacataaaaatctgatctatatccagtaactatatcccatccattctataaagcaagaattggcacaccacagcccacagggccagacttggacagcagcctcttgataccaccacaaattaagaatgatttttacattttaaaagcactgaaaaaattcaaaagaattatgtttcatgacacatgaaagttttataaaactcagatttccataccaataaataaaatgccattggtacacagccacatttacctactgtctagagctgctttcaaattgcaagatggtgttgagcagttgtgaaagaatcagtagggtcccaaggcctaaaatacttactgtctggccctttacaaaagaagtttgctaacccctgaggtagagaaaaggatccatagaaataaaagtaacaaacactctcagaaatgtgacttcaaaaatgagtgacaaaagtatgcaaaaaatggctataaaatgcacctgaaagaatttaacctaatggcagttgcctgaggcacaactttctcaatttcacctgaaggtttcatttttctggccctgtgtcccagtgaggaagacccaagtcaaccttgtgacagggatttatcacgtcttaacttgagcaatgctgtgttcccaccagcactctcagaatggaggccacacaatgtctccactcctgcattcactggctcaacttggtttctgaagaatgcgaatttagttcaaggcacggtttcaagctgtttttgttgatttcccactatattgtcttctctaaatattttctggttcaagtgcatacgctcaattatgaaaatgaattcttacaaacaacctgatctgggcggatagttaactcacaccatgaagctcaaatttgccagtacagggaaaggtatttctttttcttttcagtcttcaggctacaaggttgaaagccagaagctatgtgttataaaatgtccctagtttttcccatgttttgtagcacacatattgatctctatgtctttgccatttacttgtgtgtggtcatccccaattagtgggttattttgtacttttcaaagttaaattctaagtcaatacttagggcgtacacctaagtcaaagatggcctccaccttgaaggaaaaaaattattacatttcaacgaaaacctacacatcatctataaacacactctttccagctgtctgactctagccttgtacaatgtctttgagctattttgcaccacttcgtaagttgtagataactgatagatatatataaattctgtcttacaggctgtgattttaattgacttcctactgtggagaaaacagttttatctcaatttgcaactcatcttaactctcttttagtccatataaatttgtgccattttgacttttcctttgagccagttataacatctgcctggttctctcaaatcatataagtaaaataaaatctttagcatgtgttcatttttatacctatatgagtcataactttaccttttactgaaaattatattttaatgacccaaaagattagtaagaattcagatttatttcaaaatctatctttaaaaactttaaattttgagtgatttcacctttaatatgaatttagttggaagtaatattaagttagtttaaatcatatagaaaaatgaaatgtgatgagaagtgaacttctttgttcccttttattgcttttaaaatgatacaagacaaaaattgtgcagaggggcaagaaacaaatgttaaacaaaaattattctgacatgtgttaaaatggtaaggaagactttattaaggactattgcaatagcagtattgcaacaggggagagagatcaggttcaactccaaatacaacaaagatagatagtcagggatttatagccagtgttagagcagataaggggttcagtgggtagaaaactactaagaggagtaagggaattcttgctaaattaattcctaacaggattcttgctaaaggcaggccaatgacttagacatcaagggtggggtgagaaacttgattagacatcacggtgaccagctatcacttaaaaagattattgctaaagccaggctagaaagatcaaatacaggaatgaggtctggggccaaggtcgctagttgagaaaagggctcagaggagtataattaaagtttgggcaaggagaaaatcttcatcataggtaatagcaaatttataaaaggacaattcaattcaataaatcttgtcctcaaggaatttacaatccactgaaaagagataattaagtcaccacaacctggtcaaattaccttggttttactttgcaattaaattttattcccatatgaatctatatgtaaataatctctttaaagaaaacaaataaaatgagaagttaaagttatttctatctctgtaatctttattttaacctttattttaacttcaggggtacatatgcaggcttgttacagaggtaaacatgtgtcatgagggtttgttgtacagattatttcattacccacatgttaaacctagtacccattagttatttttcctgatcctctccctcctctctcccaccctccaataggccctagtgtgtgttgttcccctctatgtgtccatgtgttctcatcattttgctcccacttataaatgagaatatgcagcatttggttttctgttcatgtgttagtttgctaaggataatggcctccatctccatccgtgttcctgcaaaggacatgatcttgttctttttttggctgcatagtatttaatggtgtatatgtaccaccttttctttacccagtctatcattgataggcatttaggttgattccatatctttgctattgtgaatagtgttgcaatgaacatatgcatgcatgtgtgtttataacacaatgatttatactccttcaggtatatagccaagatttttccataatcccactggtattagatacccaaaaaaatcccattggtattatatacccaaaaaataccaatgggattatcagattactggaccaaatgatatttctgtctttaggtctttgaggaatcactacactatcttccataatggttgaactaatttacactcccaccaaaggtgtataaacattcttttttctccacaacctcactagcgtctgttacttttttagcttgttaatagtagccattctgactggtgtgagatggtatctcattgcggtgttgatttgcatttctctaatgatcagtgatgttgagcttttttgcacacgatttttggccgcatgtatgtcttcttttgaaaagtgtctatcaagtcctttgcccacttttttatggggttcattttttccttgtaaatttgttaagttccttatagatgctggatattagacttctgtcaaatgcatagttcgcaaaaatgttcttccattctataggttgtctgtttagtctgctgatagttccttttgttatgcagaagctctttcattatctctataatcttaatttatagactaaaatattaatttgaaaatataccaactaaagtgtatcacacacctaaatcaaggattttataaaatacactaaaacagaaactaaacatagactatttattcaactttcatataagcaaaagacaccactattggccaccaacctcactactcccagcctgtgaaacaggatgattatgggtatttgtgaaatctaaacatcaccactcactacattaaaatgaaatggcaacaaatttccacaagtctttttactcaaagtgtggtggcccaacccagcaatctgggcatcacctggcacttgttataaatgcagaccctcaggccccacctgctgaatctacattgtaccaagatccccagaaaattcttatgtacatgaaagtttgaaaaccatggatccagaagtgtgtgaaaacataactactgccagaatttttagcatattcccttattcatctcttttttatgaaactaaacgtagtggttttgctgatagagatggacgggggaaaagaaattttgttgtgaccaaagttgctgcattttttgcctaggggtggacctaaagtttcatgtcaatcattttgttttgtgagcaaaatcaaagtcatggggaaaaaggagagggtgcagaaagaagaaaattgtgaatacatagaattttatcactggaagacagaaaacaatctcaattatatatatagtatatgtactcaatacagtaatggttaaataaaccatgacacaactatgcaagagcatatataaagacattaaaaataacaaggtcatttttcatgtaccaagatgcagtgatctctaatgtaaacttagcttaaaatatgcaaggggaaaaatgcaagggcagcacagcatatataatgacttattattcatgtaaggaaaaggacataagtgtgcatatgcatagaacatctctggaatgacacacaagaaagacacacaatggttactgcccagaggggagctgaggcacgagggacagaaatggaaggagactgacatcccactgtgcatcttttaacatcttttgaattatgtgatagtattatccaattaaaacaatattttaatctaagcattgaagaattcctaaaaagtagataaaatacagttactaagataataaaggaatcccttcttcattttccctcatagatggttatgtgactatgtccaaacactttctgtgagttacagatctgagaagttgtgtctaaaattcactgacactggagcttaaatccacgtgcctagaatgctcctcactgcccccacacaacccctgagagcccccactgatgccagttctctctgcaacacaaactaagcctcttcctgtctcagctgtgaacacatttgcagaaggctattgtggttttccttagtcaggggtcagaatggccagcaggggcaggcaggtatcctaaacgagtaaagcaggcctagccaaaacaaagtgagcctttacccctccacctgcaatgaaacagggcagcaactattctgctccaaggaaatactaccatggaggagacagggccagatgttgccatgtcttcccagggatgtcagaagctgctaaatttattttaaataccttgatttaaaaatgttaatattttaattttttaaaaacagtttacagaccaaataaaatacatgtgcagctagatgtaacctagaagttcataatccatcctgtcatctttcgtgtgtggaaccatgaacatttctctttttgttattttctcattggagctgctgaaaagaaaaaaaaaatctctttttaaaaaactcaaacagctatattttggagattcgacaatttactaatctatcactccaaaatgtgctgtataatttatttgacagtcactgtgcttgcctaagaactaaaaataacctcattgtatgtgtgtgtgttgtttctaaagacctgtggtatttattattgttagaatgctttcgatgtctttggtggtatgaactgtgaggtatctctgaaggatagcatttcactgtatttcacagaatatacatatacagtccatcaaaactctgggggttatttgcaaaacatagttctcattttccaacaagctttcagcggaagaaagtttcatagaaaaaaatacaaatttcctaccactctactttgtgagaacctaaagagactgttaggttataaaaaagaaaattgagggataaatttaacacttaaaagtgactcttctagcaggaggtttgggcacccagccagattaaggagaagtagctttatacacacatcttaacagcagtctgaatatcaaatcttcactactctttgcttaaagcccagtacctactgagtcatcccagccagcatgtcccttctaacttgtcatcctgtttgttatcactctatgccctctgcagtactctggactttgaatgtgagattactttatttaagtgaactgcaattgaaaaaagaactcttttgattgaatcttgacctgcagtaattgggaacttatgtaaggaccccatgatactcatattaaggggagtgtgggaggatcccactactaaagcctggctgcagaagagggataatggaaactgcaggtgttagaaaggtaccaacatacatcttccccctatagtacatggactcagtttttacatatggctatgctttctattctgcttaagtaacataaaaactgattaggaaactcaagatcttgcactacatataaaatctgcatccattgcttatggtctaaagtaaatgcaacaactgacaattcttacagagtctcaaaaccaagaaccaccatgataaaacaattatactgcaatgctgaggaaagagacatttaattacagatataatttatgtgagtaagcataatcattttaaatttctaaataaataggcatgtcattaaatataaagcatcaggaaaggatttcaaaatctgtatggttcatctgcgttggcaaatttgatctattcagagtttactctgggcgggggggacctcatgattccatctttatggcccaactgttgattaacttccaaatgaaaatgcttgattcagcatgtattttctgtaagaaaggtatttttcacatgctatagccaggccaatctgtgtcttcaattgttgttaagacactagtatatctttaaatcttttccacttattaatttcagcagattatttgtacacatttctcaggctattctgatatttcaaatgccttgaaaatgttgtagctacataaattaaatgggcaattaagatgtcaccatgcaattctatacaatacatacttgcaatgggatacttgtgagggtaccattatccaaactgtcctattcatcagcctttctagaactttagagatgggagtcagtcagctgggttccagtcatggtgaatggcatgcaatgatctcgaggaaaccacaaagcacatcttcctatgtttgcatttcctcatctattaaatgaagagaagacctggatcctaacaggacgtctgcgaaaccctcacgaaaggttaagaaaagaataaagaacatgacaaaggtaaggtttacatgctcttattgtggcagaagggaaaaaaaagcagaaatgcatataaatacctcacagtttgtcacacaaagcacacatttaaaaaacaataacaaaaaacaacaaaaataagcaaccaaaaataattaacagtagttcaagtaatttaaacctgtattctctcctgaagaaataccagataggtaaaatatactcccgagccaccacaaactctcctaaaatccctttgtccatttctgccactttcaacatccatcttccacccagatgccagcttgaccacctcccccatcaaagtcaccagactgagctctaggaaagtcttcattaaatagtgaacacatgacatatactatcaactcagcttgaccttacaacataggtgctatggtttgaatgatggtgtcccttccaaacttaaatttaattaattaataattaattaaattgttgaaacttaagccccagtgcaacagtattgggagatgtggcccttgggtagcgattaagtcatgagggcgaggctctcatgactgggattagcacccttataaaagggcttgaggtcaaaaggagtactctcttgcccatgtgtccctcctgccatgtgaggacatggtgtacttccctccagaggatgcagcaacaaagcaccatcttggaattagagagcagccctcaacagacaccagtcctactggtgcattgatcttggacttctcagcctccagaactgtgacaaatttctgtggtttacaaatgaccaagtctgtgatattttgctacagcagcacaaacagcttaagacaatggataactaatctaagttccaaaactagtgggcttttgacatgccttggaagtagacagataaagcagtagccaagatcttttctcatctttgcataagcaaatcgtaattgacaaacatcagtatctcagagcattcaacaaagtggcaataagtaaatagataactgatgaacatacagaatcgaaaggctgacgtgggtttcaggtttctctgggttgtggggcatcccatggccaagtactgaaactcttccttgaataactatctccagagtttgagccattgaggctcttggtgacaaagacaactgatatgcttggatccatcaaataacatatcagcaattcatgccccactgatagtagaaaagtgctgcaatcattttattctgaagagagcataaagatttacaccacatgtcaaggctagatgttgttctgccaccaggaaacttgctgtgtgagacacacaaaaaattaaacacctcaagaaatacagctttctggaaaacatcaatacctcttctttttattgttacatttttctaatgaatctttcactgcaacaacttatgcagagaagttatgtatcctggaattattctactttttgataaccatttttaaagctttatactttataaagctttttttattctcccaattcacttaagaatttgcaatatccacctcgaggttaacctgaaactcaatttcacagctaattccaactaaacgtcttctccagctttccagatgccatctaaccagttatattctcactgattcagcagcatattcaaagagacagagaagaactgacatgatgctgatgaagcttaaacttcagggtccctgttgcatgggccctcagagtgccaagagtccttgggagtccgtgttctagctgagaggaaacatgaagaggcatttctctgtaagcatttgtggcaaagagatcttgaaagaaagggaaccggccgggcgtggtggctcacgcctgtaaccccagaactttgggaggccgaggcgggcagatcacgaggtaaggagatcgagaccatcctggctaacacggtgaaaccccgtctctactaaaaatacaaaataaattagccaggcatggcggcgggcgcctgtagtcccagctacttgggaggctgaggcaggagaatggtgtgaacctgggaggcggagcttgcagtgagccgagattgcacccctgcacttcagcctgggcgacagagtaagactccatctcaaaaaaaaaaaaaagaaaaagaaagagaaccaaatcatttcactgaatcattttgaaataaatactcacctttgcatctaattttgtattcataatcttttcctctttttcttaaagaggacctcccaaattgtatgagcttccaactccactaaacctgagtctgcctgatacaagggaaggcatgtaaaaatacttcttagtttatactctccactgcgcaagttttcaatctataaaaaaactcctgatctttaaaaataaaaaataaaggttggggagagggtagtaaaaagttactttaaatgtatatttttaagaatgctgatttcattatgtattttccaataccaaaatataaaataaaatagaacctgcagaacttttggctctctgacatttctccccagtgacttaaaactttcagatgaatgggacatctgggttctgagaagaatggtgtattattactgctctccacaatagcaggcctaaatggatttttcatgtttagactagtaaacataaaaagcaaacctatctcacatgactgatacgtttgcctttaacaaaacaaccccggccaaaaattattagaaaacagatcagcagccccactggactctgaagcaatgtaattaggtagtccaacactacattttgtcaaaaaattctgacaacctaataaccagattgtcatcagatagacattaaaaaatgataccaggtttgctccagcattaaaataccaccactttctgggttttttttccttctgtaaaaataaaaattaaaaatctatcagtgatgcatcccattggtctggatggtgtttaaatgagtctgtgccacttgaaggatggcaaaggaagttttgttttgatttaaagtttaagaaagaattcttcttaggaccacctgcttaacgttaatcacgaaatccctatgtgttaagaggggtaattataaaatggaatgataataacaatagtaaccggcagttattgagtgtttagattgtgccaggcactgggtttcattctgttgaatgaaaccattactggactcccaacaaccttgatgagaggtgctactctcaccctcattttcagaggtggaagggaggcttatcaaggctaaagaatccacttgcacacccaacagaggccacctcatgctcttaacctctgcaatgtgttgctgagaaggtggttagtttggatttgacagggtgaggtggtgggcattggggataagaggtgttattttcaagaaaaccattacgtatgtggccttccagaatatagtaatctagtatgtagtctggcctgtaagccaaattttatgtatagtgtgacactgaagaaaaaaacgttgtaattataggttaattcacacagttaatgcaattaaatagaaaaaggtagaaaccttaagatatagccttaggttcaaatatactctagcctccatttaattagtcaattataaaaaattgtccactaacctgtacaagaataaacctcagggagtacatttctaagatgacctttggaaccctagtatctgaaaatcttaccattttatctattaggatataaatgagttatctggtataaatcactgtcaaatttgcacaaacaaatggtgtggctgacagtcagtaataattcaatgacaccaattttttccccaacatgaaaacaccccagattactcagtcagccatgccatggctagatttgcaaggcactataaagtttccaaagtatttgtccaccacgtgattttgtttgacatccacaagcctacattatttctttttctttttcttttttttttttttttttttgagacagagtctcactctgttgcccaggatggaatgcagcagtgcgatcttggctcactgcagcctctgcctccttgttcaagcaattctcctgtctcagcctcccaagtagctgggactacacacatgtgccaccatgcctggctaatttttgtatttttagtagagacggggtttcaccatgttggccagaatggtcttgatcccctaacctcgttatctgcccacctcggcctcccgaagtgctgggattacaggcatgagccaccatgcccagccaagcctacattatttcttaaacacaaaaagatcattccgaatttcacaaacaatgttgagcaaaatatgccacacacaaagaagcccataccgtatgattctatttattatataaaattagtccaggcacagtgacccacatctgtaatcccaacactttggtggctaaggtgagaggattgctcgagggcaggggttcaagaccagcctgggcaacaataatgagactctgtctcttataaaaaactaaattaaccaggtgtggtggtgcatacctgtggccctagctacttgggaggctaagacgggaggatcacctgagcccaggaagtcaaggctgctgtgagctataattgtgccactgcactccagtctgggtgacagagcaagaccctatctcaaaaaaaaaaaaaaaaaaaaaaaaaaccacccaaaaacacacacaaattcaaaaacatggtaaaaccaatcgcagatgagtcaagatagtgacagcctcagtggaagcaagcatggtagtgagtggaagatggcatcagagtgtcatgttctacctcttattctagatgctggttccttaggcatgatgactttgggaaaattcatcaagatgtacaacttggatttacaagtatacaaatcctatagcatgttatgcttctacagaaaattgacataaaacaaccattctctccctttcagtttgctaactagaccaagaagaaaagatacactgagaaagagggtgggcactctgaaaacactgagaagtttgactttacaaactattgagctactgacagtcttgttaaaacctcttagcgtgcctttccctcacggcatcaatttatatagcaattcactacattaattcttgtaatgaaagtgtgaggagatctgtagtcaatcataattgtgccctgcaaattccagaaaatgtttgctgggatgtaagcctctgatggctggctcagcaagtgatttagagcaatgtggtgaactttcataataacagctcattaacaattgcgtttaaaatgtaaacaattgatatgtttttagaaacaccagtactgattaggtttatttcactttacaggaagtcagaagataatatgctaagcagattttcctttcttccctctcaacgataaattcaataatagttaggttagacctagttttgttttcagtttccatgaatgagaaatgtgaagaccatgggggttccaactcagtctctcttctccagttttgtgtttaggaagcacagacttgaaatgtattttgcatgtcttccaagactaaataccgaggttatgtttgtgcagctgtctgaataaaactgatgctacctcaaaaaataagttgattcagtcacaaaaaagtaccaagcaaagtattaattgatttaattgccctgcttttatttaaagctagacaagaactatgggggagggaccttatcaatgatgttaacagatatatatgtatatgcccagcacctagccaaattatagaaagagcatgggaactgcttaatgatttgctttaccagtcaatctttatgtggagtggggcatagttaatgatagtaatcattttaggcctgagttcctttaaattatcaatttaatatttttattaaatatatgcatttcaagtacatttatctccgttgctttttcgactaaaaaataaagacaaggaattcaaatgtttggattattttccctcactcataccaaatacaaggaaagtaaacataatgaagttaaagtaatattcttagcttgacaaatcacatattggggacatgagaagcctaaattatctgaagtcaattaattgttctttgtcaacggaaagaagaatttagctcccaaactggataaaatcccagccaagtaatgaccaataatggcaataatagtaacattatatttttcctgtctcttgattatcaacaatcaagaggctatagcaaataaatatacaaatatatactgtgaaaacatcaatatttgtatctacaagaaggatgaaaaattaactttgtgtagtaatatccctccactgtatttaggaaaagacaatacaacagacctctaagaatgggtgttccttctggtacttgaaggaagcacacaaacaaatatattatggaactggtggggaaaaaaacagtcatccagaatcacagggctgaagagagcccaggatgtcacctggcctgtcatgtccagaatactaacaagtttcatttaattccagcatcacaggctgctctgatattccctgggttccctctcctggctctgcctaaagacagacccaaagaccaaaaaaatctaccatgtagtccaagtcgtctaatgctagcaagcccctgaatcttgccacatagggcccacttataattgcagtaacatgtctctttcctagcctaattactattcttggagaaaaatctctctttgttttgacaatttttcctatcccttagaaaaaatggttcaggaatagattctagtattatttttcatacatgaaataaatattctatttattctattacatttctgttctataagtgtatggttagatgactgttactattctttctggctactggacataccaagtctggtttaaatactctaaccagaattagtccatgccaacataagcatttaatgagaaaggatcctggggctacatgctccatagtcatgtgaaatcggatactctgaaggggaaataactttctctgaagtgtaaccattaactgaaagagaaagcttggtgtggtatgagtcatgggtaacatgggtgaatcacagtcctgatgggcaggtggccatctctgaagaggatttcagaaatgctctccccaccttgatcaattaaattctcttattaggatagaaaacattgtattccacggttaaagtatgaaatgcctacataaccagataaaatgacacaactgttccaaaagttcagttatttacatactcctttcatgatttgtataatatctatgagccagtgttctatattaatacaacatttctctttaaatcaactcaattctgccagtctaaattacctttttgaagaagacaattttatatccccactgtaaatatccaatgtcactggtatacatattgtatatagccaatatcacttgccataaatagaaggaaactgaaaagatttcatgtgactaaccaaaaatgtattcattcatctcatctcatgtaccacatggaatactgtaacaaactggtttaaattcatactagagagtaaatgaatgatagaattctcaacacccctccatcctgtcctattaatgagattaaaggttgagggaccaccaaaagaggtaggcagggccctgagaacctgaaggagcatgtattcaggatagggggtatggggggtggggttggatgtcacaagctatgagaagtaagggtacaaaagagcagacagtagcccacttcatgattatttatatctggggctgtccctgaatgtgtcatagaggaagtcctctgtactgtttgatttgaaggcccttctacttctatgcaccatctcttttagacatccacatctgagctcacaaattatccatcacaaagaaatcacatgctgttaataggtctcttcattgtggctgacagtgcaaaacaaatgccagtccctgtgctgagatacagatttctggaatactaactgggattcccaatgtggggagacacagtagtagaggtcactccaaggactcctggaacatgctcctgaattctgttgcttcttgccatacttgccacagagtgccgttatgttctagctctctctgggtatccttctctccaatcagattctcaattctctcatcatctttctattgctcttaatacctagctctcagcaaaacaagtgcccaatttatagaaaaagcgagtaagtgactctgaatgaatcaaccacaagtgaatgaatgaatgaaaacagatcagctttgcagaaagaagcacctgcttacctaaggtatatccccaaattatcccaacctcatctaaagttatcagggaacacagcacaaattcattagcatcctgctgccttttcagagaaatgacaggttcttctccccttgcctgatcaaaagatttgctgcactctctctcttaaaatgcctccttgttacaaactgtgcaatcttggtcaacttacctaacctctctgaacatctgttcccttacttgttaaatattgaagaacaatatctgccccatgaattgtgataaagattaaatgagagatttcaagaaaagtgactgtagtatatcaaaagccaaaaagccagctacatttttggaccagatcacaatgccatgataaatatcaatggaataatggtccacaatgtcacaccacatgctttcattctgctgtcctcatgacttccctgtttgccagcatcagggtttttcacgtttacaaagaaaatggagcaggttagcaggtctcggtggcattaatgggcaaagcatcatgggcaactgttgttcataaatgctccttctcaaatgtatcctgggttggtgatgaccacaattcatttccattttgaagcgccctccattttttacttctttctcagtctgaatctcctatacttgtaatactgacggagcttcgctagtttctaaatcagaaagatgagcacgtgcagccacaggaagagaaatctgggacctgatgcctataatatttttcagacagagaatattcccccagtgtctctacccaggagatagtaaactactctgacatttcagctgttgcccctccaagcagattcacacacctcttcggctaacatcccctttgggcaggcatctactcatgtttacagttattcattatgactggctatacacagacagtgcctctggtgtcaaactgaatggccccttagacccccattccaagacagccagaggatacagacatatattaaataagacacaggcaggaaaactgcactgacttccttgagatggggaggctgaagccaaccaaagctgacctgctagagagtcctccagagctccagtgtgggatgactcacagcaaggagcacgggatcaaaatttttgaggtgcttcagggtcagaaagttttccagaacagcttctgcggatgtctgtgaacaaatatgccagcaaggaaaaagaccaactattttgcaggggaatcatcttgaaccagaagggccagcatgcattctaagtgccagggcaagttcccaaccctctgagctagctcacatctattgtgattccacacatctctccatggaataatctgtccaagaacacacaagcagagaagtgcccttctccatctacaagcatctaaatgtagagtcatgagagaaggtgagaggcagtgacttcaagaggtggcctctagacctcagaatccactctaatgaacacgctgtgtttaaacaagggatctcacattttctcaaaaggcagttagacacattcacatacttaggagtgaatctaagaactctagaaagaacggcacatttccctactgacacagttgtattgaaaaatcaatctgtggctctaagggaaatgagaaaacacaactggtgatttctagcacggcatccaatcttcacttttgtgatccctcaattctcagttcaagtataaatagactttttcccccccacgaagtaggaaaaggattaagtaggcaggacattttctaagttctgtgtagcatatgttcataagctttccttttgtagcatttatggattcattctggagtagggttaagccggagcaaagcaatttggcatgcttgcaatttgctttatcaggagaagcaagcacagactgcagaggccacctcgacctgagcagcaaagaagcttcccagaaccctgagggagacactgattattttccttacagggatgctcaagctgagccaacctccttgcaaaatagtcaatgagcttcattcagattatcctcaggaaagcagtggccaagcagacacaagtgatcatcatcatacgaacttaatttctgaccaaattccacaatcacactgctcttcctgaagtcagtcaggcagtatctatactgctacacaaacctcagggtcagcattccaatccatcccagcctaaggatcccattcagcagcagaggtgcttttcaaatctgtacatccacttcggtactttctatccacatgagagaacacactgcagcaggagatgaggatgcagtaggataattcttaatgttcacaatataatgttgaatggaaaaagcagtatgtgccattttcttaaaatacatgcccacataaagaactaactgggaaaaaaacacccagaaatgtcacttggagtcatctctgggctgtaggattatacacaatttctattttcttctcttagctgaactggtttccaaatattctaaaatgcaaatgcattacttttataatagtaataaagtaattctaaagtgatttaaatatatagactgtgattctcaaaatgcaggagttaaagaaaaaaataaagacatagactgaaccttacaaaaaagatttttatccacaaaacaaagaagcattttcattaaaacaatataattaacctgcaccattaggaaagaactacatcatatttcacattcaattttgttattatcaccatcactacttcttaagcatctgctgtacacaatgccctgtagcgggtataagtactcaaaaataaaccaggtggtaactaagttatttacatcactgggactcttccagtgttattaaagttgaagaacttgaaaagcagcatttattaataacaggggcattaatccagctgcctgccctgtactccacttacccagagagtctctcccagtcctgccaagcaagattaagtagaattaagacggcagctaaccaggtagaccttgtgccctgggccacaggtgactctggcaagggtgggcgcctgacctacatcaaaccattcagattctttcccccaggaaggaggaatacagttagtctctatcatccccttgaatgaggcacagggagttgcacgggtagccatagctggctggatatgcaaagaagccagtctgcagacagaagaggtgagaggctatgaggatcctgagacagtctcctgctctttaggatgggatgctgagagatatgtttgtccatttacccatcccactctggttagtttttgagggtcaaccacttcctggcctaaggcttcaggaagctcaccatctaaccttttgtcaaatgagtaagctatcctgtggccttgtagaagcctcacctttcatcgtttttgtcactgtttcttttgtattggttcttgaaaacaaattatctctaagacatagttgcaagattcagaactctgaactctcttcacccactccttacaagctgaatccctcctcctgtccttcttttcagatcttaacttaaacgtcattaactctgaccgctccaaatgaggaggcctgctatgttttgcctcttgatgtttcctaaataagatttacataacttttaattgtatatgctttgttggtttactagttctgatctgtctccttccctagggcataaaataatctgcccgacccatgttccttgtacctcacacagcacattcctagcatattacagaagatcaatagtattgaatgcatcagtcagtcatgtaggtgagtgcatattcattcactcaatatacaaataatgattgagcacttgaaatctgcaaggcttagtcctttcttgataaggaactaaggaactaatgattcaaaaaggagattaggtacatatgcaaagacaagaacatagacacagcagacactgctgagggcctgtcacacagaaatttccctctttgacaaagaaggccattacaccatggtaaagggatgaattcaacaagaagagctaactatcctaaatatatatgcacccaatacaggagcacccagattcataaagcaagcccttagagacctataaagagatttagactcccacacaataataatgggagactttaaaaacccactgtcaacatcacacagatcaacgagacagaaagttaacaaggatatccaggaattgaactcagctctgcagcaagcggacctaatagacatctacagaactctccatcccaaatcaacagaatatacattcttttcagaaccacaccacacctattccaaaattgaccacatagttggaagtaaagctctcctcagcaaatgtaaaagaacagaaattagaagaaactgtctctcagaccacagtgcaatcaaactagaactgaggattaagaaactcactcaaaaccgctcaattacatggaaactgaacaacctgctcctgagtgactactgagtacatcacgaaatgaaggtagaaataaagatgttctttgaaaccaatgagaacaaagacacaacataccagaatctctgggacacattcaaagcagtgtggagagggaaatttacagcactaaatgcccataagacaaagcagaaaagatctaaaattgacaccctaacatcacaaattaaagaactagagaagcaagagcaaacacattcaaaagctagcagaaggcaagcaataactaagaccagagcagaactgaaggaaatagagacacaaaaaacccttcgaaaaattaatgaatccaggagctggttttttgaaaagatcaacaaaattgatagaccgctagcaagactaataaagaagaaaagagagaagaatcaaatagatgcagtaaaaaatgataaaggggatatcaccaccgatcccacggaaatacaaactaccatcagagaatactataaacacctctatgcaaataaactagaaaatctagaagaatttgataaattcccggacacatacaacctcccaagactaaaccagaaagaagttgaatctctgaatagaccaaaaacaggctctgaaattgaggcaataagtaatagcttaccaaccaaaaaaagtccaggaccagagggattcacagctgaattctaccagaggtacaaggaggagctagtaccagtccttctgaaactattccaatcaatagaaaaagagggaatcctccctaactcattttatgaggccagcatcatcctgataccaaagctgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatacaaggctggttcaatacactcaaatcaataaatgtaatccagcatataaacagaaccaaagacaaaaaccacatgattatctcaatagatgcagaaaaggcctttgacaaaattcaacaacccttcatgctaaaaactctcaaaaaatgaggtattgatgggacatatctcaaaataataagagctatctatgacaaacccacagtcaatatcatactgaatgggcaaaaactggaagcattccctttgaaaactggcacaagacagggatgccctctcttaccactcctattcaacacagtgttggaatttctggccagggcgatcaggcaggagaaggaaataaagggtattgaattaggaaaagaggaagtcaaactgtccctgtttgccgatgacatgaatgtatatctagaaaatcccaacgtctcagcccaaaatctccttaagctgataggtaacttcggctaagtctcaggatacaaaatcaacgtgcaaaaatcacaagcattcttatacaccaataacagacaaacagagagccaaatcatgagtgaactcccattcacaattgcttcaaagagaataaaatacctaggaatccaacttacaagagatgggaaggacctcttgaaggagaactacaaaccactgctcagtgaaataaaagaggatacaaacaaatggaagaacattccatgcccatgggtaggaagaatcaatatggtgaaaatggccatactgcccaaggtaatttgtagattcaatgccatccccatcaagctaccaatgactttcttcacagaattggaataaactactttaaagttcatatggaaccaaaaacgaccccgcatcaccaagtcaatcctaagccaaaagaacaaagctggaggcatcacgctacctgacttcaaactatactacaaggctacagtaaccaaaacagcatggtactggtaccaaaacagagacatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagcacttctgcacagcaaaagaaactaccatcagagtgaacaggcaacctacagaatgggagaaaatttttgcaatctactcatctgacaaagggctaatatgccaaatctacaatgaactcaaacaaatttacaagaaaaaaacaaccccatcaacaagtgggtgaaggatatgaacagacacttctcaaaagaagacatttatgcagccaaaagacacatgaaaaaatgctcatcatcactggccatcagagacatgcaaatcaaaaccacaatgagataccatctcacaccaggtagcatggcgatcattaaaaagtcaggaaacaacaggtgctagagaggatgtggagaaataggaacactgttacactgttggtgggactgtaaactagttcaaccattgtggaagtcagtgtggtgattcctcagggatctagaactagaattaccatttgacccagccatctcattactgggtatatactaaaaggattataaatcatgctgctataaagacacatgcatacgtatgtttattgtggcactattcacaatagcaaagacttggaaccgacccaaatgcccaacaatgattgactggattaagaaaatgtggcatatatacaccatggaatactatgcagccataaaaaatgatgagttcatgtcctttgtagggacatggatgaagctggaaaccatcattctcagcaaactatcacaaggacaaaacaccaaacaccgcatgttctcattcatagctgggaattgaacaatgagaacacatggacacaggaaggggaacatcacccactggggcttgttgtggggtggggggagggaagagggatagcattaggagatacacctaatgctaaatgacgagttaatgggggcagcacaccaacatggcacatgtatacatatgtaacaaacctgcacattgcgtacatgtaccctaaaacttaaagtataataaaaaaaaaataaaataaaaaaagaaattttcctgtttcacctcacaggtaaagccctgtgctggttaattttctgtgtcaactcaactgggccatggggtgcccaaactaaatattatttctggatgtgtctgtgagggtgtttctgggtgagattagcatttaaacagaaggccatcacccagtttgttgaacagaagaaaaggaggagaatggagaaatttgccctgtttctgcttcactgtgtgagctgggatacatgatctcatctttgccggccctcagactgggattatgccattggctcccttggttctcaggccttaggacttggactgaattacaccaccggctttcctgggtctccagcttgcagacagcacatcatggaacttctcagcttccagaatcacataagccaatacctcacaataagtaaataaaccaataaataaccttttggttctgtttctctgaagaatcctgactagtataagccccagttttattagggtggcctccctccataaagctatgtactcaagggaaggtgagattatcccagaaaagagataaaacccgattagtttaaaacagggaaagggttaacagctgctctgatatccctttagctccaagggcagctgggcagacccagagcagccagagaccccacacccatgccctacacacacacatcagccactccagctgtgagcagcctcttctgattgcttaacatgccggccaaattgtattttctatgtgcaccataacaagaacaaagttgggaagcaccaatctaagccaccagggatgagccccattccgcgtgccagtgtctgatttaggaaggagcatgggactgcaatcaactaaatgagacttaaggggaagtcagctcaggggttacaggaacagttccttgcttttaaaaagggacatataagaacagatattttattttgccagtggatgttgccatgtctgcctgtagctcccaaaaaggaaccagccatcttagaactatgaaggcagccagtctaagaactaagtcaacacactgaagatggcacaggaaaaagagcaagaaatagacactttggtaacaatgttgagccactgaattaacaaaacttgaaactgcacccctcccaggaggtcttattccctgagataattcatttctcttattctgatgggtttttatttggtggattttcaaatgtaacttggtagagcaattcacaaaataattgacagtgcttagcaatctgtcaatagctgagtgctcaaaatcctctccctgctacacagtgacaaccatcaaaggcaccctggtgggtccccagttgcttggcaaaagtggattgcagttagattccagacatttggagccaggattctataatgccttcccatcaatcatgacatccctggggcagcaggtagacttgcagagggcagggagcttttttcttttaattcccctattgtttgaaccatttcaagttgactttttgattatttgcagccaaaggcatcttcggtgataaatccatcttcacataattagcagcaaatttatgtggcctcctttgagcaaagactcaggagaaaatgatgcagagattcataattccacccacattccccaaaatctttagatgatgggtcttcagtgaattctctctacaaaaaaaaagacaactgagatgccagaaaaaggattaatcatgtgatcatctgacacttatcatgggagtcataaagtaccacacaaatggtgaggcatcaccttgtctcagtgttgaattaggggcagcataattttaaaatatcaatttgtactctttgttatccctcctgtgtatactgttccctttcgcatctcaaaaacttcaagactttgccttcttccctttgtctcccagacatattcaaacgcaaaagatgctaaaagacaaccaccaatcccctaaatccagtctccattaaagacttttctttttcaaaaaagcctaaattcattgaagggaatgtgttacatcccagcagaaaggtccaaaataaagacaatttgggttgttttgttttgcttaaaagtgttgttctttgatctgtttaggtgggcacttggagtacagtaaggattgggctttcctggtattggagagaagctggagcagttccttaaagtagtggacgctggcaccctgcttcctggcagaactctagagaggtgacaggacttttgatcgggatagtgatgggatactgggaaaatgactaccaaggccttgaagccacagcgaaaatcccagccttctttgcacagatacaacaggactacccaacaatgcatggacaagaagcctctcatggtgaccagagtggactaaagttcagggggcctttttaaaaatgttttatgctataacagacctgcagcatttttgcatcaatgaccttaagtgagcagacactccaaacaccacttagaacttcccaacatttagagaaaaaaaaagtaaccagttatgcatgtatgcatgcttgcaattcatgcagcattcaaaacaatttttcagaatgaaatctttaaatcagagtgcacactcagtttgtatttttagttgatttgacacatcatgagcaaccacaggattccacaataccaggccaagttcccactgtagggatggaaaggtgtgatacctttcctcacctctcacaagagtcacagccaacattcctataacaaaagacaggtcagcaagagaaaagcataacaaatgtatttaatcaaagttttatgtgacatagcagccttccgaaatgaagacccaaagactaaaggaaaatagtttttatgcttaggttcagtgaagaatgcacagctgtgtagaaatgtggtagaacaaaaggggtgtgttctactggaaatagaaaatagattggcggtggtgggggtggtggtggggatcagcaaggcctgactattcagattcttattggcctctctgtgtaacgttctttcttcccagtatggagcagggcctctatggaatgaggatcttcaaaggagaaggaagagagtgacttttctaggtttaatggcttgctgtggggaagagacattctagtttctatgacccaccttagggaagaggaattctggtttatacgacttgcttaaggggaggaagagaagtaggagacagtattatgggagactgccacaaagaccttggttctgagggctttccaatgtatttccttcagttcaaagtactcaggatgctaaggtaccatactttgggggattgggttctaagacccgacaccactagttatttaatattttccttcctgcaaatcctgctaccttaaaaaaaaggaaaactaactgtacaacaggtagttctgtagctaatgagcattattaaatattttcaaaacattccaataaaaggcaataccaaacggcttttatcctaatactttctaaataacgccacattcatttatgaggaattgcatttccctcaatgttctgggcattaatgaagattgaatataaataaaagaattgccttatatgtatagcactttaaagagttgagattcccaaataatacaaaagcattttcaagtcacacatggtatgtaaagtgaaaatgttcttgaaggaaatatcctctaataatacttacctacttcagagggtgatgggaagctctattaacaccaaaagaacacttttagatcttcaaataaaagcactatacaaatgcaaagtattattattatagttctgaaataatttcacacctagggatgagaaaaccccaggccaaattttattgcttctctcatacgtgataaacaagaaatgccataagcaaggggcgaggggggtggttagtggggggtgtgatagtgggggaagtggaaatcaaacagaacaaagacttcaaagtttctctttcactaggactttgtatttgcccagatgtcatttagggaactctcagggaagaaagaaaaaaaaaagtcccttaaaggtcagagttaagtacagggacaaagttctcattgcttttgtaccagataaagcaacaaccggctgagctgaaaaaaaataagcttgtctacttctatgggacataatttctcccaaagcacttctcaaaaaaaaagaaaaaaaaatggccagatgaattattactgaatcacccactagtgtgatgatctcacctatgaagtcaaaaggtagctgctttaacagacaccaggatttctagtcaattactgagagcactgagcaagacatgttattgctgatggtagtggtggtgatgatgatgaagatgataatgatgttgatgatcatgattgtgatgatggtaattacggtaatgataggatatggaacagaagttctcaaacctgctgatcaatggaatcacccctagagctttttacaatacagatttttggttctccacctcagccccactgattttgaatctctgaagatagaactcagaaattttttttaagtagccatcaggataactgaagtgacagtatttgtaagtaatataatgattaagaatgcaggctctgtgaacagactggctggtgtcttctcccagttctaacacttactagctatgtgaccttggaaaaaatacttagccttaagtctcaatttctacaactataaaatggaaatactaatatgacccacctatgaaattgacatgctattactacctaccttataaggtagatgcctaaagtaggcaaatttttttaaaagcacatattaattccaagaaagacaaaaaattttatattaaagaaaacataacaaataccattcggcttagcaacagaaaaaaattacgtaatcatgataatgtaaatattacctgttgatttaaataaaaattgtaatataactatgtcaggaggctgtggggaccagaagtggtaagagtggaaaggatcagagagctattgctaaaattgataaattaggaaaaaataatataagtacattatttagaaagagagaggtgaacaccagaaatatcagaatagaaagttgctaattctgggaagcaatccagagagaggtagaaagaaggcatagatgttgcagtttttaaatatttgctatttaatgctgttttatttaaacaatgtagatacactgctttgataaaaataaaaataaaatgtaaaaggtaatttgtaatgcatataagtacaatatggtatttctttatacactgaggctactataaagcttttcaatttaccaaaacttgcttttaaaaaaaaaagatataatatctccaactatgcaatcaaaatgtccatttcttaaaagtgtacaataaagacttactttttacctggcacactctaaatcctaaaaagatatttgctgaattgggctgaggatggtggaaaaatatataaagaacaaagttcctttgtacaatcaaggtcacagcaggaaggagatgacatcttcacctggggtgaaggcagggttaagggaagaccactaagggatggtctagtgtgctggacttagcaaaaattccattaacactccagactcaaaggggaaaagggaagaggcagttaccagacagtagaaaaagctgtagccgctgaagagaggcccccaaccggaactgtggccttccttagagggatacagccattgccaacccacaatgctgcagggaagaaagtagggaagaatatttcaacctcgtgttcccaggtcttcatccagttccttcccctggctaatacaacagaaagccagcaaacaagggagcccagagaatgcctgcgatagaggttaggcccatggtgcagagccatttagaagagagaggagctggaagcacaaatgtgaatacccagcacaagcactatacaaggtggttgttgctgttgtcgttgttgttgttgtttaatctgtctctttttcctactcagcctcctaaaacaagcccctcaaattttcatctgtttaagaaatattcatggcatgatagtaataaactgatgttatgcatttgttaaaatttactaagcactttcatatatattgtcttcatgtgatcctcaaaacagccctgtgcaataaatagggcaaaagttatcctcattttacaggtgaggaacctcagatcttaaagaaagttaggaatcttgcacagagtcacaaagctagcaaatggcagagccaaaactagaaggaatgtttcctaataccccagctaaggctcttccttccatataatactgtcatgctatttattcacagtaggagtgcaaaattgatatacctgttaaaaaaaaattaacaagttttgttctaggcactgcacagagcacagaagtagtcaacaaataagacacaaggggaaatagagaaaacttgcccattccattctcattctacattccacaagcaatgccagaactggaagtaattgagttttcaatcacattttacacatcattgaaaagaaggtgctcagtagggtaagaacagtgttcaaatgagaaataaaaattcagggaaaagtagacaaatgtctaaagaatatacctgttgtgtttggggttgctgggggtaaaccgaagaaaatctcagtcccttaacaatccccatgacacaaagagaccagggccccagaaattgggagggatgacttctccgcttctcttctcatttccagctctacgcccacatacatacaccttctttgagagctaagagaagcagccaagagtgacttttctgtaccaaacacaggagtactgggaagttcagcaaaataacccatttttgagagtctaataaagaactctgtactttttgtaatctactgcaaaacactgagctacttacacatgatgaaagaaagtaatgagtggcattttaattgtaaacctccaaacataccatatttattccagatctagctcactaatgaatagactatactatcaatgagggttctgtagttgcaagcagaagaaacaaattggctaatttaagaattattggaaggatactggagtctcagccaatccatggcagaatggaaaataaggtttggaggccatgactactagccaagacagacatggaggcaacagtggtctcatagtacatgttggcagatcagaatgcccacctaggacaagggagaatcctttagctaaagaatcaaattccaaagaaggagcatttacttagccaagcttgtggtcatacacccatccataggcagggtgcaggcccctgagtagggcccctggttacagttccactagcctaattacctcaaaaagaaataaagatgctgttaggaaggaaaaacatacacgacagaaaaaaaaaattggtgggggggttccctctatactaccaaggctttctttaaaaattcttgaagaagctaactagcagtagactcttaatttctcaagactattaactagtaattgatgacaaccaaggaaggtagttttcctaatacctacaaaacttcagcctaataacttttcacttccagaggcctcacttcctgtattacctgaaagttaccttttcatttgattcctaaggaccaagcagaattttcccttctttggtagcaacatgcttattttagaaatattatcctgaagcttctaaaaagaatagacttataaaaatgtataatgaataaattcataaagatgctgttgctgctgctgccgccgccgatgatgatgatgatgatgatgatgatgatgatgatgatgatattaataagagcagtggcagctcacatctactgagcacttatcatgggccaggacttctaagtccttgacacagaatacttcatttaattctccacacctacatgaagccaaaaacagtattatccccacttcacagatcaggaaactgagactctaagagggtgaataagttgtccgcagtccaacagctagtaaaagccaaatcatgactaaacccatgtctgattccagagtaccaattcaacaaaagattttcattgagaataaagaaaatggactgtgcctgtgtggaaacattccccaagaggaaaggaagcaccatatctgtgccaaaagattacaaagttgttaagatggctacatcaccaccaaatccaattattcatgagcatttatttctaaaagctatcaagtatttctttattccaagatgtggctcaatggtccagagacatgtagttgtatggccaaaaataagaattatctactgcttaagatagtaatttcttcactgatgttcaacaattatggcaaaattccaagccaaccagttttcatgcaccagagtttagttgccccaaagcaaatcctaagaaaagaggatttttttataactcatatttttattatctaaaaggggttttctccaatatccctgtaaaattcttctttgccctccaaataaacatgaaaaattcagccccagaaatagatttgtcaagaagttaggaagaacttaaagtacatggtaaatcaaaatggcttttcaactttaactaaagtggtcatagtaataattgctgcaataaaaatgacagaaaaaaaccctaaaagtatcaaaaatgtaatttatgatgaaaacaaatgtaaaattatagcatatttcaccctggccaccaaagactcttgatgaaaccgcagccctataattgcccagaatgaattctttaaattaaaatacttcatgcagaacagaaattaaacaatgaatcaaagaacaaagctgtacagaggtatgctcataaatatacctagcaaagaggaaacaattacatttttccatgtaaaaaccaacttgattgtaatgtttcacaagagaccgagtaggtacttttcccattgcttcaagcttggaagttcatttcctgtaattcatttagggctcagagtgactgggtggaatgaaattagatacaccaaattcagtggctcttttctttctacaaaactggctcttccatgcaactgcacaactgactttcacaataaatttcattcaacccaattgaaatgccactctgcattttattttaaatgctttatttggccagctagttttatttaactattggccagaagtggtacaagtgcattctttttccatctagcattaatcttagtaaacttagctccattggaatgtcttagctgctgagaagaaagcaaaagtcagcaagcatacaattgcatttgtctactctcaacacatcattttatttcctcctgctctctgctaactattgctcagcacttttgcctaagagggaggacaagcaggtggttaaggaagttgtcctgtcagctatatctttagtccaagtgtttaaatctctgaataaaagaaaaatcaatgttgtaaaggcaatgtttgtcaaggccatgtaataaatacacttacctttacagactgttctcagtggatttctcttctttcctgagcttcaaagctacaaagacataaaaatgaaagacagagttgtctgtgagtacaacaacaaacattttctccccatgtctctaaatagaatttccatatgccatggtatatggtgctagccaaataaaccattgataaaacttgtgcctcatacctcccgcacaagaggccaaaaaaagacagtcagaaactgaaaatggtgcacacatctacccagaattgaagcacacaaaccttggccaaatctacagtcaaatcttttggagtgtgtactcctcaacagaatgggaacggcttatagcgagatgaaaatcaaattaaacatgagtgtgacatactcagtctgactaagcattttattttcttatttctttttgtcatctttcttgcatgctctatttccatttctctgaaaaagtttcacttagggatgcctattccatttatatgacatgcatggtccttctaatataaacctcaccacttgctccgtaagtatatgtgtgcatgattacagggacaatcacccttcctgtatgtagactgcagccttctctcggaagaaactcacaaaacagaggaagccacaacttgacatttcaaatcaaatcttgttaacttcagctctctgtgatcaaaacataaatactatgcactgaccacacacaaatcaatgtgacaaaagatctgcaaaagcaacagtaataacttacagtatcgtgaagctggttctttaatcatccaatcttactcataaggtgcctctacagtcaccagtaatgggaatatgattctttctctcatttttggctaggtcctaacatctccgaaaggtgcagtagttggggatagacagctacaccacagcttttccatggttctttttttttccttcaatatctgaagggattgttttagcttttactgggctgtttccctccacatccctctattccatcaaagaatgcattaccactgatgcatgaccaccaaagaacaggtcagacttacgggctaagatgtaaatttcagactattaatgcaggaggtaggtcccttctatgggacagcatcagaaatttctccttccccctgagctacaccgtttaccaatgagtttagaacaagcagagtttggagaatattagataaaatagtgtaatattgcatttgtgaaatctaagagatgaataatctgataacatggagattgagctgaatccctttccacttcaaacacagaaatgctaaacaaaatacaataatgacttaaaatacatatatgtgtgtgtatgtgtgtatatatatgtgtgtgtatgtatatacatatgtgcatatatatacacacacatgtacaaatatacatacacatgtgtatatatatacctacatatatatacacgcacatagatacacacacacacacacacacacacgcacatacacacacatatatagccaagcccaaaagaaagagaaaaagccgtctgggaagtgagaagcgcctctgctcagccgccaaccatctgggaagtgaggagcccctctgcccggctggccaactgactgggagtgaggagcgcctctgcccggccgcccaactatctgggaagtgaggggcccctctgcctggccgctgccctgtccgggaagtgaggagcgcctctgctcggcagccgccctgtctgggaagtgaggagtgcctctgcccggctgcccaaccatctgggaagtgaggagcgcctctgcccggacgctgtgcaaccttccaagtgtgaagtgacagccttgtgtgtgatcttttctgttcttccccaagtttgcatttttgacattaaagtttactttttcgttaaaaaaaaaaaaagagagagagaaagccaatataaaaatatatggatgtagagtttctagaatgaaagacatgagtcctctggaaaaagtataacaatatctcaaaaagataaataaaagcaaatgcatactttcatatatcagaatgaaaccacagaacgcagagataaaaataaaatcttaaagtcaaccagagagggaaaaaaaagagacttctagcaaaagaacatgtcattagcaaaaatgaaagtaaagcaacagtgcggacactgtgtctcacgcctgtaatcccagcactttgggacaccaaggcaggcagataacctgaagtcaggagtttgagaccagcctggccaacgtggtgaaaccttgtctctactaaaaatacaggccgggcgcggtggctcactcctgtaatcccagcactttgggaggccgaggcaggcagatcacgaggtcaggagatcgagaccatcctggctaatatggtgaaaccccatctctactaaaaatacaaaaaattagatgggtgtggtaccaggcgcctgtagtcccagctacttgggaggctgaggcaggagaatggtgtgaacctgggaggcggggcttgcagtgagcagagatcgcaccactgcactccagcctgggcaacagagcgagactccgtctcaaaaaaaaaaaaaaaaaaaattagctgggcgtggtggtgggcacctgtaatcccagctactcaggaggctgaggcaggagaatagcttgaacccaggaggcagaggttgcagtgagctgaaattgcaccattgcactccagcctgggcaacaagagagaaactttttctcaaaaaaaaaaaaagaaaaattatatgcccatgctaaacctaacattcaagaatgatagagaacaatagataaatcagaacatttttcaaaaaaaaaattgtttagtgctcacagtagtttacttttgccaaaagaaatactaaaataagatatgcttgaataagcgggaatttatcccagaaggaagcagtgagaaacaagaagcaatagtaaacagagaaattagtaagcatgatggtaaatctggtaactttaataataagtaatgggtattgattaataattattaagctctacttgtaaaaaaacaaaacaaaacaatttttagcatttgccaataaagtgaaactgagtggtttatcacaatcatatggaataaagaagggggtaataaattgtttacaaggaggagagaaatactacttaaggcattaaagatatgcactaaaactactgattaacttgttaaggataaccagcatttctttctctgtctatataagcaaagaggcccttacacatgtactcacagagatttgtacaatgtttacattctacaaatgtattgccaggatggcaaaaaatacagaaaacaacccaaacatctatcagcaatacgataaacactttttttacatattcttagaatggagtattatataactttggaaaatcagtgaaagttacccacatcaacatagatacctctcaaaatataatgtaaaacaaaagaagcaagtcacagaaagctatacatattattctatttgtataacattcaaaaaggcaaaaataaatactgtgttgtttttgaatataaagtataagtggtacaaaacaaaataaagaaagggaagaaatttacacagaattcaggctatctttatcttgagagtgggagaggagatggaatacgtgagaggaatgggggggcttctggaatatggtaatgatctgtttcttggcctagaaagaggtatctggacaatcagtttattattttctttaaactgtatatgtacacttgcacaaattattttgcatgtaggctctatttccgaattttaaaacatacaagagtaaccaccaaaagaacagaaatttccaaatcaatagaggaaacaacatagagtaaacgcaatcgattctctatacaacattgaaatggaagggagaaagaagcaaaggaaaacacgctgaatagaatataaaaaagaaaatattttaactaagtccagctgtgtcaggaatcagggtaagtacatctgttaaaattttatcaaaacgaatgttttaaaatcttgctatgtgttgtttataagaaacaaatttaaacataagttttgaaaagaaaagtgtggataagtacacaccacggaaataggaaccaaaaaaaagctgacggaataagttattgttaggcatgacgaaagttagcaataatagaagagaaagtatttatattctttttttaaaattttattattattatactttaagttttagggtacatgtgcacaacgtgcaagtttgttacatatgtatacatgtgccatgttggtgtgctgcacccattaactcatcatctagcattaggtatatctcctaatgccatcccacccaccccccgccccacaacaatccccagtgtgtgatgttctccttcctgtgtccatgtgttctcattgttcaattcccacctatgagtgagaacatgcgctgtttggtgttttgtccttgtgatagtttgcagagaatgatggtttccagcttcatccatgtccctacaaaggacatgaactcatcattttttatggctgcatagtattccatggtgtatatgtgccacattttcttaatccagtctatcattgttggacatttgggtcggttccaagtctttgctattgtgaatagtgccacaataaacatacgtgtgcatgtgtctttatagcagcatgatttataatccttttagtatatacccagtaatgagatggctgagtcaaatggtatatctagttctagatccctgaggaatcgccacactgacttccacaatggttgaactagtttacagtcccaccaacagggtaaaagtgttcctatttctccacatcctctccagcacctgttgtttcctgacattttaatgattgccattctaactggtgtgagatggtatctcattgtggttttgatttgcatgtctctgatggccagtgatggtgagcattttttcatgtgtcttttggctgcgtaaatgtcttcttttgagaagtgtctgttcttatccttttcccactttttgatggggttgtttttgtcttgtaaatttatttgagttcattgtagattcgggatattagccctttgtcagatgagtagattgcaaaaattttctcccattctgtaggttgcctgttcactctgatggtagtttcttttgctgtgcagaagtgctttagtttaattagatcccatttgtcaattttgtcttttaatgccattgcttttggtgttttagacatgaagtccttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctgccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctctgttcttttggcttaggattgacttggtgatgcaggctcttttttggttccatatgaactttaaagtagttttttccaattctgtgaagaaagtcattggtagcttcatggggatggcattgaatctataaattaccttgggcattatggccattttgacaatattgattcttcctacccatgggcatggaatgttcttccatttgtttgtatcctcttttatttcattgagcagtggtttgtagttctccttgaagaggtccttcccctcccttgtaagatggattcctaggtattttattctctttgaagcagttgtgaatgggagttcactcatgatttcactctctgtttgtctgttattggtgtaaaggaatgcttgtgatttttgcacattgattttgtatcctgagactttcctgaagttgcttatcagcttaaggagattttgggctgagacgatggggttttctagatatacaatcatgtcatctgcaaacagggacaatttgacttcctcttttcctaattcaataccctttattttcttctcctgcctgattgccctggacagaacttccaacactatattgaataggagtggtgagagagggcatccctgtcttgtgccagttttcaaagggaatgcctctagtttttgtccattcagtatgatattggctgtgggtttgtcatagatagctcttattattttgagatatgacccatcaatacctaatttattgagagtttttagcatgaagagttgttgaattttgtcaaaggccttttctgcatctattgagataatcatgtggtttttgtctttggttctgtttatatgctggattacgttaattgatttgcatatgttcaaccagccttgcatcccagggatgaaacccacttgatcatggtggataagctttttgatgtgctgctggattcggtttgccagtattttattgagggtttctgcattgatgttcatcagggatattgatctaaaattctctttttttgttgtgtctctgcccagctttggtatcaggatgatgctggcctcataaaatgagttagggaggatttcctctttttctattgactggaatagtttcagaagaactggtaccagctcctccttgtacctctggtagaattcagctgtgaatccatctggtcctggactttttttggttggtaagctattacttattgcctcaatttcagagcctgttattggtctattcagagattcaacttctttctggtttagtcttgggagggtgtatgtgtctgggaatttatcaaattcttctagattttctagtttatttgcatagaggtgttcctagtattctctgatggtagtttgtatttctgtgggatcggtgttgatatcccctttatcatttttattgtgtctatttgattcttctctcttttcttcttcattagtcttgctagaggtctatcaattttgttgatcttttcaaaaaaccagctcctggattcattaattttttgaagggttttttgtgtctctatttccttcagttctgctctgattttcattatttcttgccttctgctagtgttgagtgttgctcttgcttctctagttcttttaattgtgatgttagggtggcacttttagatctttcctgctttcttttgtgggcatttagtgctataaatttccctctatacactgctttgaatgggtccaagagattctggtatgttgtgtctttgttctcgttggtttcaaagaacatctttatttctgccttcatttcgttatgtaccccatagtcactcaggagcaggttgttcagtttccatgtaattgagtggttttgagtgagtttcttaatcctgagttctagtttgattgcactgtggtctgagagacagtttcttctaatttctgttcttttacatttgctgaggagtgctttacttccaactatgtggtcaatttcagaataggtgtggtgtggtgctgaaaaaaatgtatattctgttgatatggggtggagagttctctagatgtctattaggtccgcttggtgcagagctgagttcaattcctggatatccttgttaactttctgtcttgttgatctgctaatgttgacagtggggtattaaagtctcccattattattgtgtgggagtctaagtctctttgtaggtcactcaggacttgctttatgaatctgggtgctcctgtattgggtgcatatatatttaggatagttagctcttctcattgaattgatccctttaccattatgcaatggccttctttgtctcttttgatctttgttggtttaaagactgttttatcagtgactaggattgcaaaccctgcctttttttttgttttccatttgcttggtagatcttcctccatccctttattttgagcctatgtgtgtctctgtacatgacatgggtttcctgaatacagcacactgatgggtcttgactctttatccaatttgccaatctgtgtcttttaattggagcatttagtccatttacatttaaggttaatattcttatgtgtgaatctgatcctgtcattatgatgttagctggttatttcgctcattagttgatgtggtttcttcctagccttgatggtctttaaaatttggcatgtttttgcagtggctggtactggttgttcctttccatgtttagtgcttccttcaggggctcttttagggctggcctggtggtgagaaaatctctcagcatttgcttgtctgtaaaggattttatttctccttcacttatgaagcttagtttggctggatatgaaatgctgggttgaaaattctttcctttaagaatgttgaatattggcccccactctcttctggcttgtagagtttctgccgagagatccgctgttagtctgatgggcttccctttgtgggtaacccgacctttctctctggctgcccttaaaattttttacttcatttcaactttggtgaatctgacaatgaagtgtcttggagttgctcttcttgaggagtatctttctggcattctctgtatttcctaaatctgaatgttggcctgccttgctagattggggaagttctcctgaatgatatcctgcagagtgttttccaacttggttccattctccccgtcactttcaggtacaccaatcagacatagatttggtcttttcacatagtcccatatttcttggaggctttgtttgtttctttttattattttttttctaaacttctcttctcgcttcatttcattcgtcttccatcattgataccctttcttccagttgatcgcatcggctactgaggcttgtgcgttcgtcacgtggttctcgtgccttggttttcagctccatcaagtcctttaaggacttctgtgcattggttattctagttagccattcatctaattttttttcaaggtttttaacttctttgccattggttcgaacttcctcctttagctcggagtagtttgatcatctgaagccttctactcttgactcatcaaagtcattctccatccagctttgttccattgctggtgaggagctgcgttcctttggaggaggagaggcactctgatttttagagtttccagtttttctgctctgttttttccccatctttgtggttttatctacctttggtctttgatgatggtgacgtacagatgggtttttggtgtggatgtcctttctgtttgttagttttccttctaacagtcaggatgctcagctgcaggtctgttggagtttcctgggggtccactccagactctgtgtgcctgggtatcagcagccgtggctgcagaacagcggatattgatgaaccgcaaatgctactgcttgatcgttcaagttttgtctcagaggagtacccggccgtgtgaggtgttagaacgcccctagtgcggggtacctcccagttaggctactcgggggtcagggacccacttgaggaggcagtctgcccattctcagatctcaagctgcgtgctgggagaaccactactctcttcaaagctgtcagacagggacatttaagtctgcagaggttactgctgccttttgtttgtctgtgcccggcccccagaggtggagcctacagaggcagacaggcctccttgagctgtggtgggatccacccagagcgagcttcctggtctctttgtttacctactcaagccttggcaatggcaggcgcccctcccccagcctcgctgccgccttgcagtttgatctcagactgctgtgctagcaatgagtgaggctccgtgggcgtagggccctccgagccatgtgcggtatataatctcctggtgtgccgtttgttaatcctgctggaaaagtgcagtattacggtgggagtgacctgattttccaggtgccatctgtcacccctctcttttactaggaaagggaattcactgaccccttgcgcttcccggataaggcaatgcctcgccctgcttcggctcacacacagtgcgctgcacccactgtcctgcacccactgtattgcactccccagtgagatgaacctggtacctcagttggaaatgcagaaatcacccatcttctgtgtcgctcacactgggagctgtagactggaactgttcctattcggtcatcttggctccatcccccgttttttattgacatataacaaattatccaaaaactagatatttaaaaataaaagtggtggctggcagccaagatggccgaatagaaacagctccggtctacagctcccagcatgagcaatgcagaagaagggtgatttctgcatttccatctgaggtaccaggttcatctcactagggagtgccagacagtgggcgcaggacagtggttgcagagcaccgtgcacaagccgaagcagggtgaggcattgcctcactcgggaagtgcaaggggtcagagatctccctttcctagtcaaagaaaggggtgacagacggcacctggaaaatagggtcactcccaccctaatactgcacttttccgatgggcttaagaaacggcgcaccagaagattatatcccacacctggctcgaagggtcctatgcccacggagtctcgctgattgctagcacagcagtctgagatcaaactgcaaggcagcagcgaggctgggggaggggcgcccgccattgcccaggcttgcttaggtaaacaaagctgccaggaagcatgaactgggtagagcccaccacatctcaaggaggcctgcctgcctctgtgggctccacctctgggggcagggcacagacaaacaaaaagacagcagtaacctctgcagacttcaatgtccctgtctgacagctttgaagagagcagtggttctcccagcacgcagccagagatctgagaatggggagactgcctcctcaagtaggtccctgacccctgacccccgagcagcctaactgggaggcacccccaagtaggggctgactgacacctcacacggccgggtactcctctgagacaaaacttccagaggaacgatcagacagcagcattcgcggttcacgaaaatccgctgttctgcagccactgctgctgatacccaggcaaacagagtctggagtggacctctagcaaactccaacagtcctgcagctgagggtcctgtctcgtagaaggaaaactaacaaacagaaaggacatccacaccaaaaatctgtacataaccatcatgaaagaccaaaagtagataaaaccacaaagatgggaaaaaacagagcagaaaaactggaaactctaaaaagcagagcgcttctcctcctccaaaggaacgcagttcctcaccagcaacggaataaagctggatggaaaatgactttgacaagttgagagaagaaggcttcagacgatcaaactactccgagctaaaggaggaaattcaaaccaaagacaaagaagttaaaaactttgaaaaaaatttagacgattgtataactagaataaccaatacagagaagtgcttaaaggagctgatggagctgaaagccaaggcacgagaactacgtgaagaatgcagaagcctcaggagccgatgcgatcaactggaagaaagggtatcaatgatggaagatgaaatgaatgaaatgaagcaagaagagaagtttagagaaaaaataataaaaagaaacaaacaaagcctccaagaaatatgggactatgtgaaaacaccaaatctacgtctgattggtgtacctgaaagtgatggggagaatggaaccaagttggaaaacactctgcaggatattatccaggagaacttccccaatctagcaaggcaggccaacattcagcttcaggaaatacagagaacgccacaaagatactcctcgagaagggcaactccaagacacataattgtcagattcaccaaagttgaaatgaaggaaaaaatgttaagggcagccagacagaaaggtcgggttacccacaaagggaagcctatcagactaacagcggatatctcggcagaaattctacaagccagaagagagtggaggaggcccatattcaacattcttaaaggaaagaattttcaacccagcatttcatatccagccaaactaagcttcataagtgaaggagaaataaaatcctttacagacaagcaaatgctgagagattttctcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacgagcaaaataaccagctaacatcataatgacaggatcaaattcacacataacaatattaactttaaatgtaaatggactaaatgttccaattaaaagacacagactggcaaattggataaagagtcaagacccatcagtgtgctgtattcaggaaacccatctcacatgcagagacaaacataggctcaaaataaagggatggaggaagatctacccagcaaatggaaaacaaaaaaaggcaggggttgcagtcctactctctgataaaacagtctttaaaccaacaaagatcaaaagagagaaagaaggccattacgtaatggtaaagggatcaattcaacaagtagagctaactatcctaaatatatatgcatccaatacaggagcacccagattcataaagcaagtcctgagtgacctacaaagagacttagactcccacacaataagaatgggagactttaacaacccactgtcaacattagacagatcaacaagacagaaagttaacaaggatatccaggtattgaactcagctctgcaccaagcagacctaatagacatctacagaactctgcatcccaaaacaacagaacatacatttttttcagcaccacaccacacctattccaaaattgaccacatagttggaagtaaagctctcctgagcaaatgtaaaagaacagaaattataacaaattgtctctcagaccacagtgcaatcaaactagaactcaggattaagaatctcactcaaaaccgctcaattacatggaaactgaacaacctgctcctgaatgactactgggtacataacgaaatgaaggcagaaataaagatgttctttgaaaccaacgagaacaaagacacaacataccagaatctctgggacccattcaaagcagtgtatagagggaaatttatagcactaaatgcccacaaaagaaagcaggaaagatccaaaattgacaccctaacatcacaattacaagaactagaaaagcaagagcaaacgcattcaaaagctagcaaaaggcaagaaataactaaaatcagagcagaactgaaggaaatagagacacaaaaaacccttcaaaaaattaatgaatccaggagctggttttttgaaaggatcaacaaaattgacagacagctagcaagactaataaagaagaaaagagagaagaatcaaatagacgcagtaaaaaatgataaaggggatatcaccaccaatcccatagaaatacaaactaccatcagagaatactacaaacacctctgcacaaataaactagaaaatctagaagaaatggataaattcctcgacacatacaccctcccaagactaaagcaggaagaagttggatctctgaatagaccaatgacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaagagagaattttagaccaatatccttgatgaacattgatgcaaatatcctcaataaaatactggcaaaccgaatccagcagcacatcacaaagcttatccaccatgatcaagtgggcttcatccctgggatgcaaggctggtccaatgtatgcaaatcagtaaatgtaatccagcatataaacagagccaaagacaaaaaccacatgattacctcaatagatgcagaaaaggcctttgacaaaattcaacaactcttcatgctaaaaactctcaatgaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtggacaaattgtccctgtttgcagatgacatgattgtatatctagaaaaccccatcacctcagcccaaaatctccttaagctgataagcagcttcagcaaagtctcaggatacaaaatcaatgtacaaaaatcacaagcattcttatacaccaataacagacaaacagaaagcctcatcatgagtgaactcccattcacaattgctcctaggaatccaacttacaagggacatgaaggacctcttcaaggagaactacaaaccactgctcaatgaaataaaagacgatacaaacaaatggaagaacattctatgctcatgggtaggaagaatcaatatcatgaaaatggccatactgcccaaggtaatttatagattcaatgccatccccatcaagctaccaatgactttcttcacagaattggaataaactactttaaagttcatatggaaccaaaaaagagcccgcatcaccaagtcaatcctaagccaaaagaataaagctggaggcatcactctacctgacttcaaactatactacaaggctacagtaaccaaaacagcatggtactggtagcaaaacagagatatagatcaatggaacagtacagagccctcagaaataatgccgcatatctgcaactatgtgatctttgacaaacctgacaaaaacaagcaatggggaaaggattccctatttaataaatggtgctgggaaaactagctagccatatgtagaaagctgaaactggatcccttccttacatcttatacaaattaattcaagatgcattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatcggagaaaatgtttgcaacctactcatttgacaaagggctaatatcccgaatctacaatgaactcaaataaatttacaagacaaaaacaaacaaccccatcaacaagtgggcgaaggacatgaagagacacttctcaaaagaagacatttatgcagccaaaaaacacatgaaaaaatgctcaccatcactggccatgagagaaatgcaaatcaaaaccacaatgagataccatgttacaccagttagaatggcaatcattaaaaagtcaggaaacaacaggtgctggaaaggttgtggagaaataggaacacttttacactgttggtgggactgtaaactagttcaaccattgtggaagtcagtgtggcgattcctcagggatctagaactagaaataccatttgacccagccatgccattactgcgtatatacccaaaggactataaatcatgctgctataaagacacatgcacacgtatgtttattgcagcactattcacaatagcaaagacttggaaccgacccaaatgtccaacaatgacagactggattaagaaaatgtggcacatatataccatggaatactatgcatccataaaaaatgatgagttcatgtcctttgtagggacatggatgaaattggaaatcatcattctcagtaaactatcgcaaggacaaaaaaccaaacaccgcatgttctcactcataggtgggaattgagcaatgagaacacatggacacaggaaggggaatatcacactctggggactgttgtggggtagggggaggggggagggatagcattaggagatatgcctaatgctaaatgatgagttaatgagtgcagcacaccagcatggcagatgtataaatatgtgactaacctgcacgttgtgcacatgtaccctaaaacttaaagtataataataataaaataaaaaaataaaaataaaagtaagaatttattatctctcacggtttctacggatcaagaatcctggcagggttcagcaggatggcttttctgtatgctacaaagcctgaggcttccgctagcagacttgaaagttaggggctggaatcatctgatatctcatgccctcaaatatctaagctaggggctgggatcatctgaagactcatgccctcacatatctgccagttgttgctcagggttagctgagaccacagctagagctagcagctggaatatgtccatgtggcctctccatgtggcttgagtctcctcacaacatggtggctgagttccaaagacgagttctgagagaagctgtattttttatgacctaggctcagaaatcacataacaccatttacactgcactccactggtcaggtcagtcacaaacccccacccagactaaaagaaagagaacaacagccttgccgccctcaatgagggagtgtctgttacactgtaagaagagcacaggattggataaatgtgctgatgtgatcacctttggaaaatacaatctgccacaacattctttacaagcacatatgaaacataagcaaaaattaaacatatagtaggcctgaaagtagtttcaatgaatatcaaacaatagatatcaaaggtttcttattataatgcattaaagttggaaaagaattactaaatatgatttttaaaatatgtttgaaaattacaattttatgacagtttccctttgtgaattgggattagacaaggaccttaactaaatcccactggatgaaggtccacatctggagtcaaaagagatcactaatttggttgtggatacattgaatttgaagtgccttagagacatctaaaggaaaatatccaggtaagcagttgggtagatgggactgtagctaagaggggaggtctgagagtggtaagttatctgtaagtaggaagtaactgcagttgtgaatatggatgtgactgtccagggagtcagtataagtagaaagacaaaagggcctaggactgatccgtgagcaagttcaacatctaacagttgtgttgaggaggatgaatcctacataagagagagaacagttgccagagaagtaaaactaaatcctcaagattcacagaaaggtcaagcaatataaatactaaaaaaagcccaataggaaggtcatcgaggaactcagcaggaactgttttgtggactgatggaggcagaattcagtttggagttggttaagacagaagtggaagtcattaaacaaagacaatgagtaaagacaatcctagataagcttggctgtgactggggaggaaagagtggcaactaaaggacaaagggctggaagacggtttgtttgtatagtttttaaacagaaaaaaggccgagtatgtatcaaggtaatggagaagatctatttaagatgcagagtgagtgtagaagagaaagggtaaccagtactgaaggttcctgagaaggttgaaagggacaggtggtaggactggttttaaactgagctttggcctcaccgtaatcatatagtgtcttatgataggaacccatgctattgtcttaatgcactactttatcgtgtgtttatgttttctcaccctaattagaatctaagctctataaaatgtatggcctttattgttcaaaccaaccccaccttactcacacattgaaaaccccagattctatcccagcacccaacagtcattcaataaacactcatgtgtcacttagtaatgggagtatattctgagaaatgcacccataggtgattttgtcattgtgcaaacatcactgcatgtacttacacaaacctagaaagtgtagcccactatacacttatcctatatggtatagcctattgctcctaggttacagacctgtaaagcatgttactgtcctaaatgctgtaagtaattataacacgatgataagtatttgtgtatctaaacatctaaacatataaaaggtatggtaaaaatatagtattataatattatggaaccatggtcctatttgcagtccatcattgactgaaatgacattatgtggcacacaaccatacttgttgaataaactaatacaagcagattctatcatctttgtgtacatctttgtgtaaatctaaaaatgtgtgtgtgtgtgtgtgtgtgtgtgtgtgtgtgtgtttgtgtgtgtcctggctatccaaaatgcgagcaagtcagaacccaaaagttcttgttccagagtatagatatctagacaatagtcaggaatagccactcaaattagccctctctttcccatgttttccttgacctaaaaatccaaggatctaaactacaggccatgaaaacattttcacctacagttacaatattataccacttcccactttcctcatgcctaattcgtccatattttgttctagagcagacaaactctgtatccttcatttgacctcctgcaagacataaattaaatttaaatgaatccaaatactttgggcttcagttctcctaaaagaaataaacatggaagtagagcagtacaggccagtaacacactgatttatcttgctgatttttcagaggatagccctccaaaaaatctttacaaacctcaagcctctcaatccatggatccaaaccccagctcccttaaaaataggtctgaatttaaacaaatatctttccgaaatatagaaacctgctttgatggtgactcatcttatcccagtagaaacctttctctgggtaccatccaactgcaccattcttaaggcaacattacctggaactgagggatttgcctctattgttgcattctgcagccctcacctgacttaactgccacgttaaggaattggttattgacctttaagtctttaacaattatttacatacctaggaaagagtctgtgcattcaggtacaagaatgaagacaccgaataaattcagccctcgttttcatttttatgctacgttcagtgagctgttactgcagacaaattattgcagcattctttcaaatgatagccaattttcaactaagagaagattcttaaacccctttctaaaaccttttcctgcatatcggtgaaaaccaggcagttggaaaacacagccctggttaaaccacataataataaattaatactttaaacacatggaattatttaagaatctgcataataatttaaaccctcataagacatagcagcaaaggccccaaaaacctaacacttctcagatatattcctagaagttttatttcaatttatatgtatgcatttcttacagaatattttcagaatttctgaaactcagatacatttagagtccagggaggtgaccagaataattcttacttttgttatttacctggggagctaatcaatattgttaaaatgtaggtgaaagtctttctatttgaccataagttcagcaataatacggaccacatctgtcttgttctatattaaatctacatcttctagaacactgtctggcacatatactccgtaaaatttctttaataaaagaatattataagttttcactattactaggaatgaaaattgattgcaaattattaaggaaaggttagttttgagttttgttcttggttttcattcattctcttaatttgtaccccatgctttcacaaaacaataagttatctctctactgaagcctacccttctatggcctgagacacatacacacaacacgacatgcccttgccacatctattcaatgctgtcatatttgccatgcatcagaaaaataaatttaccaagtagcagaagctctggaaaatcattaggtgacatctgaggagcagaataccaatcagccaataattagcatctgaaaattcatagagtcacagacaaatcaaattccatgaaatctcagggagcttggctccctgaccctggctgggttggtgcccaggcaatgggtaagcagtaaattgtgccaccccaacaggactggaaggtgccatggctagtctaaccccagggggagacattctgacaatgtggcatttgcacagggatgccctaacatggccccagtatgttttctcagaacgggatgacattttaagtcaaatagctctgttcccaatagcacaggtcctctcccaaactctaatagcctgaatttgagaaaaagaggttcatcttggggagaaactgatgttttgcagatgcaatattaaaacaatccatttataaggaaggcaaaaccagatattcagtgtttaacttcatttattacctttccatcattacatagacctcagatagccttagacttaaaaagtcattcacatttaagcaaaactctgttcctggagcatctacactggatacttttcaatgaatgctgaaactggttataaagttgtgctaccaagaggcatgaagagtgactgtcagtaccttaccaaacccctgctgactggaacatgcaagtcagtccaaggatgcagggccaccactgttactgctgcctccagcctaactaaggtcacctttcctgcatgcctgcctcattctaaaggaagaaaacagagaggttggagaataccagctccccatttggtttctacagttgccaactctacccacatgtgacttggggaaagcacccttaagaagagtggggtccaacgtccaaccagactgacccagccttgggggtaaacattccacctccaccacgtggcctgtgtgcacctgatttgaatctgctcctaccctgagccaagggtgaccattctgccaggtccccactccactgcagggtcaggcagcagcctctgctcctggctcctggcccagtgctcggatggcccagcaacgtcactgcggagagggagtctggttgtgccctcctctgaactctccatctggaagactctctagtctccttccctctcatttttaatctgacagacactgcggacagggaaactcagagcagaccaaagttcatcttccctttcctgcttcatggctggcataatcacaggggcagaacaaggttggcatggaccaggatgccaggaattaaatgagggtccctgaccactggaacacattagtcctgccttccaaagtcttaattagtcttcctgtgcctggcacacctaccaccagggaggtggccgggtaaggtgccatgctcacagcaagtattcaacaaaatattggtagagaatggcggtcacaaatgcctgctggctcatggctttgcaacaacagtcagctctgaggtctgggcaccagcggcaagatttctgctctctttactaatgcagacagttctagcagcgttattctgagtgatattcagccaccagctcaatttggaagcaaaatgatcttaacaaacagtggcagacttgatagacaggctgctgagcctggggaccaaaacaaaggatgaaaagaaaaagaaaggaagggttgatgacaagacgaggagtgggaaatgaatactgcaaagaaaaatgaggaggattacagtactagatacttcagtccggcaactctgaaatgagctgtgaacataacaacagactcaagggtggaaacaatggggggaatcaaggcaacggaacagggcagcatctgtcacgaattttgatgctgggacagacttagcgctagcagtggaatagatttgatagtaagtaatatttgagaggtttcaaaagacaatgggtcttaattctgtcctgttttgcacctcttgaactacagtgacataccaaaatttgctatttttctaagaggacattgacagatacaatgaaaattgtgaatacattttttccttctgcattcattatctctggcccttatccacaggcctattgcagactaaattggattttggatcactggtactgaggtgctgcaattaattaacaatagaaacataatatttatatccaggcctaacaacatctgacatttaaactattctgccagtcggacaaattccattcgacaaattttcattttaatgaacatgacagaccacagtttgcatgataggccaagcagcagaacagagttgacctcttggcatgtgttttcaaggactgaccatgctccagaagaaacaatctgagaaactgtcagaataacagaaagaccagatccccagttccacccagacagaccaaatacataccaccctcatgtcccccagcacagatcctagtatgaaactgtcctcatttcatgtgcgagctcaaagttaaatacttactgccccttgtaatccactggataatttttctatctttgggttgctgacattttctttggggtactgaagtcccttagcccttcctaattaaaaagtgataaacatttttgcaaggcatccaataatgtgcaaagtacacaagagttggaactgatgcagctttttcagttggcacaaaactggccttccacattttgccagatggtgtatctcagtaagtccccaatccctgactcgagtgaggggcattgtcaatatgatgctgaagcagagactatctttaaatgctatcttattttgcattatactaacacgatgggtctaacacttattcttgctgaaactttcacagctaaagaagttttcattcttctgtgactcattattcaagccaacagaatatgatacagataaggggaaaaattctgcccctcttaagaaccatataaatttgctggaaaccaatgtcagagagcagatctcccagcaagacttcccattgctcctctatgggttactggtccaaagcacactgggtgaaatagtatgtatttacccaagcccatctctactaccccaaaaacgtggatgtcaaggatagagataaagatgaaaaatgcaaagacagcaaggcagatagaagcttaatagatctgggaaataagtaaggtcagtgaaaaacaatatattgtagctgggatccctaagggccgtatagttctagttcacatatctacaacattccttattctagtttttatgtcaattcaaaagaactgaaataaaattccactttaaaagtaatacttctttggagtagggatttggttcatgggttccaatctcagcaactgaaatgactacctacatggtaatttgttttcaagctgtggctctgactagacccaaaatggtaaccatgcttatgttactattttattttattttattttattttattgacatggaatctcattcttatcgcccaggctggaatgcaacgatatgatctcggctcactctgcctcccgggttcaagcaattctcctgcctcagcctcccaagtagctgggaccacgggcacatgccaccacacccagctaatttttttatttttaatagagacggggtttcaccatgttggccaggctggtcttgtactcctgacatcagctgatccacccgccttggcctcccatagtgctgggattacaggcatgagccaccacatccagctcatgttacttttagatatggccatgataccagaacattaagcactgaaaggatgacagcatttccaccagtgtaacctaatttagaatcaataatgtgtcactcaaatcggcagcatgtacatatatacatacagtgtggatggacacacacacacacatatatatatacatacattaattatagtaatagccacatgtttgaggtttttacatgcatcttctcttatataacaccatgagataagtactattatgaactctgtaacacactgaggaaagggcagttacagttcactgacctccttaagaggtaaagtcaaggtcacaggcatgtaagcggcagagtttaagtgcaaatccaagtctgcccttcctccagagcctgtgctctacacaacacagtggcatatgacagcatccgcaagggaaacagcatgaaggaattgattccttttggcaacagtcaaaatatcttttaaatatcaggtataaaacattttcagaccaccagatgcttattcaattttgaaaaatcaatttttatggagttgctatgagtagtttcatgtttgttaatgcctggttatattcttgaaaaagtagcggcctcatagagaaaaatatatatatttttttgaaagttgggaagaaaaatgagaccttaactggattaaattgaaaatatttgacagaacacaaatgaatagaatctgtaactttaacatgcctttgcaggaggcatgttctaaaatggtcataccaaattcagaacacaatagacttaacatgcttcttgttgtaaacaaaggcattgggttaaatgaaagttccatcaaagcttaataaccaattcaagtgaacacaaagttaagcgttatatactttctgcggtttcagtaatagctaatctaataatggtaaatggagggttattgttgattcctttgcctgtttcataaattagataaagcaacgtggaagttagagtactttagagttttattggactaagtgattttaaagctatctcaaaatataacgaagtcatgacttgaatgactgctgagttgtagcttgttttccatcaccatgttagtacttttcaccagtgttaaataaaaagcttcctgttaactaaaacaattctataaatacaatgtctatctacagaaccaaaccatttaaggtaaagtgtcattgatacagtatgatctgatattctatttcaccagggccaagcttataaaatattaactataagagcagtcaagtgttatttatttcttctgatacaaaactcaggaacagtagaatttctctgcttaatgattttccatagcacatttccaattttctactacagtttattgatctggaatactaaaacagttttcttccctgtctaaagaacacaaaaagccctgtgcccctagtcccatgggatgtgcctccaaagataacagtcgtggcatctcatcaggcgctgaggggtggtaatgagaagcaaggcattttccttactgaaagaaggtgctagtcaaatctcaggccttttgataacgggaaacacttcccaagcctttgcatttggagatgaggctccacacctgcagttctgagagcagatgagttgcccttcacaaaggcagtctattttcctgcatttccccttcatgccctgatatggttactttcaattaccctgatagtccaggaagaaaaatatccctctctccatatttcattcacataataagaatctgcaagctgttctgtatgacagatgaggactgtgtgctgaagcaacttgttccgcctgtcagcctccgagaacccacagcaatgagatacaatcgtgatgacattactagagaagaagtgggtcaaatacatggtcactttaaaacagaatgtcaaccattctttctacttcagtaatttgatgcagtggtactcaaaacacagacagagagagagaaaaggaaagagagagagaaagagaaaaaagttcaccactattagtttagtgtccatacatacacaaatgcaaatgcaaataattgttaaaattactgttcccatatacccttacatgacttttttcatcctccagccaattagtcaagaaatgtttagtaagcatgtggtatgagccagacactgaaatgggtagaatgctgaaaacagacacagcccctgccctcttagagtttacagtctaggataaaggacaaagattaacaagcaattgagattaatgtaatgaagcctgaaaaaaaacgaagtagaaggtactaaaagagcttacaatataagaactaaccaagtctttcaggtcagtaaaggtttctctgaggaagagacatttaagttaaggtcagaagtattagagcagccagataagaggtgagagagaagagtgacaagtggaggacttttctcctcagaatgtttcctttcaaagaaaccattaagacaaaggcctcaggacacagtagaagatataatggagtaaatgacgccatcaagtctaccattgggacttattgtctttccttatttcaatccctagtttagaaaattaatttttaaaaaaaatttttaaacattagtatacctctgtcctatcttgccacataagggcaaaagttaatcataatcacattttcttgctgatctaaatattaaggtagattttactttaaaaaatctaatttatcttgactgtactggttaaaatccatgggttatttttaaaaatatgttttgacagcagtgaaacttgcagcacatacaataccaagagcataaatttgttcagggtataagtacatgaaaattaatataagcagttggtaaatgtgacttataaaaaaaaagactgtaccaactacatgccacaatgggtggaaataaagaagaaaaaggttctttttctctaatatttggtcatgaaaattctgatttgttcttgcagaaaattgtttttggatcattattcatctctcttacagcatagaacttttttccatgggatcaacaaattggaatggagaggaaaaaccggatatattcatgagtatgtttgccctttctactaaagcccgagtgtgatgttcggattattttctttccaaactcaaaatccattcccagaatccaaaatcaataaaaatggtactagcaaaactgagggttgaatttggcctaaaaactcaatgactaagtagagctactaatatgaggagaggtttttaaaaaaatgtctgtagttattaatcaccagcaatgactttagcagctgctctaaagtaaacacaatctacagctactttaaagcaatacagtgtaaaaaccatgagaattaacattctactgggtgaaaggtggcagaatatgccaccccaaaatataccacattggcataagaattattttcaagctaaaggcacttataaaaaaataatttaaaaaaaaaaacagcaggtgcaagaagggttttctgaccctcttctttttcttcataaaagcaagagctaaaatccctgtatggaaaatattctcctgacaccagaaggaaagtaacattcttatcatcaagggcgggatactgagaccaagagaactctgtacaaacaaaccttattaaactagctcttattttcctcgtcacctctccacccagttaaatatcctggcccaaggccctttgccttgtcacatcttcacaatttactactctttatccaattccatatataagtgttcaattctaacttcatctttgggtcttcatttccttatgagggctcccatgtcacaaaaaaacttacattaaataaatttgtatgcttttcttctattaatctgccttgtatcaatttaatttttaagcccagccaaaaaccctaagaaggtaggggtgaaattttgcttcccctacatctgttacttaggtcttatctagagttcaacctgaaaggcatattttaggaggaatattggccaaactggaaaatatctccaagaggacaactagaatggtgagaggttctgaacttcacataagaaacctggggatgttcagcctggagaaaagcaatgggagacagcaaaactaccttcatacattcgatgggtcattcatcaataaggccattccgttttactgagcacttcctctatacaaggtaccatgcaaggcaaaggagatacagcactgagagagaaagccagtcttttcttaccatgcggaagggaaaatggattttctccatgtcacttcacaagatactgtagagtagagcagagcacagattttggaatcagagcactagagtaaaaacctgtactgggttgaatgccattccccacccctccaatatgtctgtgtcaaatccctggagcctgcaaatattactttattagaaaaaaaagtctttgcaaatataattaagaatcttgagatgagatcatactggattgtctgggtgagctctaaatataatgatcagtgttcttacaaaagaaaggcagatgcagacagacagaaaagaagaagatatagaagagaaggccaaatgaagcaaacagttatgtgggtgcaagccaaagaatgcttggggccaccagaagctagaagaggcaaggaagttttctcccctagagcctgttgagggagcatggccctgccaacaccttgattttggacttctggcttccaggactgtgaggaaataaatttctgttgttttaagccaccaaatttgtagcaattggttacaatagctctagaaaactaatataactcccaattacttagctagctgtagtaccttactagctgtgttacccattgctaataactctagccctctgagaaccaggccctcattaggaaactggagacaatagaaatactcatctcacaggtcagagattaaggaggtatgtcaaacgtgcagcacagggcctagaacaaagtaagttttcagtacataatagtgttattattaatggattcagatttactgggaagcttgtgtagaccttagaacaatatatcaacaggtgtaataacagctaatttatgcagtagggctctctctactggtaaatatatgtagagaccagataaatcattttccagaaatactggaaaagggatgtttatattgtttgggaggctggaataaacatccactagccttccttctagatcaacccagtaaccatttctccttggtgcatcaggtcaagatccttaggcaggttaacccagtaagggaagtgaggtatacacagggtttggctgctaccttaaaaagtcccttcccctcgctgtaccttgttgtctttagctataaaataagcatattctgatcatgtcttagtatttccaacttgaaaatgccaagacacaatgagaaagacttggatcaatgagatagtttgggtatttgtccccccaaatctcatgttgaattataattcccagtgtcagaggtggagcctagtgagaggtaattggatgatgggggtggatttttcatgaatggtttagcactatcctcttggtgctgtcctcataatagtgagtgagttcttgtgagatctggttgtgcaaaggtgtatggcacctccccttactatcctcttgctcctgcttttgccatatgacatgcctgctcccattttgtcttctgccatgagtaaaagctccctgaagcctcccccaaaatggagcagatgccagcaccatgcttgtacagcctgaagatctgtgagccaattaaatctctatttttttaataaattactgagtctcctgtatttctttatagcaatgcaagaatggcctaatatcatcacacacttaaattttctgattctcagaaatgaagcaattagactagagtaaggattgctaaggaccagttgacaaaccaggaccaaaccataatattgtttttaaccagtacctagcaaaatgagaaaaatttaaaaaataataattttttaaatgtctttgcttggcagaattaaaagttagcaatcctatgtcagctcccatcctatctcacttcctaattcaaaaattatgtttacagcctctgaaattctaaagttttggaactggtatatcacagaacaatctattaaatttgattcctacactaatattctgtgatttttttaaaggacatttcagaactgtggattctatcactgacgtgttcaagttcaagaataagaagtcatccttttagaatttaaaaatactcactggtaaaatcatatagaactaaatgttcacaacagtaaaatggaaaaatctaaataaaatgagtcgctagtaaatatgatgctatagttttacaaaatgttatcatgaagagaaattgggtaacgcataggcatgaatctctctatactagttcttacaactgcatgtgaatctagaactatctaaataaaaatttcagttaaaaaatactcactgggttgtgtgcaatggctcatgcctgaaaccccattttggaaggccaaggtgggaggatcccttgagtccaggcatttgaaaccagcctggacaacataataagaccccatttctacaaaaagtttaaaaaaaattgctaggtgtggtggtgggcacctatggttccagctactcgggaggctgaggtgaaaggacctcttgagtccagaagttcaaggtggagccatgatcatgccactgcattccagcctgggcaaaagagtgagtctcggtctcttacggaaaaaaaaaaaaaatgctcactgggctctaaaagttcttaatgttgtttattaattcaaacaatggtcagattcaaactcaataaatataatcaactgtgctttatacatagcatatggacagttactatgaaccatttgtttggcaaagatgtactgaggatcttctatattccaggcactatgctaggtactagagtctggtggccaactcagttcttcccttcacagagagtaacacctagctggagaaaaaggcaataaataaagagacaacttcaaattgtaacaagtgctatggaaaaaagaaaggctgaggcagaaaacacagggagggataaggaactacatgagccatacatatggaaaatgaaactgtgatgcaggaatgtgcccttattttttgtatgcctatattattgaactggcataaattctgaataatgaaaatatgtgcttgggttgtgactgtggtgggctcttaaaggtaggctctgcccttctgcaccaataaaaggagtgagaaaaaaaaagtaaagttgacatttgcctttaacaaataaggcaatacaagactgtccatatgtaaaagttaaacatacaatgggggccgggcatggtggctcatgcctgtaatcccagcactttgagaagccaaggctggtggatcacttgaggccaggagttcgagaccagcctggccaacatggcgaaaccctgtctctacaaaaaaaaatacaaaaatcatccagacaccatggtgtacacctgtaatcccagcttcttgggaggctgaggcacgagaatcgcttgaaccagggaggtggaggttgcagtgagctgagatcttgccactgcacttcagcctgagggacagagcaagaccttgtctcaaaagaaaaaagaaaaaacgtattccataaacatacaatggacacagcactctgtgagatgaaattctttaaaaggtatgtgagtcataatttcccatatatgcccaccaccccttggaggaggaggggttggctctctacctaaactagaagataaaactctctcataatcaaagacaggggaggaccagggaggtcttcaagaggagaaacatacctttgaaattctctcccttcttagaagattcagaatatttcaaatactgcaaagtatgccctgggagccagtcaaaatatgtagtaggccagaccacaggactaggaaattaagatacagctgcctgctcctattaggcctaggtgcagggccagaatattaaggttaacttgggcccagtttggctgaaaagacacaggcttcaaataagactggacaggagagcaggtaaataaatagaatattcacataatggaacattatataacagtcaaaccaaataaagcaaggtacagaacaatgtgtattgtacaatatctttatataagaaaggaaggaaaataacgtacatacatatttgcctgtgtgctaataaaagtggctactaccttaagggagatgggtacaaagatgagggtatgagaagaggagcaagaacaaaatttcactttatacctttttatattgttttgtaaaaataaagagctaaaagattataattctcattgctggtgttagtcacacatttggagagggcaattcggtggtatacatccaggtccttaaaactggcatatccctagacccagaaattccacttttgaaaggaagttatctaagaaaataataagagatttgtgtacacacacacacacacattcactgcagaattatttatcatagttaagaaaatttttttaatctacatgtaaaataataaagaaccagtgaaggaaattatgggccatctaaacaatccagtaacatgcaactgtcaaaaactacactgtaaaacatataccgtagaatactcagtggcacagaaaagtattcatagtatattttttaaatcattcattaatttttcaataccttctttagagcatctaccaggtactaggcactgagctaaatgctgatttaaaaggccagttacaaaacagtatataaatggacaattccattttttgtgcatctgtgcatttataactagactagaaggatagacaccaatatgagagtagtgattacctgagtggcaagattatgggtgaaatatattttctataatgaacatatattatttctgcaatatgagaaaaaagcaccacttttttaatcaggctaacaactcccaggatcaagaatgtgtctcattcatctctctgtcctctcaccccctcctgactccctgaatacaaacatgatgcttgcttcagctgcagcaattctgtggccattatggaaaggccaagaactgcaagatacactctccttgacatctctgagctgctgaactaaagccaaagctaaccatttctagacttctttttatgtggaagaaacaaacctctattctttttaagcaggttacttgcagctgaaagcatttgaagctgacatagtaacctattaaataatacatgacacattaaggccagtacaggcaacccagcaaatttctttgatcaaccagcagaaactgaagactgatgtggttaattgccccactagcttctggctctgtattctcttctctgaagctcctgggaagtagagcccaggagaagctgttagtgaggattcgagatccataggggagcactgcttgctgcaaagaaaaaccaggcagctactcctacagctttacaacgtggcccagcattcccactcctggaaatgtctcctaagaaaaaatcatgaatgtgattatgcacacgtgcaaatacatcagaaaaaatggtgaggaaaacctatatgttgaccaagtgggatagattaaaaaataatgtcatgttctaacagtggaatactctgtagacattaatgccatgggaaaatgcatacaatatattgacgagtgaaaacagaaaacaaaactgtatgtaaagtattatccaaatttagaaaaatgtgtccattttctgttagaaaactaacagaacaaatatgcatgcaataaaaacaatggaaaaaaagccacacactgaaatattgatagtgctatcatgaatgggtgaaatgcaatgttattttattttttgagtatttctatatttttttaaatcttccaaatttattttcttgtgcagttggtaagaaaatttcttctaaatagcaccttcttacagaatattctgggccctccgaccaagatgttcaattcatccacaccaactttgtctaatacctgcctgcagatccaatggagttaacaagaaacaatttatttttgtgttttaaaaatagacatggcaacagctgtaagctaagctacagaaaatgataaagaaattttatttccaaataaatttgcattgtataaatgcagtacattttctttaattccataaggttttgatactgctaatttgagaaaaatattgatgtttccttaaataagtctaatttgtattgaaattcatcccctcacttgaaatggaatgatcttgaaaacaataaaaatgaatgttaatttgctatgtcattgataaaagcaattccttttatatccttgtccttatccattagacttcattttacagaaaaggtagctatcaggcaggtctgacctttttgccacctaaggacattagctattagagctcaagctccctagccggatggcctgggtccatatcttaggcccaccacttgccaactgggtgtccttgagcccttgtttaacctctctgagcttcagttttctcgtgtgtaaaacaaggataatacaagtatcgactccatagagttgctaagaggatgaaatacgaaaatctacataaagatcttagttcagtgcctggccatagtaatctaatttaaaaaaaaaaagtaaggtctcttttaacttgctttcaatttttatgtgcagatagatcatggacctgaaattttaggtcctaaagaggcccaagcatcctggtttaagaacccatgttggaaaaattagctgggtgcagtggcgcatgcctgtagtcccagctacttgggaggctgagacaggagaatcgcttgaacccaggaggcggaggttgcagtgagccaagattgcgccactgcactccagcctggatgacagagcgagactctgtctcaaaaaaaaaagaacccatgttggatacagatacttgacttttaaatgcagactcagtatcatttacttagcgttccctatgataaatgagatgtttagggaaaatgttgggtttttttagaccactggaaattgacttcagcatgtgtattagagaatgtaactaccccattcaccttgtcctgtccagtactttcactaaaagcaaggtattgtgaccaataataaaatcatagctaaaataatcactaacatgtcattagtgcttaatatgtaccagaaagtgccctgtgtgttttcatgtattatctcatttaatcctcacaactaaccaatgaggtaagttctcttactatccccatttttagatgagaaaactgtggtataaagagccaggaaagtgctaagtcaagatataaatatagtatgtaacaatatactatatttactatatgtattataacatatactataataatatatttttgttataatatatagtatattatattatatgttataataatataatatagatatataaatataaatatatattattgttatataatatatattatggtaattagtaataataataataacacagcatcattattcaatccctgtgacctgccaaatgcagctctagatgccttcccagtgacatctcttgtgttgacaacaatcttttactattcttatttaatggatgaggaaactgagaacttaaatgagttacttaagatgagctatagctctgactggttccaaagccagccactccagaattactcttctacagagggcagggaaaacagctcattaggtccctgaagtgctctacccaggtcacagaatgttggagaggaataggacttcagaatgatcagatccaagccctcactttacagatgtggaaagggaggcccagagaaaagagacttgcataaggcagtgggagagccagaactaaaacctgggtctcccagttgacatgatgtagccatctcatgttgagtcagctatctcaggcactgtgaaagcaggaagggaaagctgacagcttcagagtgatgacagcagactgtcctccctctctctgctccctgctgaccctgggactgctgcatatgcttcctggcccactcagagtagcagcaacatgacttgagaagaggctcttcaggagagaacccacaatgaagacaggaagcacccatgcccttacatgatctacctagggcccatttccaatggaatccccctgaaatagaattaaagatcaatggagatggagggttgcctcagacacatgtgggtctcttttgtagacatacaacacaacctaaatctttgagaacatgatctgactcaacaaattacctgcattttttctgattaaatgtacatccatcttagtttgtatactggataaaaataaaccaactcgtacagaaagttttttaaaaatagagttttggggtgtttaattaaaaatgctttcagtattatgtaatccttgaaatacaacagttgtttactctgctttgatttctaagctttcctttgatgacagatattaatatttatcatttttctgatgttggactaatgagaatcttaagtgtttatgagaagccatttaaatattacagtactgcagatatgtttgttttctgatttatattcctgtctttaacatcaaccaggatttatttttttgtgctgaatcctgggttgttgttcatcaacattttcagtaaactttaaatagccagaactgatgatttctacatttatttgatggtcaaagtgaatatgaaacttcaccaaataacatagtactatgggaaaggtttagttatgatttataaagtaaaaactggaatgcatgtataactgctagccaggaatagagtaacattccaggtttaatgacactgatctcaggtcatacgtattgagtgctgagtatgtatcaggcactgtgtagaacataattgaaatcaatgatttcacttgattcttacaacagctctaagagctaggtagtattatcatctccattttacaggaaagcgaagctcagagaggttgagcacttcactcaagatgacacagcaaatgagaggcaaagccagaagtgagtcctcagggtcagataatgggctcttatttataattcctctctcaagggtccctctgtgactccccagtatttgaaaaatcttattctctacaaagtataaataacccatctgcacagagcaacagtcttcagacaacccagactttcagatcttgatggctatgatgagtcacacctcattttgtttatcataggccatgcattgttctatgcatggagacagcaataaacagcaccaacaattgtccctgccctcatagtgctatctttctagagagggaagatagataatattaacacaataaacaaagcattatcaccattatggggaggaaacgggaggctatgcaaattcagagaaatagtaaaaggggatgaagtctgcagtttctgtagatttcacttgcatatactccccatgcagccaagactcagctaaccagagaaatgacttacaatcagtaacagaagatggcccagaagtagtgtggtacagtgcaaaatctaacactgaattctcagttagggacctgacataaatcactcaccctgcataaggaccaggtgcaggggagacagccatcagcaaaatagccactaccgctgcccttcatagagcttacagtccaaagggaagagaagcattgatttaaaatcaaaggttaaataaaagctgtaaaaagtataagaaggaagcaaaagacacaggagctaacctataggagactaagaaaggtcaacattctgccaattgcactgtctgtgacccacaccaagtcatttttcctctttacagccagtttttcaaatatgcaaataaaggagagtagactagatgaatccaaccagcttctttcaagctctttttaaaaatctcttgaagccatgattctaacatataaaaattatgtatctcctcttctttccaccaattaaaagatcccaaactgtcagtccctttcattgtattcatctgcctcactactgctagggctttgttcttgattttcactgccatttggcagagaagtcaaatcaggagggatatggatgtgataccgcattagggggcagaagtgggtatcgcagatgctctgatcagaacctagtgaaggaaatgagaaggaattgggttatacaaatggaacctagggtccagagagtgtattaacaggtaacaaattagcctgtggagatagtaggcattagggaagcatcagccaggactgtaactcatgttctggccaaagggaggggaaaaaaaaagtctagaagtagtggagaagcagatgagtggaagagaggtctagacagcaaacagcatggatccaaccacaatactgagatccagggacaggagcattacccatgggaaaaaaatccaaattccatactttgacttcaaggccctgtatggcctgggccctatctatacagccaatttcatctgatgtcagtctccctttccctctctatggttcagccacaggggccttcttttctccctttgatggtgttaagctctttcccaccttaaggccttggtataggctattccttctgcctgggaccccattctattaataccagctcttcatatggccagctccctctcatcctttacttaggtctctgcttaattctcagctctttctgtctggccattttatctcaataggttactcatccctctttctatcacagtatcttataatcttccttcttgtacttgacatattattattacaggtgtttgcctatgtgttatctgtccccttcactagactccatgagggcagtgctgatattttatatagatcatcccatttaattcataacaatctacgaagtgggtactattatgtccattttacaaagagaaataaaactgcaaagaaaaacaactggccatatatatatatatatatatatacacaaattctaaacaatactactcattacattaaaacagaatggcaacttagtagaagccacaaaaatctgaaatctttttatttcaagtgtagcccatggaccagcaacatatatatcacctggcagcttgttggaaatgcaaacacttctggcctcaccagggcccttgcatatagttccagcagtcctcaacccacaggagttggacccagctgttccatctgcaacaggaagccaaacacagctaacacctctaggccagggaaaccttggcctgttgccttgtggaagttcaagaggctagaggaagccttagtttagaggaagctttatccctgctcagaggagccaagagagggcctcagctgtagatttttctgaagcttcttggccttgtttttatccaccaggctggcagaacccagcaaatgggatttcaaactacagtggctacctgttttgctgtatccctagtgtcacatccctcttctgaaggtatcagcagctctcgttaaccagggcctttctgtgtgtacagccctgcaagctttgcacagcacaactccagcaggcaccagtcacatatactctggtatgaatggtggcctctgatgctaagaatgtggcagccctggcccacttcctctgggtgaatctctcctctcccagggtgggcatttgctccacacctggccactcacagtacccctccaactggctatagaaacaattccaagtggtaggcatatggcccaagctagaactccttcaatctgctgtaaattttgaggtattatgggcaaatagatatatttcagcccatacaattgagtctctctaaacttgatggaaaaaatctgggatctttaaggtaacatgttatatctgattattaagatgggaatttaaggtaccttgccttctaatggaaatttatgtagccaattacagtgcccccttctttacataattttaacccattgggattgctttctaaccagtggttcttggccctggctacaagttagaatcactagagcatgtctcgtccagatcaattaaattgggaaaggttggtggcacaggccttggtacctcaatttcagctgcgctagactctgactactcatctatgtaaggcgtcccaaagtggcatatggtgtgctacatagtctatgcttccaggcaggccaacaaagtggtagactacatccagtgaaaatcagacctgccactttctgatgatgtagtaactgacaggcagagactaattttacttacacaagtggctgtaaaacaaaatattcccctctctctccaccccaccattttttgttgttctacctctcccacactctctgcatttgttttacctccctcttgcctctcctgctctcccttggatttcttgccagggtcattcctagaagagattgaactggaatcgctagtgctccaggactgaaacaatcttactctaagcaggttccaacccttccctccacctgtcctcagggctccaaacgcataggtaaacttgtgcttctgggcacagcttaaacatctactgacaaaaccaagcaggtaccgtccttcagttaatgtggagtccaaaggcagcagtgagttttgtgttttgctttgttttttcaaaactaagatgtgggaagaagacttctcagaaaataaaaatcttgttcttaccacattccacagacttcagtgattaaatgactgtagattgtatgctcctccagcctggtctaactaaaatattcatgcattaaaccttgtgagggagtactgatacttcaacattatctatgatggtttctaactccagtagctgtgagtctgagaaactgcaaaatatactgaattttaataggattctgattgttaagaaaaagaggtaaatccataacaaagaacactaataaacacttaaaaagactcagcaagagtctttaagttacagaatcctgaaaatgtgtatcttttgtgaacttctcaagcagtttctcaattttctcttctattcccacttattcatcattaaaagaaaacactggcatacaaacaaaatacccctaaaataagtgatttttaactgcagttaacactctggcaaaaacactctttttcccaccctttctctttttctctgtatggagtgaacagaccagaaaagtaaggccactacattgtgaaataacctcctggtgggcagaaaggttcaggaaatgctgaaaaatgaaattacggtgctgggtaatatatattcaaaccaagaatgttcctggaccgttgatataagggtttaaatataaatataaatactcaaatataactgtatgcattttctatgagtcagaaaaacaactttccaaaggaaagggtctgaaaggggatcagaatatgctaccccaaaatatgccactttggcataagggttatttgagttgaaggcaattaagaacagcagattcagaaaaaacaacaacaaaaaaaaaaacacctctgccctcctccatctagctaaaagcagggcacagattttcctttgtaaaggtgacatattttctataaataaaggttttcccctttccctaccagagagacttcttacctgcataaacaaaccttactaaacaaccttcatttaccatacattttcctagtcattttttcacagtttatccccctaccccagaagcccaaatccccttgtccttttgtaaccacccaacaggttcattttgcctgctgcccagatggtttatccagagagaggaattgcaacagagaaagaatttaattcatgcagagccggctgaacaggagaccagagttttattattactgagatcagtctccctggaacatttcagagactgggattttttaaggataatttggtgggtagcgggccaggcagtggggagtgctgatcggtcgaattggagatgaaatcacagggagtcaaagctgtcctcctgtgctgagtcagttcctgcatggaggcacaagaccaaatgagccagtttatcaacctgggtggtgctatctgatccatctagtgcaaggttggaaaaatatctccagcaccaaccttaggttttgatgttatccctaggagcaactggggaggtttagaatcttgtggcctctagttgcatgactcctaaaccataatttctaaacttgtggctaatttgttagtcctagggggtttgggaaagggttgttatcatctttgttccaaagttacactataaactaagatcctcccaaagttagtctggcctacgcacaggaatgaacgaggacagcttggaggttagaggcaagttagatgcggttaggtcagatctctttcaccgtcataatttttgcaaaggaggtttcactttgtctagtttcttctccacataatatataagcccccagacctaaccacctctttagggtcttcacttcttttctatgaaggcctctgtatgcatatgtaataaatgatttctcctcttaatctgtcttttgtcagtttacttttcagtgccccaggagcagaacctaagaaagtagagaaaggattgtttttcttttttcctccctcacaatcaccacatatatggattatcaagaaaattaaaggtatgtaatcaaattagcttaattattcttctgctttgacagaggatgggggtaggaagaaaactttataataggcagcctttctagaagtggttcatttcaatggttcatttcaagctactcaattagaatgtaagaatattaccagtaaaaatgagtggtattttatctgaacaactgtttaaaccctttcaataacactgccatagatcatgaaagcatgtcactgagtttctttggaacacagttttaatgggattatagccccccactccacccccagctatgaggaatgaggcaaactaagtacaggacgagaaacacaacctgaaattcaatataaggaaaacccttagacaagcacagcaagagatacaaggagggtaggggagaaagagtgtccctggtagttaatctcaaagataactagtgcaaaatttatagttagttcatcaaattccatgacagctttgtgatgacgcttttctttcattcccaaagccttcaaaatgctactttctagatatttcattccccactcagaccttttacctattggattatacctgattcattccacgatgctgtgttattagaatcagtggttttcaatgttaaatgcactttagaatcagctgcgaatcattccacaatgctgtgttattagaatcagtggttttcaatcttagatgcactttagaatcagctgggaaatgtaaaaaataaacaaacaaaagaaatcacacaaacaaaaaaaacacctgctcccctccccactctttcggttatctggatgggaccagccccaggtgattctaacttacagccaagcctgagagccactagttggaaagcaatccaaacaaattaaaattacataatgaaggaataaacttacattaggaggccaggtacctcgaattcccatcctaataatcagatataatgtgttaatttaaggatcccagattttgtccatcaaatttagaaagactcaattgcatgggatgaaatatatctatttgcccatgatggggttcaggacatactaccctgaaatattgtaagctgaatgaatttgagaagacagcagaagccagaaggtcagaggtcactctctgaccttccttctgccctctctgaagcaggtcataaaacctaggaagaattatctggccttctcctgaagcaggtctaagaccctcctgtgaaaggtttctcacttcccatacctggaatgaaagaacatccttatctctgaaaacaaagggttacagagaatctgaacaaacaggtcttgctatgtttcctcccattgttagctcatgttttcttattcaatcatacttctacacaactatgtacttcttcatcaaatctagcataaaaaatacacaggtttaccagttttgggggtcttcattccattatgaagaatcctgtgtcacataaaacttacgttaaataaatctgtgtgcttttctctcgttaatctgtcttttgttacaggggagtcaaccaagaacctgagggtgaggaaaagatacttctcctccccgaccccataatacgccaacttttacagaggattgaagaaattccaaacatcatatcatagaggtaagcaaaaacagtagaattaaaggttatctaagtcctcttagtattcaaaatatgataaacaaggaaacagagcaggatgcatcaacttgtgttttttattgacaatgataagaataaaatcattagctaccatttatggagtaccagttactgtgttaagcatttcaatgggttacctcactgaaaactaaaaacatccctctgcaatagaaattatcgcccccatttcacaaatcaggaaattgaggctcagagagatttggacactttccccagagtcacacacatagaaagtagcagaaccaagattaaagtccaggtcttttgctctatcgagtccattctcttaactacatcatctgtcacctagaccactgaagagtatcctaagtacttgctactcaaaggacgatccatggaccagcagcatcagtctgttagaaatactgactctctgatcctttccaggtctttaatttaatcagaatctgcattttaagatcagcaggagacttgtatgcacattaaaattaaagaagcacaaacatacatgcttatcccacatcaactattacctcagataaattcattatccataatgcatccatactttttaaaacctgatttacttgacaaataaaaattgtatatgtttatggtatacaacatgatgttttgaaatatgtatcccatgtggaatggctacatcaagctaattaatatgcactacctcaaatacgtatttatttgtggtgagaatgtcagaggtgtttgaaccagagcaactccatcttcaataggggctgagtaaaataaggctgagatctactaggctgcattcccaggaggttaaggcattcttagtcacaagataagatagaaggttggcacaagatatgggtaataaagaccttgctgataaaacaggttgcagtagagaagttggctaaaaccccccaaaaccaaaatggccacaagagtgacctctggtcgtcctcactgctatactccctccagcgccatgacagtttaaaaatgccatggcaatgtcagaaagttaccctatatggtctaaaaagaggagtcacgaataatccatgccttgtttagcatatcatcaagaaataaccataaaaatgagaaaccagccaccctcaggactgctccgtctatggagtagccatccttttattcctttactttcttaataaacttgctttcactttactctgtggacttgccctgaattctttcttgcataagacccaagaaccctctcttggggtctggatcaagacccctttctgggaacaagaacacttaaagtctacactctaagtaatcttcaataatacaatacatagctatacatccatacttttatgaaaacaaatccaacaatttcatttccccatttaaggccattaaacaatttcccaaatgccctcggaataaggtcgaaatgcaggtaaccggactctgcatagtattactcaggctcaccattctcagcaaactaacacaggaacagaaaagcaaacaccacacgttctcactcataagtgggagttgaacaatgagaacgcatggacacagggaggggaacatcacacaccggggcctgttgtggggtagagggggaaggggagggagagcattaggacaaatacctaatgcatgcagggcttaaaacctagatgacagattgacaggtgcagcaaaccaccacggcacatgtatacctattaacaaacctgtacattctgtacatgtatcccagaacttaaagtaaaattttaaaaaaatttaaaaaaagaaaaacatatctattactcaggctcacctctgcagccttattctctccacctcctccagccattgattttcataccctaagcacacagaccttctttctgctcatcaaatcccaacatcccctccctccctccctcctgtcctccattgtactaggttcttccctgccgagaatataccctcactcaccccatcagtgcctccctaccagccccatttactgctctcaccagagcagatgcagtgcctggaacagagctaggagcaagataaatgtgctgaataaaaatatgtttaggatactgagggcctccgctgtttcctttgtccttctcctctgctgttgctgtgatcctcattcctgttgctccttccctgttccctgcatcacttcttttcagtaactcacctccttatcgtaacctcatggctattgaagttgtcagctttagaaagaagcactgccacatccccacggtcattgccccaggattactcaccagctggatgacaactgcctcactctaaccctgagcctcctgggataggaccaatcctttctagagatggacagaaggccccactgacagaaacaggctgcttttaaatcaaggatttaatatataggtggaaccatagatcaggggcctctcagcaggcagtaccgagccaaaagcttcactgtctctctgcccacacaagagagtgtcactgtgctgacaagacaggttatcaagagttgtgaggaacttcatattttaaatgtgatgaccaagtgtgctactctaagaaaacaagtggcaaacaaatccttttataatataaatacctgcttaaagttttaaatcttgaggaaatgtgaattttcatatatcaggcttacaataacaaaaataagagctattatatttatctattgactgcaagctgttaagagcctgacaacatgctcaaagctttaaacacactttcttcttcatcatcactgtgaggtagaaatgcttattatccctattttaagagagaaaaccaagggctaagtaacctgtctaaaaggcacagctgggaattaaatcatgggtccccagacaacccctctactgcttctctgctatgtcttactatatagatcactttctcatctgagaagtcacagatatggacattcccaaagagacaaccccttggagaatgatctcaaaggctgagatttttctctgcaatgtacatgttgaaagcaaagtaacctcctacatcttatatttcaaagctgcacttctgcattaaaagagtaaacagattcaatgaagagatgtgggaacagggtgcttatgaatgcaatgccacaagtactttttcagtgtctactggtggtcaggcactgtggtggaagctgaatgatcagactatcagttgggagagcgtgggggtgggggcatgggggtgatgaggagaacttctcaaatagactgtttcaggaatgtttagccaataattcataaaactgttactttattacctaactatatggaaatcatctttcagaagagaccagagttacctgccttattatctgtgaatacataattgaaagggccaatatgtcttccaaaatgaaagtcacaacttgatagatttctgagagttcatattagagggtcagattttaacatgtgaatgcaaacatagtgtcagaatttgttctcaagtgtctgaaagaacaaaagagaaaagagtaatgggagccaaaaccagactaacttccaaaatagaaacagagcatgttgaagttgcataaacacacaaataaagatggggacacaaaaacatttcctaaagcattctatcaaaggctgcaggaaaaaggccaagacaaggataccaaatagaaaagcataagcctaaaaaggttatccacactactgtgaggactccagaaacctgccttcttgcagaaacgggatacttttgacatgagggcatgagatgaagattgcagactacttcgtaacacactctcctcatttataaaataagagttagattagattatttataaggtccttccagtctgaatgcattaagtccttatcatctatgtggtccttgcaccttaagagagatgaccatataaagaagctcaaaaaacatttgttgaattcatgaagtattacaaccttaccaataataaataagataatttataacaattggtcctggtctgtggccttgaaagagcaaattagaggagaaaccattatctaaagagctacacatctggtgttcctgctagctgactgctggtggaatgaaaataaccctggacttgaaaataagatgcttggttctagtctaatctctgacacaaaccaactgtgtgaccttgggcaaactgctttaccacctgggccagtttcctaatctctaaaataaaggtattctaaaactatatacatatatatatggaatctttattataggccaagaagtgttccaagatctttgcattagaattaaatgatctcaaaggtttttgcagctcaaatgtttagtatctaagtacagaggcagcatggtataattaaaagattccaaattctgtagccagaaaggttggactcctcctcagctctgtaaggtaaggtctttctctaagcagagactgttaagcagaagggcttacagtctcagtccttttattcaccagtgttttaacttgaacaagttacttaactttcctagccttagttttctaatctgtaaagttgatataaaaatggttctcactctcatatagcttttaagaggattaaattataacacatatattttattgaatatatattatattgctagctgtgtaatcatgggctatcttctcaagttttttctcatatacaaatgggaaatgtagtattaaaaagagatcatgtgaacaggttctaaatggtcaagtgttagtggttttggaagcatgtacgttaatacttggaacaccgtatacaacaatcccatatctaacacttagaacagcatatgcaatcaataacaacacacacacacacacacacacacacacacacacacacacacacacacacacacacaaaccctagacttctttctttactaaatatttctagtccaggttgcagcaggtggacacaggccggcagccatgaacgcaggtccacatgggagttgtagttccgagtcaagcggctgctctacagaacggctagaagcgagacttcgtctcccaggagacatctcgccgtgcaaaatggcacgccacgaggtggagtacctgcccgacgagaaacaagaggcgggactgcaactcccagaagcctccgcggccaaggcctcaggccgcaggctgaagccaaggagggagagttcaggtagatccggcttaacatcaggtgcgagtagggaccacccttggtagtctgggcccggcccaggtcagaaccttactaaaacaaccactgtgagtattttctattggtcccagcacatttctgagagaccagaataataatagcagtaaatctgcaagtggtaaactttcacaagcataacctcaatttagatttcggcttcaggcaacatcctttggccacttgacctgggagcattgagctccttgtttcccagataagcgctgtgagtggctgttccaaggtaacacagcgagggcagaatgtgagcctacagagaaatctgcagatgcatctcaagttccactaacctgcctccttaccccccaccaccaccaacttggatatacctttaaaattcccccctttgacgctaaaaataaaaacaacaaccataaaataagtgtaagaaagtccgaccaagtaccgatgagttctcccacaacaataaattcgatgcctctttgcctgtttttgaagtagtaatgtaaaattatctcccaaaatgctgccttctctatactccggtttgctcctgtcctgggcacgtgttcagcaaccccttaggggaatccagagctgcgtgtttaacacagacctgttgggacggattttcgctacttgtctatgaaactgacgaaccatcccaaaacggcgggtgccgactacacccccagagccaagagctgtggcgtccccggacccgctggcgtggccccgtgcctcagtttccccaatgtataaacacggtggaggaggaacgggttagggctagggtcggtgcttgggaattggggggcccgagtccccaccctgagaccctcgtggggcggaagagtactcgggacagaagcccaccgccccgtgagcggcgccggccccactgggctccggggtgatgacctgacgcgcgtggaaacccagacccgcgccccagaaacagtattccacttgggcttgcctccccgcccctaccttccaggatgttgacagctgggaatgaaaggcagagggagggagcgcggggccggagcgccgcctgggagtgtgcccactgggtggccgcctgagggacccgggaacagagggcaaaaagtcctgtgaccggacagagcagagcggggactgcaattc

SEQ ID NO: 2485 - DNA, 1502099 bp, Homo sapiens; identical to SEQ ID NO: 2484
  misc_feature (369735)..(369735): n is a, c, g, or t
  misc_feature (455030)..(455030): n is a, c, g, or t
